United States Patent 10,407,724 (METHODS AND COMPOSITIONS FOR SCREENING AND TREATING DEVELOPMENTAL DISORDERS) - sequence listing, part 65

SEQ ID NO: 1796 - DNA, 43746 bp, Homo sapiens
tccggagcccaagccgccggctacgcgccctgcgcccccttggtgccgcgtccagtgcccagcgcgctttgatgctgcagctccgggccgggccgctctgcttctctgctcgctgggacgctctccgacggctccgccctcgcctctcgccccgagtccctgctgaccccggggaggtggggtccgggccgggcacagccccgctgaggcaggatgttcacgtccaagtccaactcggtgtcgccctcgccgtccctggagcaggctgactcggacgccctggatatcagcaccaaagtgcagctctacggcgtgctgtggaagaggcctttcggcaggccgtcggccaagtggtcccggcggtgagtgcgcccccgcgccccaaggagaccgccggggagagagcctgggcgtcgttacccctcccaccccctccagtcgccgtcgtgcctctgctttcctgtgtgaccttggcgtcaccccttttcactctacactggctcccgcaggaaaatgtggaccatagtctgggccgggagaatggagatggggcccctgccctggggcggtggcaaattctctatggaatgaacctgaccctcgagtgggaatgttgggtgtgggcagaagagaccgtggtcggggtgggatcccagctaggtcagatcaggccagactgaggggaggcagaaactccatctctagccaaagatgcccccaaccccgggacccccactgtcaattccatcgtcttcacaacccctgacccaggccgcgaggaccgggcctgagtgtctccctcccgccaaccacccacccttaagacggagagggacctggcccttctgaaaggctcaggctaaggagggaggaagggccaggaagggtgcttgtccatggggaagtgaccttggcaacccctccaactgtcccttgaaataatttttttaaaagtgagcacagggaagagagattctagtgcttcagacggaggagctggaaaggagggaggcagctggagtgaaggaggggatagattggttctgccaaggattgatcctctgaaaggggtggtggagagagacagggtagtcccaaccatccttcagccccagctgcctggtccccaactcagacgcgactccgcggacatcggtagccactctccacttacaaattagcctgggaggtattgagggaagagggagttcacagccctggacttgcaggaagctcccaactggctgcaggtgctgtgggccattttctggacagtttccactctccagtcaatttcagttctgagattcactactggtatggcctggagaatgcagaccctgtccagcccttccgcggaggtgtgacccttccaggaaaccaggggtatccagatgccccttccccatcccacactctatgagtctgcccctgagcagagggggcctccaatgttcccaggaccacagatcatgtggatgtggtagtggtgggtgctgatgttctgttctgatgaataatttaatgtttctataagaccgcagaacaaatggagctgtggacagtagctcacattttatatctctggtttcatgttgttttgttgcttctgacaggtttctctctgggatttaatgggatacaggcttcttgagttcctccaaagttcagcttatctctgaccccctaaatgaaggcttggagcaacatggagtgtatttggggagcttccagtattgtgctatgtgagctacagcccccagggccaggagagctggggtggaaaggctgtgtgtagattcaagcacaattagcagaatatctccccccaccacccatctttcttctgcctcagcagctccagatagttaatctttcttttctattgggtctggctgctgttctgggtcctgtcaaccaagacttctcttgccagacattttcacctgacagcatccctagaaaatgctaggtgcttgtgacccccagggtatgtcccctggtcctccccttcaccactgcaggtacattgggaaactggtctctgcacctacagttgattccagggctaggaagtgtcaggagtacagggcataggcccccagctaaaagcacaatggtagtgccaaggaggcttggagaggtttagtgtcccccacccagagactccatcttctcctccatccactaccgtggcccccaaagccacccgaaacgatgcaatcagagtctgagcagtatgtatgctctgctaatacagctaaaagtcaagtcctttagcctccttccaaggagattgttacctgggttcccttcctttgtaggaatttcagagctgccactgtgcaaagactacctggggctcaagaaagaactaacatcccacctgcccattctaggcctctgtgttctcagttctgggaatacacaacacacacacacacacacacacacacacacacacacacacacgctatttagtcttgggtcagtgacagagccagccagagagggcctgggtgtgggggagaaagatgctcagctcagccccctctcacttcccatcagggccccctgggccccagcttcccatttgtaaagtagagtctgtgggctcagctaattagcagccacaggaagacttggggacagagcagctgagggccgccaccgcagagccttgccattagggcgatcaatgccctggctggagcagttaaggggagggggcctgaaaagtctcagcactgcattagtaaagaataagctggagagaactggctgtggccagctgggttctataaaaccttttccactcagggtctgtcttaggacctgtgcctccagcttccaccgcccaagcagccctgcctgcctggggtgggaaggtgcccttgagctgaagggtcaacttatttcctgggggcaacaaaaggggaagggaatcaaaagcattaattagcagagatcagataatctgggagagatgtctagaagggaaggctgttgactgtgtcctcatcttggtctgtgagtggagatggaagtgcaaagacctgggcagtgccaggacaaagaggaagggggtgggaaatctcagcctcagccagtgtcatgctgtgagggcttggcctagactaattctttcctgagattgaatgctttttccagcattctattccacctcccaaatccctgctgaacacttcccaaggccggaacccctaaggaggaggacccacccacttccttcctgcaacaggagcatctataatcctcctcaccccttctcctccccaggggcagggtagccagtagggcctgaaccgagctccgcagtttactcttgcagagcatcggtgggtccctgacttagggagctaagattcattgtgtccacctggtgccagtggagccatggagacagtggccatgtgtcctaaatctcaggccacaacctgtacagtgtgtaaagattatctgtgcagatgagggtcaccatgccaaaaagactagaggagactttcttcccacagggatttggagcccagggttttgactttggtgctcagcactgcttcccagaggtgacaccaatgccgagctttcccagagcagagagaagagcctatcatgtcagcttcacggcactaggctcagcctcaccctggtgaccctggggtttggtctcactttctggcacccctggcatttccctcagctggctgtgtgaggtatcccacaagcagaattgtaacatttcctctgtggagggtgcctgaaggaccccctttaaaaaataaacttctattcttcaaacttctaccagagtggcaacatagggtgtggggaacagtgaccaggtggcagttgaggggcagggatcttctgctaatgtgtgtgggaagttggggaggggacagagcagaggagctctttcagcattgataaagaagaaggacttggggaacagtgtctctgcctccagaaaaaaaagtgaccaaattactttattctgaagatttcatagtgtttttcactctctggctccttgttccagagctgttctcccaagctcacgataggaaactgaggcacagaggcagggggaaggtgccttttctgagtctcctcagattcctctacccatcaccctcttccctttctgtgctggtagcatccaggttacagtgaatccttgggttagggagatgggcacactctctggatcacccagccataaatgaaatgatacacatcaggtcactggggtcgtatgattatttacccagaccaggtctgccaaagttaagtgagttaattgtgcaaacaggtggcatttctttctcacccactccctgaggagctgccctccatggctgttgatgtcctatttgaaaatgagtctcacctgtgtatgggtcagacctccagcttgcagagagttcagcttccttgtacccaagacttaaaaataacaaagtaattgcttctgagagcagctgtgggtatggtagaaagtgaatctaaggccgggtgtggtggctggtaattccagcactttgggagtccaaggtgggtggatcacttgaggtcaggagttggagaccagcctggccaacatggcaaaaccctgtctctactaaaaatacaaagattagccaggcatggtggtgggtgcctgtaatcccagctactcaggaggttgaggcaggagaatcgctcgaacctaggaggtggaggttgcaatgagcagagattgagccactgcactccagcctgagggacagagtgatactccatctcaaaaaaaaaaaaaaaaaaaaaaaggaaaaaaaaagaaagtgaatctaagcttagaggcaggtgctccaagttccagccccagctctgccagtaaccagctgcatgatccaggctgtggcatttcaccccactggccagcagtgtctcatctatagagtgggaatgggatgggtcaaactgtgtgccacaaatgaccccagaggtgccttgagtctaccacaagggaatggggaacaggggtacagctccaagactccccacccacttcaagcaatacctctgcactgttatatatattttttgtttgtttgtttgtttgtttgtttgagagagagtctccttctgtcaccaaggctggagtacagtgtcgtgatcttggctcactgcaacctctgcctcccaggttcaaggaattctcatacctcagcctcccgattagctgggatcacaggcatgtaccaccatgcccggctaatttttgtatttttgagtagagatggggtttcgccatgttggctaggctgttctcaaactcctgacctcaggtgatctgcccgcctcggcctcccaaagtgctgggtttacaggcatgagccccctgttatatgttttacaccagcagtccccaacgtttttggcaccaggtgccatgactggtttcatggaagacaatttttccaaggacaggggtgggtgtgggggtggtttcatcaggcattagattctcataatgactgtgcaacctagatcccttgccatgcacaatttacaaaagggttggtgctcctatgagaatctaatgccgccgctgatctgacaggaggcggagctcaggcggtaatgccagccacggggagaagctgtaaaaacagatgaagcttcacctgctcatctcctgctgtgtggcccagttcctaacaggccatggactggtactggtccagggcccaggggttgaagactcctgttttacacattacggttgtcttactgttgttggaatacttgttccagggggactaagttttttgagcccccttggacttgataatctctctgaactctaatgtgtcatgactcatgcatttcacagatagaattcctgctgttctgccatcttagactggatgccagatgagaagcacaggccaggatgagcatttcctgagcacaccaggccatccagaatggacacaagggacacacactggggctgtgtcatttctaccttccttctgccagttctgaaaaggacacttctgagggcagtccttctccagttccaccccctacatagccattctcagtatccaggaggctcggagaggagggagactggctgctgggcctattctggaagtttgtgcccggggaagagggagaagccaggctggatgttcgccttcctggaaaatgtaactcatgtgtaactcacacatccactaggctcttgctgctctcttgagagtgagataaatttggtcccaagaccaaatcccatatctaaaggaagtctaaaatctgtaccaaggtttctgttaatctctaagaggctgtaaactagtttcttggttgatggattaatttgctgaccaatgtacacggtccttgttgcacaaccagaggtggaactcagcttttattcctcagttttccagccttccacactgctgcataaacacagcaggtatttatgagtctagcagcctatcctgaagggaagctgtggcaaagaggagggcagaggaggtatttaaattacagaattgcaaacatcttcaaattgagcgttaggtctctggtaggcaccccacctcgctgtcaccagagatggtgacatcactctctctctggactcttggatcctcccaggatcctctctcctctgcactctgccatcactcctcctccctattgtcctacaggattttccccaaattcaaatttctttcactctgttaagcaaagccctttctagctcctactcctaaactcagtggcattcgcatctccaaacattagggagctcacctgagtggacagagactggataggcctttgtttaacaggacctgcccaacatagaagatacctgtggttctagataacattttccttggctccagatgggcttatcatgaggcagtggtgaccatcaagctctggttgagcccttgttgcattcagagcactggggaggggggcagaagatggggacaaagctaaagcttgagaaaacccttcttggattccctaattcatattggatggcacctgtgccactctgtgacccaagctagagtcctggtcatcgtgtcatcccagttcctgctcactctgcccttgtttaacatttcgatgagccttgctgatttgtacctcccaataaatttaattttccctttgcctggttgtggacttccctatggctaaaactacaatatgaccttataagtgccctgtttgaaacttgctggcagctccccttgtctgcaggaagaagtccagcgtcttcacaaggactactcactctgccccgctctgtccctgctctctgaccttaactcactccttaccgcacctcccctgcaccactgcccaccctttgcactttctgccaataataccagagatatttttataactttgaacacactattctttgcctatgctgttccctctgtctggaatggatctctcccacttccatttccttccaaattcccaagatactcctattcattcttcaaagccctgcttagttgtcacatcttggggagctcccttggctggacccctaaaccattgattcctcccggtcttcactcttcctatacctaatataaacttacaatgttgcaatatattgtggcacattacaatgttgcagtctactctcctggtgtgttgtaaagttacagtgtactgtggtatgctacgatgttgcagagtacttccctggtatgttacaaagttaaagcctaccctggagctttacaatgttgcggtgtatcctcttgatgctttacaactatcctagctcccccattcccagctatgtgatctggggcattatttaatttttctatgccccagtttcctcacctacctcatgtgaggagttgaatgagttagcacaatgctgttactagaacagtgtttagcacctagcacaaaggaggagcttgataaacattaggtgttttgtttttgttttttagggtcttttgagacagggtctggctttgtggcccaggctggagggtagtggcatgatcacagctcactgtagcgtcgacctcctggtctcaagcaatacttctacctcagcctcccaagtagctaggaccacaggcacgagctaccatacccagctaattttttaattttctgttgagacagtctccctgtgttgcccaggctggtatggactccggggttgaaatgatccttctgccttggtcccacaaagtactgggattacaggcgtgagccaccacacccggccaatattagctatttttaaaagtatgttggtttctacactctttctcctgcttttgattatcagctccctgaggtcagcaaatcatcaagctccagggcccagcatagtagcttggtgtaccaggggaatcagtcatgctctctgacctgagctgaccagcagcttgcagtcactctgcagagatagcagagataagctctaggaagagaaacaattccagtcacatgtaatgaggaggaccaggcatcacagagcacagcaggtgagaacttgggctttgtcagcagaaataaccgtgttctgagtttgccacttactagtcgcttaatctctatgcctcagtttcctctctagtgaaatagtttcctatttcactagagaaacctctgtgcctcagtttcctcactagtgaaatagaaaaaacaagcacgttcacaactatcctagctccgccattctgagttgtgtgatctgggacatattatttaacttctcttagagttgttatgagaaatttaaataagataaagtcaataaaacacttagcatcagggcctttgcacctgcagctcctctgccagaaacaccttacctctcctcaaagattaccttcttaactcggctctccctggccactctcttagcaaggtgagtgtcctggcaccctgcgaatgctctttaatctggaaatgaaaatactattctttatgatgggagagagagacagccagcgttgacacaagccccatacctcacccaatgctccgggcttcaccccaacacatggggacagaaaagggccagagctgatgggcaaagcttctcccaggattgatgttgggtctggaaggagggatgggcttcacacggggggcagggggaagcagcatatgcagggataagccatgtgttgggaggtcagggagctggccagctgggctggagccaagagctccctccagtagcagccttgtgagcacaaatggaaaaggaggtcaggggagagtgcagcttattattactgagtctgaacccaatcataataaataataattttaatcataaaagtaatcatttattaaatatttaccaccatgttctaagtctttaggggaacattatcctgacagctctatgagatatagttattattattatataggtattattattattatcctcaagttgcacggtggggacctacctaccttaggtaacttgccccagtcacattgccagtcagtggcagagctctaacattggctaccccaaccctgaaacttacagcctctggcccatctgtttcctggtcaggagctggatggagcagctccttaggcagtggctgtgggaagtaggtgtagggactattgaccatgggttccaatcccagttccacctctgccctaggagtatggctttgcatacactgttttgcctctaagcctcagtttcctcatctgtgaaatgagaataaaatgcccaaccgtccacaattgtgacgtggatcaaatacatgtggaacccttagcacagaagccaatgcatgagaacagctgcagaaagggcagccatctctcgcccttgggccgtctctagccagaccaactgcgcagggcctgggaagacgtggcccctggcttgcagtcagaatgagagtgtcagggaacaaggggactttggaatagggtgggaagaggaagtgtacctctgtgcagggcactggtgttctgagcccctgcctgttgagaagatgctgagaaggggcagctaaaatagcagggctgtcactgagacaggtttataagcaaggccagatctttgggtcctagaaatttgcttgccaggtgagccctccgttgggccgaactcattcctgcctgccaggccatcgtcctcctcctccaggtccatgctagctcccctcccttgacccccatctccacccaagccattctggggacagctgcagccaggccgggtgtggcatgtgtgatgtgtgggcccttcacaatccctactgaactctggccctcacagagcaaagactaccctgaacatccaccttccttcccctgcccctctttatgctgtccttcagaagcacgaggagaagaagggatatgacattagggaacactttctgtgtgccaggcaagtgctgaggactttacatgcctccatccactggatcctctcttgccccctaacgatatgtggcaacatcccctaatgaatctccctgcctttaccctgacaatctgccctcaacacagcagggtcgagacttttgcaatgtaagccaggtcactcctgctcaaagccttccagtggctgtctctcttactcagagaaaaagccagcctctaccaactagtgctgtgaccttcagcaagtcatgcctcctctctgcttcatttctgaccatgtaaaatgcagggagcatttctctcatagcatcattgtgagtggtgttaagtgcattaatagcagtaactgcttggaatgaggtgtggtatgtggaaagtactctataaatgttagcttgatcattattgtcattaccatggccatagagccctatgcaatctggcccaactgccgcagccttgcagttccctcgagagctaggcacacttcctgcctcagggcctttgcacctgcagcttctctgctggaaacaccttacctctcctcaaagattaccttcttaactaggctgtccctgcccaccctctttgacatggacccatgcccactcccaattccccctaacctgctttattttcctccatagcatatgtcagcatctggcacatgacatctctatgtctcatttattcgtcatccgacacccactacatgcaagtagtgtaagctctaaggagacagggatttttgtctgtcttgttcacaactgtatctccaacacctagagcagtgcttggcacacagtggcaactcagtaattgctgaatcaatggaggaatctttataacagccctaagagacagttatttgtacccgcattttatagaggaagaaagggaggcttagtaaggctgggagtttgcctgaggctgcagcttgaaggatgggggttggtggaccccagagccctgtgctctccttgccatgtgtctaatgatcttctgcccacccacttcccagccctggcacagtgcttttccttaagtgggtggggctccagaagtgacaggaaggcataaaggtatttatttgtttcagtcagcttgggctactataacaaaatgccatagactgggtggcttaaaccctggaagtgtatttggtcacagttctgcaggctgagagtctgagatcaagttgcccacatggtcaggttctgatgagggcacctgttcctggcttgcagatggccaccttctcaatatgtccccacacggtggaggaagaggaaaaagagggtgaaagaggtttgatttatttatttttgcaacagggtcttgatctgtcacccaggctggaggccaccctggagtgcagtggtggtgtgatcacggctcactgcagctttgaactcctggactcaagtgatcctctcactcagcctcctggctagaactacaggcatgtaccaccatgcccagctaattttttttttttttttttttttaatgtagagacaaggccttgctatgttgcccaggctggtcttgaactcctgggctcaagtaatccccctgcttcagccttccaaactgtcatgattacagatatgagccactgtacccagccaggaaagagagctcttcttataaggccacagtcctattggattagggccctacccttaagaccttccttaacattaattacctcctaaagaccttatctccaaatacagtcacatgtggggttagggcttgaacatatgaacgttgaggagacatattgagtccatagtagcatttccaaagccattgagaggagatggtggccctggagacagtcgtgtgctgcttactgcagtgactgtattcagaccatggaatgcatcactcagcgctgtcctgagtcctccgcagattggtggggtgatgagcgcaatctcatttgaccctcaaaataaccgcataaggtagttgttattatccccattctatcgatagagaaactaaggctcagaaaggaaagctgacttgccgaaggacccccaaccccagccggaaaatgtcaggtctctctgatgccaaagcctatatgctcttaactactctatgaaattcccttggaacagccaggggacacctacctgggcccatgggactgaagtgggatggacttgccctccaggagcctgatgccccattggggcaagatgcatacatgggatgtggcagtgggcctaagtgccaagtgcaggctctgctagcaagtgcagaaggagcccagaaatcagtgtggcctgggtgggtcaccaagggtgggaagggtcccgctggctgaagagaaagagggagggcattccaggccaagccacacaaactccatgtgcaggaccacgcaagtgtagcaggcaggggacagtgagctcggcagttgactggaggacagagaggctgaagggcagacatggcaggaaagctgagaggtgggaagaggtcaggtgctggcaggcctggaatgtcactgaggttctgcagcaggtggtattcatgtgctgtttccgcagtgggggcagaaaggcctaggacgagcattggctttagtagggtatcaaccctgagcaggggccacagggctgtgtttgttatgtggccggtcagagagggtaggttcaggtaaagaaaatggggctgagtacagtggctcagcctgtaatcccagcactttgagaggccgaggcaggagggtcacttgaggccaagagttcgaggccagcctgggcaacatagcaagaccctgtttctattttattttgttttattttattttattttattttatttattttattttattttattttattttattttattttattttattttagagagtcttgctctgtcactcaggttggagtgcaatgatgttatctctgctcactgcaacctcctgggttcaagcgattctcctgccacagcctcctgagtaactgggattacaggcctgagccaccacacctggctgatttttgtatttttagtagagacagagttttaccattttcaccaggcttgtctcaaactcctgacttcaagtgatctacctgcctcagcctcccaaagtgctgggattacaggtgtgagccatcgcacccagccttctatttttgaaaaagaaaagaaaatgggttgacatgaggctcacaccacagcacagagctgagcttcactttcctcagatggcagctgccagtagtcccaggcctgcctccgcatagcagctgtggccttaggaaagatcatgtggctggtaggaccttcagagattcactgacttcgtcatgctcaccagcaaggtttctttttgttttctcttctcttctcttctcttctcttctcttctcttctcttctcttctcttctcttctcttctcttctcttctttgagatggagtctcactcgtgttgcccaggctggagtgcagtggcgtgatcttggctcactgcaacctctgcatcctgggttcaagtgattctcatgcctcagcctcctgagtagctgggattacaggtgtgcgccaccacacccagctaatttctgtatttttagtagagatggggtttcaccatattggccaggctggtctcgatctcccgacctcaagtgatccgcccgcctcagcctcccaaaatgctgggattgattacaggtgtgagccacagaacccagcctcactggcaagttttcaagcccctcacaagagggcccattcgaccagtggcgtgctggcaaatgcttacactaggctcttgggggagggagctgaggcaattctgtaggattggacttgcatggtgcaaatactcccatcacagccactattgagctaccaacaccatgtgaccaaatgcagagcagggaagagattgacattgtgggctcttatgagcccatctgagctggctccaactctccctgcatgtaaactttaaactctcatacgtgcacacacacacacacacacacacacacacacacacacacactcacaccagctttcagaatcgccaccacattctgctcacaccccgtcactacaacagcacttattagcaggggccctggaggaaggagccagccactctgggtgtccctgaatctctgggctttgagcgccaatcggaccttcccctagagggtgcttggtggctcatcatagctccaaacatgagtcctgggagagcccctggggcaggtccaaatgctccacatgttgacctcaaggacgtggcctccccagcagtcaaaaagcaccaaagtcacagagccctcagttagacctgagtcccagaaggagactggggagtagcccgagacaaagggaagaaggagactggggagcagcctgagacaaacggaatgccaatgtcacactggggtgctcggggctgcagattgccagctttcatgttacttgccaaagacccatcttagcatcttgcatcttcttgcgttccttttcctagaggagaccctaagtggctggaggtgagagctcaaggggctgaaggtgtccaaggggaagaaccacagctctcctgctgtgctgagccagggtggtggttcagcgggacagaggcagccagacctggaagccagtagtggggctcccgctccagctggccacctgtgcaggggcccagctgcctgtggggacgtcactggccagctgaggcctttgtgagggtgtggagcttgagttggtaaggatggctgagctggtgtccctgtgggctcccatgtgagtccagggcccccaagggtgctcttgttgtcccaagaaacctcaccccttctctcctggttgcttttccttccccaccgcccactataggtttttcatcatcaaagagagctttctgctttactactctgagagcgaaaaaaagagctttgaaaccaataaatacttcaatatacatcctaaggtgaggcggcccctcccagggccacagcaggggagggcccagtgcgggcatcagagcttgcatcttgtgaggggaggggactgcgctcttgctctggcctagcagagagtctggagagcaaatcctcttggggcaaaagaccccctgcccctgtcctgggctggaccctcactctcctgtgccccagaccctgccccaacccttcctcttctctctgaacatcagttctggcctctgtcccatggccccagggtctagcttccatcctggggcacttggcaggaactggctttgtccaggggcccccagaacccctgagtgaccccagttgggtggggtgggggctgcctgttctggttcttcctcagggcgtcatccctctggggggctgcctggtggagcccaaggaagagcctagcatgccctatgccatgaagatctcccaccaggacttccatgtgagtaaagctcttccctcagcctgggctccgcaggagcagaccagcctctcaggcctcttcaggacacacatcccatgtcctggcctgggagaggggcatcagcacccagggatgtggggtgggtgacagggcagagctgggcctccatcaccctcagcgtggctgcctctcaggcatgcgcatggctcctcttcctggcaggggaacatcttgcttgctgctgagtcggagtttgagcagacccagtggctggagatgctgcaggagtctgggaaggtgtaagtgctcacagccaggagggcagcctgcagatccaggatggggtgggcggggctgcccctgaactccctgcctctctgctgggatcctggtgggcacagggccagggctgtgggagatggctagggtaggggagagcagacaggccaggttttagagcatctgtgaggggtcccctgagtgagcttgaaaagtgtctaggtcacaggtggcaggtgtgggtaccatttgtctccaactcttgggagttgtatttgatgcctcctgacacccatctcacctccccaggcccataattaattctagcaaggactagagctagtgctttgtaaattagggtcaagatcacagaaatctcctgccaacccagtccatttttatgtaaaccactgtcctgacacctgcctagtcaggctaggtcatgcttttagttccaaaaacaccgaccgtgtgctctgtggcaggccttgcactgggtagcggacattcagtaatgtaaaaaagccacccaggaagcaatctcctccctgctctaaaagtgctgttggcccagcccccagtggcccactttgcagcctgggccagcctccagctactgtaactgatccgtgctggtgacatgcccagagccatgggtgccagagtgaatgcaagttgagattctggaggagaaagggtgggcgagtacaaaacgtatgccttctctttcccctctacccttctgttttaatgattttctgtttcttcctcttctctcctctgtcccatctgccctccctccccaggacctggaagaatgcccagctgggagaagccatgatcaaaagcctggaggcccaggggctgcagttggctaaggaaaagcaggagtatttaggttggctggaggggtggttccctaatggtagcagcacttggggaccaggggctatagccaggggcttggtaaaggatgcagcagggatgagggtctctcaggtggggctatgagggaacagagaccagtttggcacctggagggcttcctggtacactacgcatccttttggccaacatgactgaaggcaggagcgtctgatggttaagagcctgggctctggatccagcttcatcatttgtcacccatctcagctgtgtatatctttaggcagctcagcctctctaagcctcaatttcctcatccttaaaatcgagttaaaaatagtctctagcttttagaggattgggttaaatgagacaatgtctgtaagtgcttgagccagacatgcagtaagggctccataagtggagttgatgttgttatcctatcctgggtccccagggtctggcttgtccccagtacccttgccccaggccattttaaaccttgccacagcattccagaccttgtgcccctgacaggttggtaaacatgcactgtttgggagagaagatgagactgagggtttgccttcagcctgggaccctctcccctctgcctgcttagacacttggggccccagcacttgctcccctatgcctgcttcagaacttcctaggttctgccctccttactagccagacattagtgcaggtggaaggtgggtgtgggactagcccaggtgcagcaggcctgggggatgcagagactgctttgaacttccaaggatgaggcccctcataaccctaggaaaagaaaaagcaggatgatgatgggggaaggagggtggcagcttccatcaccaggagctggcccaccctctggctggcagggctgcaggccccttccttgggagatgctgggggtgacagcgaccacctcaggcaccagctccctcaggacctcagagcactttcctgattgtgtgtgcatgtgtgtgtgtgtgcttgttttggcagacaaactgatggaagagaccgaagaactctgccttcagagggagcagagagaggtaggtgcacaccaaggggctctcagcagccgtggtgtaatggctcacgtttctagcactagggaatgatgcaggggagctgggtgcacagaggacttgctagaagatcagatggggcagggcggggaggccaaatgggatcacagtgcttgcttgggacttgctgtaacttgttggtaagaagtgtctttctccttaccaacccctgggagtaaagtgaaaagggtgggtgatgaccttctagagaaagagccatccaaagtgtcatcagctgcatcagttggtaatgagctgcttgtcaatgatgttcacgggagctataatgccctctgttatccatagagggctatctggcacctgagggtgattgggcttgatgatctcagaagttccttcattctctgaatgtcaaaagtccacagcaggctaagcactggcttgaggcagactggagggtaaaggagactcttgccttgtgtgaaggaggggagccaccgaagccctcttcttcatttagaatctcagtgcaggctgggcgcagtggctcacgcctgtaatcccagcactgtgggaggccaaggcgggtggatcacctgaggtcgggaattcaagaccagcctggccaacatggtgaaaccccgtctctactaaaaatacaaaaataagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaataagccgggcatggaagtgcgtgcttatagtcccagcttttcgggcagctgaggcaggagaatcgcttgaacccgggaggccgaggctgcagtgagctgagattgtgccattgcatttcagcctgggcgacagaacgagactccgtctcaaaaaaaaaaaaaaaaaaaaaaaaaatctcagcgaagcactgggccttgcctgttctgaggagtcattaccacatattaagggcagggggcggtagtgggtagtaccgtggattctggagccaggctgcctgtatttgtatttgaccttcaatacttctagctttgtgacctcaggcaagttatttaacttctccaaatcttcttatctgaaaaatgcagatgataatagaatccatcttagggatgttgtgatgatttagtgagatgttccatataaagtgtttggcacatagtacatgcttaacgaatatctgtgtttgttagcattatgatcgtattattaatataggcccatgctgcaagtgaactgtctgaggcctgaagcagcagagtggcttgaccagagcagcctgcagagggagggccttatttagttcacttttctttgcctagtcacttgtccttgtcctctcccaggcaagtcacagggcaggggctatcagccttggctcagaacctctaacttgactcttaggaagtcctcagttttcccacccacccctccctgggctctgaaacaggccatatcatcaaaaagcatcatgtcccctttgcaccccaaatattcccagggcctggcacagctcctggcccaagacgagttcttggtaaatgtttgtggaatgaattagtaaatgaatgggattgatttttcacaactttacatcttaattttaatccaacaggacaatccaccctcatttttcttcttctaaaattgtattggttattcttgctcattttatccttccagctggacttcagaatcatttcattgattaaagagaaaataaaaaaagaatggggatttgtatttggatggcatggatttgaggactggcattataatggcaatgagtcttcttccatcaccagagttggtcctctgtgtctccaggctctcctctaggtcctgtgttagggttttggcattttctgcacacaattctatacatttcaagcaaggcttctgtattgtcagcaaattaaaaacaggtgcccagggatgggatggagtggcagacacagccactggcagggagagagacagacttatccatcagagaggctaaatctggggcagcagttggctggaggaaaatttagacactctatctaggtctttagccaggaaattaggacagcggagacccactgcacacaggcctcccttaatgccacagcacagggaaggagggaggcctgtcagctgtgaactccctggctttctggtataaaatgtgaatgagactcaggcccagctggtacccaccatgaaggctgttctgggcatggagagaactgtgcctcagttctcattttttgtcagctgcatgctctagatctggaatagagctcaggttctagtctttgccactgagtcattcagtcaaagtttcttcttccttaactttctcatgcataggatgggtctgcctgtctcctgcacttttcccatctgcactcaggtcagagattgtctgggtgtgccttgagccgctgaggcaattgatgtaatggcctagtgataagatgaaggttcttctgctgattgctgtggtctctttgagacaacatggcctaaagaaagactgaagatatggaaccaggagacctggattggagtcttaactctatcactgactgtgtgatgttgggcatgtcagttaccctctctgagcttcaatttccccccatctgggatgtctgattagagttatgctggctgctgcgtacttctagggttgctgcgaggcccaatgaagtagaacgcggggaagggatttgtgaactggaaaggcccttgtgcactgtgtgatgtacagtcctgacatcctccatgcagcagaaaagtcctgggactctggaggaatgagcagagcgtgcagggggaaccctcctgactcatcttcccagagccggaagtccatgcccttccctgggttcctggtctttggctccctctggccttatccctctcacccctggaggagggcagcctgcctacctttccccttctgactgagttgtgagagctcagccatgcacatgagcaggtgcaggagaaaaatcagaaatgcccagggtagggcagggtttctggcaaggttcttgccacctggagtgctcacagtcagagtacagactctttgagttggaaaaaatgtgccactacaactgaagctctttgtcaacctttttggtggacattgttcctggttctgtgacgaatgactcactacctccagaggtgtcctttgcatgatttctcagttatttgaaagctcttcctttcattgagctgaagtgtgccttctagtgactttttctcacctttatactcctgcaacttaagtcagacccaagattcagcagaacacacgatatagtagagaaaggtttgaattgtggcagggcttagcagacaactcagtctataatggggctgctacaaacactcaagccatgctgggcttcaggaacagcaagttctggctgctccaggtttataagtggtaacttccactcttatcagcattctcaggctacacttggacactggcttcctttaagaaacatacaggtgaagtgaaaagtggaaaagaaatgagaaaggaagtgagaatttctctttccttaataaactttattttttggagcagtttagattcacagcaaaactacgcagcaaatacagagattttccacataacacttgttccccacagggttccccactgtcaatatccagcaccacagtgatacatttgttacaatcaatgagtcaacattgacacactgtcacccaaagttcatagcatacattagggttcactcttggtgttgtacatcctctggattttggcaaacgtataacaatatgtatctaccactgtagtatcatacacaatagtttcactgccctaaaaatgctcatttcactgtcctaaaaatcctggcaactgcttttttttttttttttttttttttttttaaagacggaatcttgccctgttgcccatgctggagtgcagtggcgcgatctcggctcactgcaacctctgcctcctgggttcaagggattctcctgcctctgcctcctgagtagctgggaatacaggcgcgtgccaccatttttgtatttttagaagagacggggcttcaccgtgttagccaggatggcctcgaactcctgacctcatgatcccccctcctcggcctcccaaagtgctgggattacaggcatgagccaccgtgcccagccactgctgatctttttactgtatccatagttttgccttttccagaatgtcatgtagctggagtcatatggtatgtagcttttttagattggcttctttcacttagtaatgtgcattcaggtttcctccgtgtctttttgtggcttgatagctcatttcttttcagtgctgaatgatattaccttatccgcatgtcctacagtttgtttatccctctccctacttaaggacatcttggttgcctccaagttttgacaattatgaataaaattgctataaacatccatgtgcaggtttttgtgtggacatacattttcagtttatttggaaaagtaataaggagtatgattgttggattgcatggtgaaaatatgttcagttttgtaagaagttgccaaactgtcttccaaagtagctgtaccattttgtatttgcagtagcaatgaatgagagttcctgttgctccacatccttgccagcatttggtgttgtcagggatttgaattttggctattttattttttatttcaatttttagtttttgagacagagtcttgctctgttgcccagactggagtgcagtggagtgtggctcactgcagccttgaattcctgggtttaagagatcctctcacctcagcctcctgagtagctgggactataggtgcactccagcacacttggctaatttttttaaattatttttatagagatggggtctccttatgttgaactcctgagatcaagtgatctcccctcttggcctcctaaagtgctgggattacaggcatagccactgtatctggctgattttggccactttcatgagtttagcggtagctcgttgttattttaatttgcaattacctaatcatatatgatgttggacatccttttatatgcttatatgccatcttaaaatttttatttatttttttaggccgggcgtggtggctcacgcctgtaatcctagaactttgggaagctgaggcaggcggatcatgagatgaggagttcgagaccagcctggccaacatggtgaaatgctgtctctactaaaatacaaaaattagccgggggtggtgatgtgtgcctataatcccagctacttgggaggctgaggcaggagaattgcttgaacccaggaggcagaggttacagtgagccgagattgtgccacagcactacagcctgggtgacagagcaagactccatctcaaaaaaaaaaaacaaaaacaaaaaaactatttttgagtcagggtcccacactgtcatccaggctgagtgcagtggcgtgatcacggttaactgtagcctcccaggctaaagtgatccacctgcctcagcctcccaagtagctgggactacaggcatgcaccaccatgcacggctaattttttattttttgttgttgcctgccacaatccctggtggactgaacaaatgggggcaaacatgggactaaaagacaagagacgaaagagtatatttggaagaaggggtctggggcacctcacggacaagtgccctgagctttacacagccctccatatttattaggcaaaagagatagtgagaaagtgggggtgattatcgggtaattgtcagttgactgtttgattcacagcaagcttgtgagactgcattctttgaacaataggcactagattctcaacaggtaacttcaaggagcccagcgccagggagtgatggccctcagtaagccttttggtggcaggtgtgtaagtttgctcacattccacattcatgataaacagtttgctgtttgatcatatagccgccagtagaatgctgagttggtcacaatccctttggccttttcggctcccaacattttatggagatggggtcttgctctgttgcccaggctggtcttgcattcctgaacacaagtgatcctcccactttggcctcccaaaatcctgggattacagatgtgagccactgtgcctggcctgccatctttatatcttctttgctaagatgtctgggtcttttgcccatttttttattgttgagcttcatgagttctttgtatattttgcataacagtcctttattagatgtgtctgggaatgttttctcctagtttgtgacttgttttcttattctcttgatgtcattcacagggaataaaattttaattttaatgaaatccatcttatcaattacttccttcaaagatcatgccttttgtgttatgtcttaaaaagtcagtactgtagattttcatcaccttgataaaaatctttttgtagacatcacctaggttgtctcctatgttatcttctaggagttgtatacttttgtgttttgcatttagctctatgatccattgtgatttattttttgtgaaaagtgtttaaggtctgtgtagagtcttttttttttcttttgcatgtggctgtccagttgttcaagtaccatatgttgaaaagactatcttaggccacgcacggtggctcatgcctgtaatcccagcactttgggaggtcgaggcgggtggatcacctgaggtcaggagttcgaaaccagcctagccaacatggtgaaaccctgcctctactaaaaatacaaaaattagccaggcgtggtggcgggcgcctgtaatcccagctactcaggagactgaggcaggagaatcacttgaacccaggaggcagaggttgctgtgagccaagatcacaccactgcaccccagcctgggttacagagtgagactccatctcaaaaaaaaaaaagactggcttttccaatactattgtactgcctttgctccattgtcagagttgaattgactatatttatgttagtatgtttccgagctctctattctgttctatttatatatttgtttattttttcatcaataccacaatgtcttgattgctgtagctttatagtaagtcttaaagttgggtagtctcagtcttccaattttctccttcaatattgagttggctattatgggtgttttgcctctccatgtaaactttagaatcaatttgtcagtttccacaaaacaacatgctgggattttaattgagattgtattgaatctatagatcaagttgggaaatgatatcttgcaaatattgaatcatcctatttatgaacatggactatcccttcattttagttctttgatatcttttattacattctgtagttttctacatatagattttgtacattatttttagatttatacctaagtatttcattttggagggtgctaatgtcaatggtaatgtgttgttacatttcaaatttccactgcactccagctgggtgacagagcaagaccctatcttcaaaagaaaaaaaaaatctcaaattccacctttttattgccagtatataggaaaataattgactttgtacattaatcttgtatcctacaatcttgctacaattgcttattaattccaggaatttttttggtcaattcttccagattttctatatagacaatcatgtcatctgtgaacagagacagtattatttctttctttgtaatctgtataccttctatttccttttcttgtctgattgtgttagttaggaattccagtacaatgttgagaagcactggtgagaagggacatcctcatcttcttcctttctgatcttatcaggcaagcttctagtttctcaccatttagtatgatgttagctgtaggtgtttgtagatgttctctatcacattgaggaagttcctctctattactagtttgttgagagttttcatcatcaattggtgttggattttgtcaaatgctttttccatgtgattctttttctcttctttagcctgttgatgtgatggattatattaattgattttcaaatattgaaccagccttgtatacttgggaataaattccacttagttgtgatgtattattcgtttggatttggttttctttgttttgtttgtttgtttgtttgttgtttgtttgttttgaaacagagtttcagtcttgttgtccaggctagagttgcagtagtgtgatcttggctaactgttacctctgcctcctgggttcaagcgatcctcctgcctcagcctcccaagtagctgggattaaaggtatgtgccaccatgccctgctaattttgtatttttagtagagatggagtttcatcacgttggtcaggctggtttcaacctcctgacctcagataatccacctgcctccgcctcccaaagtgctgggtttacaggcatgagccacctcacacagaccattgttggatttgatttgttaatattttgttgaaaatttttgcatctgtgttcatgaaagatactggtctgtagttttctttttctccttttcttttttttctttttttgagacagagtcttgctctgtcacccaggctggagtgcagtggcaccatctcagctcactgcaacctcctcctgccaggttcaagggatcctcgtgccttagtctcccaagtagctgggattacaggtgtgcgccaccatacctggctaagttttgtattttttattagagacatggtttcaccatgttggtcaggctggtctcaaactcctggcctcaagtgatctgcctgcctcggcctcccaaagtgctaggattataggtatgatccactgtgactggccagtctgtagttttcttataatgtctctattaggttttggtaaggtaattctagcctcattgaatggattaggaaatattcccttggcttctatcttgagaaaaaaagattgtagataattggtatagtttcttaaatgtttgatataatttatcactgagcccctctgggcctggtgctttctgttttggaagggcattaattattgattcaatttatttaatagatataggcctattcaaattgtctgtttcttcttgtgtaagttttgacagattgtatctttcaaggagttggtccatttcatctgagttatcaaatttattggcatagagttattcatcatagttctttattatccttttaatgtcagtggtgtctgtagttatgttccctctttcatttctgatattaataatttgtgtcttctttctttttatttagcctagttagagtcttatgaattttatttatcttttcaaagaactggcttttgattttgttgattttctgtgttgatttcctgttttcaatttcattgatttctgctctgttttatttctttttttctgcttacctttgatttaattttctctttttttttctagtttcctaatgtggaagcttagattattgattttagatatttcttcttttctaatatattaatttgatgctatgcatttctctcaaagcactgcttttgttacattccacaaattttgatgagttgtattttcatttagttcaaagtatctttagatttctcttgatatttcttctttgacacatgtgttatttagaaatgtgttctttaatcttcaagtattttgtggattttccagttaactttcttttgttgatttctagcacaattccactttggtttaggagcagacattacatgatttctattattttatatttgtggtctgggcacagtgatgcatgcctgtaatcccagcactttgggaagccaaggcaggaggattgcttgaggccaggagtttgtggcaagcctgggcaacacagcaaggcccagtctctaagaaaaaaaaaaaagagagagagagaaagaaaaaagaaaaaaattcaccagggatagtggcatatgcctgtagtcctcgccactcaggaggctgaggcaggaggattacttgaacccaggagttacaatgagctatgattgtaccactgcacttcagcctggatgacagcaagaccctgggcatggtggtgcatgcctgtaatcctagctactcaggaggctgaggcgggagaaccacttgaacccaggaggcggaagttgcagtgagacaagatggcaccactgtactccagcctgggtggcagaggaagactccatctcaaaaataaaataaaataaaataaaataataaaataaaataaaataaaataaaataaaaaagagtttaatggagtaaatgaaagattcgcgaatcaggcagccctcagaatcacagcagattgacagagactccaggggtgcctgtgatcagaacaaatttatagacaaaaaaggtaaagtgacatataggaatcggaagtgaggtacagaagcagcaagattggttacagcttggtgtttgccttatttgaacgcagtttggacattcagcagtctatgagtggctgaagtgtggccgctgggattggctaacactcagctattgttacaggtgcatactattaaattaggttttcaattttgtctgttaagctaagttacagttcatccataaggactcaaatataaaagtatggagtccttctcaggccatatttattttgctttaacacacttattcactctccaatgctcttcctttccttatgtagatatgagtttctgacctatatcattttccttctccctgaggacttcttttaacatttcttgcaagacaggtctactggcaacaaattccctctatttttgtttgtctgagaaagtattcctccttcacttttgaaggatgattttatagggtacagaattctaagctggtgttttattctctcaatactttaaatatttcactccattcttttcttgctttcatggtttctgagaagccagatgtaattcttatcttctttcttcaataggtaattttttcttcttctggcttcttaagatatttttcctcatctttgattttttgaagtttaaatatgaaatttctagatatggtttgtttagggcatttattcatttggtgttctcttagcttcctagatctgtggtttgatgtctgacattaatatgggaaaactctcagtcattgcttcaaatattgcttctagtccttctgattattctcattatacattttgcaccttttgcagttgtcgcacagttcttcgatattctgctctgggttttttttttttcagccttttttctctttgcttttcagttttggaaatttctattgtcatagcctcaagctgagagattttttttcctcggccatgtccagtctcgcaatgatcccatcataagcattcttcactcttacagtgtttgtgatctcttgcaatttcttttttattcttagaattttcatctctctacttatattatccatctgttcttgcatgttgtctacttttgccattaaagctcttaatacattaatcttagtttgcgtttaaattcctggtctgataattccagcattcctgccatatctaatctggttctgatgcttgctctatctcttcaaattgtgttttttaccttctagtatgccttgtgattttttgttgaatgccctttattttttccctggccacgatgtattgggtaaaaggagttgtggtgaataggcctttagtgatgtggtggtcttagccttttggtgagttgcgcccctggactgtgaacttcataaatgcttctcagggctttcccccaccttaggtagaatagcatgggtacagtgggctggaatttggtatttcccttcccccaagtaggttacactctgataaaacaggttaggctctggtataatcgtttatggcaggctttgtaaagaagaacagaatggcctcaggcacagtgtaatcccagcactttgaaaggccaaggcagttggatcacctgaggtcaggagttcaagaccagcctgtgtgacatggcgaaatcccgtctctactaaaaatacaaaaattagcttggtgtggtggtgcatgcctgtagtcccagctacatggaaggctgaggcaggagaatcacttgaacccgggaggcagaggttgcagtgagccaagatcacgccactgcactccagcctgggtgacagagcgagactctgtctcaacaaaccaaccaaccaacaaacaaaaaaacagaatgctgtgttgcatttccaaatggctgctttccccttatattcactgagaacctggtagagctcctggagttataactcacagaagtgaggaggcctccctaagattggccccccctggagttttaactcttcaaactgaacctccagcaatttgtcaattgcagttcaggttttcctaccccagtactggttcccatggaggtttctgctggtagtttctgcctcattaatgtgactctctgtatctgtgtcttaggccattcttgcattgctataaagaaatacctgagactaagtaatttataaagaaaggtttgattggctcatggttctgcaggctttacaggaagcatggtgctggcatctgcacagcttctagggaggcctcaggaagcttacaatcatggcagatggtgaaggtggagcagacatgtcacatgaccagagcaggagcaagagagagagcatgggcgcggggaagtgccacacactttaaacaaccagatctcatgtgtactcagagggagagctcacttatcaccaaggggatgacccaagctatttatgaaggatctgcccccgtaatctaactaccttccaccaagccccacctccaagattagggattacatttcaacatgagattcgggcaggaacaaatatccaagctatattaatctgcctgtcttttcaattttgggaatagaactttgctttatgacctcacttctctgatgatgtaagaagacttgctgatttttcagtttgtttggtttttaaatttattttatttagagacagggtctcactatgttgcccaggatggtctcaaactcctgggctcaagtgatccactttgtggattacaggagtgagccactgtgtcctgccttgttcagctttttacttattagaataaagtgacaacttctaaattccttacatgctgaactggaaactgaagttcttccgttctctttctttttcctccttaatatgtaacttttcccctatttgtagaaatcatgctctttgtagaaaacttgtaaaacatgaataagaaaataaaatttatccataatcccataattgacagacaactgtcaccaaactttttggtgcttttcattttagcctttttttctctatatactattcttatatatggtatattttaaatataattatcagcatattggatattcagttttatggactgccttttcattatacttttcatcataccttcattaacattatacatttttcatgtcctttaacattctttgaaaacatcaattttaatggcaatgtactgattcattgtatgtgatgttttatttaaataatcttctatttttgatccttcttcctgaccaagaagaagcaatgaaggttttgagcagggagtaaggaaaaagggtgggtatcatgttttgatttccatttttgcgggggagggtgtctccctctatcacccaggctggagtgcaatgacacgatctcagctcactgcagcctcgacctcctgggctcaagtgatcctctcacctcagccttccaagtagctgagaccacaggtgcacactaccatgtccagctatttttttgtattttttgtagagatggggtttcaccatattacccaggctggcctcgaactcctgagctcaggcgatccgcctgtcttggcctcccaaagggctgggattacagtgatttctattttaaatagtgaagttggctgcaatatggagaaaaggatgaaggcgggccagaaagagtgcaaagagcccaggtgggaggccactgcattagtccaggcaagacctaatagcagtgtgaaccagagcagggcagtgagatgaagagaagttgcctggcaggttctagagtgggggctgggggtggggggcaatacgaactggacttgagggtggagtgggaaagagtagagtggggaaggatgaggtgaagcatgaatcccaagtttctcacctgcataagcagtggatggtggtgcattccctgagacagggtgcactggaagatcacaagctctggtggggaagatcatgaatttgttcttggacatgtgtttatgatatctttggatatctggctggagatgtgaagccaacagttggatataagaggatggagctcaaccaagagtagggacgacaggtatcaacataggagtcatttgcacataaatggcaaatgaagcagggaggggtgggggagtaggagtggtctagattgccttggatctagcgcagacagagagagggcaggcgcagcactctctgaactgaggcagtactccatggtagggctgttgggaggattgcatacaaactgcttgcaacataggaagtgcttaataaacgatagccactgtcagcctgtccagcttcccagagtcatgttcactgtcactctgggcccaaccatgtgggccaatctcggttctttcagggcagcaggtttccacagggcctttgtacctacctttccttctgcctggaatgctccttctttttccttctattgattcatcttcatctgtcacctaaagaatcacctgatctcccctaacctcacaccgcatacctgcctcactcccatcagggtagctctacatagaaccatgtccctgtcctgcatatcatgtatcttggtttgtaatgctactctaatgtgtctgattattttggtaatatttgatgtttgcatttgatctacaatcctgatctgattttatttatttatttatttatttatttatttatttatttgtttgtttgtttgtttgagacagggcatcactttgtcacccaggctggagtgcagtggcatgatctcggctcactgcaacctctgtcccccagactcaagggatcctcctgcctcagcccctcaagtagctggaactactacaggcttgtaccaccatacctggctaattttttgtatttttatttttagtagagatggggtttgccgtgttggccaggctgctcttgaactcctgagctcaagcaatcctcccacctcggcctcccatggtgctaggattacaggcatgagccacctctcccggccctgattttattaatagttgcactggactgtgagctccctgagagcaaggatacagctgtttttgcttatcttcatatcctcagtgcatagcttggcagatgcttgaaacatattagacaataaatatgtgtagcatgaatgaatagaattataagaaaaaatctcactgaggtttttactggaattgcattgagctcgtaaattaatttgaaagaatctttactgtattaagtcttcctaaccaggagtctagtctagaattgcattcttttcaagaatacaattagttttactgaggatgagaaatcatgccctgtgaagtgtggtgaacaggaattctttggcttggaggagaggagacttgaggacagaattgctcttttaaatacttgaagagaaaagaggttagtgttgttttatggcctcaagggggataagccggacccattgaaggattatgaggtaggcagcttttggctcaagtggagctggtggtggaaatggggtgcctcctcccctaggtgtgcttgagcagcccagagtggctgggctttggctgctgtccttggctttgcctgtgttttgttttgctaagagctgttccctagctcttattttggtgacagggacatgcaggcttcctagctgaggagaggggcttcaggagagagtacagctgagacagagagaaaggcccaggaagccaggcagcagctgaagggagaaaaaatttgggcaagagacagagatggtttatgagattttggaggggaattttgctccataaatgaaatagaacgctctcattgaagccccacaaaactttcaacaaaaatcttcattattcataaatgcttttgtatttatagctgtcagggagtggcagggctgagcatagcagagggttgagcctgtaaggaaaaggcttttatcagggttgttcaggggtgaaatgggctgtcacgagagccagtcaagcaaagcttggaccatctcttggcaggaaaaccaagcaggagactgaagcatctgatggagactttaattgcctttaaagttgctttgaccctggagggttctgactcatgggtgcctgtttctctggccctttcacagagcaataaatgctgtgcgggcacatgtagtacagactcaggtagaaaagcaccttatcacatatataggggactactggggaaggaagggaattccagtcattccaagccaaatgattgtcttgccgtattattttcaggtggatcacattcactttcttcttctcagaggcatagctgggatctgctggcgtcacgaggcacttaaatgccagggagggaaggaatgggttttaatcattgaccctcccccgttttcaactacaaaaggatatcccagcgtaatatcaagtaacgggaaatgtttgtaagttggagtgttagagaaagggactttccagggatggggtggagcctccaggtgggtccagggtgatcatttgtgaagcggcagaggccccagacctgtaaaagctgggcgcctggccgcgcacggtggctcacgcctataatcccagcactttgggaggccaaggtgggtggatcacccgaggtcaggagttcgagaccagcctagccaacatggtagaacccccgctgaactctactaaaaatgcaaaaattagccaggtgtgatggtgcgcgcccgtaatcccagctactcgggagactgagacaggataattgcttgaaccagggaggcggagtttgcagtgaactgagatcgtgccactgcactccagcctgggtgacagagcgagactctgtctcaaaaaaaaaaaaaaaaaaaaaaaaaaaaaagagctgggcacctttgttattttccagtgtaagcccagggatgcttacagcttgtaatttccccaggcctctaaacggctctgccccaggaggcagagcccactgaggagagggaatatgtgaggtttgtcgaatctgaggctataaaggggtttatcatcataagcaatatccaatatcatgtgttagctactgagaatgaataatatagggagtttcaaacttttctgaagctccaaactcttatttcatcaaagagggattggggtctataagaagaaaattttattgggaggccaaggtgggcagatcacctgaggtcaggagttcgagaccagcctggccaacctggtgaaaccccatctctactaaaaatacaaaaattagccgggtgtggtggtgagtgcctgtaatcccagctactcgggaggctggagcaggagaattgattgaatctgggaggcagaggttgcagtgagccgagattgtgttactgcactccagcctgggcaacagtaagactcagtctcaaaagaaaaaaagaatacaattttaattatatttatattatgtctatatatggtatcttgtatatagacactggttgccatggcagggggaagggaacgtagcacatcatgcattgcctcttaaaggcaactgcctagaagtaacacacttctgctctcattccattggctttagctagtcccacggacccactcacctttaccaggtgcactgtggccatgtggtgtgcccaggaggagcatcagaatgccagtgagagctgggcttggtggcttgagcctgtggtcccagctactcaggaggctgaggcaggaggatggcttgagcttgggagttcaaggcggcaatgagctatgatcgtgccactgcacgagtgccactctgcctgagtgacagagactccatctataaacataataatattaataataataccagtgagcagtgagcagtcttggtggtgacaacaattggcaaaaactgaggtcagtttgtaaccagtgatccatgcccaaagtgccagtaatgattagaagggaaagatatagcaactctttgggtaagtagtttagaaatggaggtcatagggtttgaacgcaggctccttcctctgcctcatgttttattccttctttgcatctcctcaaagcccatggcaacttctccatatagacagcctccctccccagtggggtttccattaaacttgggaacaaagcccccaggtgaaaatgagagtggaatttggagctggaagatgagaaaggaagtgaatgtggaaataatatcctcccacagtgtaaaatgtggaggaacaaagcagttgtcacaaaaatgtttcaagccaaattacgtgaaatgtgccccccaatgccacctgccactgaaccccaggaaaagaggactcctggaggacacacagttgctgggaaaacacttgggcttcctgggattcctgaaggggcaagtctggtcccctggggcctgtcctgcactttctagttctcctccactttggggccggagcagagggaagctgaagccacctggagtcattgcttcccagatacctcaagaaaaatagagtccttattctctgacttttgggttgggaatagcttttccttgccacttctaacagacatcactccagggatctcgaatggaaatacacactcaccactctttcctccaggtgtgagggacagccaacccgcctgatggtggcagtgactggagctgccctgcagagtagatatttagaattatagtttcctccagccacagggagtaatgttgggagtgttcctaaacccagtcttcagcatgcaaaatgtgttttcagtgggctcgattcatcatagattttgggtttgtcaggactacatatcaatgagtggggccagcgggccttagaacttaattcccggtctggtgcagcacatgacccaggctgtgctaaatcccagagggtcccttgggatagagtgggggatcctgatctcagggttcctttgctgcctgtgactcttctcttcctctctggtctcttcaggagcttgagcgccttaaccaggtgctggaggccgagaagcagcagttcgaggaggtggtgcaggagctgagaatggagcaggagcagatcaagaggtggtggtggtgcctgggaattgggggtgccactaagttagggcatgcagagcccaccttccccgtcagatctgaggaggcctccacctcagagatgctatcttcccaaggctccaggcttgggtctatcccagtttgagtctgtcctccaaggctccaggtttgagtgttcccagaagaatctgtagactcccctgacccagataaatggggtcatttctacccactagagcataaggcaatggagcatccctccaagccacaaagccccctgccttcatgaaagcctctctcacccagggccagacaggacacgctggcctagaggtgcttgctgttggccaagaccctcaacatttgctgtctttcctgcatagtcctttttgggaatgtgtcatttgagaactttagtaccatgtattgtttgtaaacctagttgtacattataatcatctactgaattataatcttttaaaggtagagcctagaaatctctctctatatatatacatgtatatatctatatacatgtatatatgtatatataaaaatgtttgtttgtttgtttgtttttgagacagagtctcactctgtcacccaggctggagtgcagtggcacgatctcggctcactgcagccccgcctcctgggttcaagtgattcttgtgcctcagcctcctgaggagctgggattacagacatgtgccaccatgcttggctaatttttgtaattttagcagagccagggttttgccatgttggccagactggtcgccaacacctgtcctcaacgatcctcccaccttggcctcccaaagtgttgggattacaggtgtgagccaccgcaccagggctagaaatctatatattttttaaaaacaccccaggtgattctgaggcagcctccaggaatgtggagactgctgctgtgggtggggtagtcatcatcgtcatcctcatcctcatcattatcatcaccacacatgatcagtgatagcccagaaactgttttcttataacaaccttatccaagggtgtcaattaactatgtattttgaggagggaaaaacccagaggatcttactaagtaaatagccaagcacctactcagcttccagaatgttgccaggtattagaaggaatagaagacaagtccactcccttgaagagtggacgtatgatctggttggggaaaccagactcatacccaggaaacattagtgtaataatatgtaatcaggtgctagaaggcatggtgcagatttcctgtgttacgagaattgagacacatgcatgatgcttgtgggcttgaatacagggctgagtgagatgggccttgaaaggtgagtaggattttgaaaattgggcaggagaagggaaagactttccaagtaggatgaggggacactagtgtaaaagcctaaggtgactgaagcttgtgaagaaggcagcaaggagcttgttactaacccaaagaggggccttagccatgttctatgtcagaatgaccatgggttctagcaagtgctgtccagagaagacagggtgaggctggggcccctttgtttctccagtgtttccctctgcctgtggggtggccctaggtttattccaggtgacagatgcatgtgtacctggagcaagtgactccaaccccatgtggccaggacttactttcaactccaggcccctactgctgctgtcagggcccagctgtgcagaggggctggccattcaagagccctcctgagccccatcaggaagtgaagcaaaagcatttctaagtgcagaggtgattggtggggggtggggagagtgggcactgccatacccagccctctgtctccacagggagctggaactgactgcaagatgccttaagggtgtagaacaagagaaaaaggaactgaggcacctcacggagtccttgcagcagacactggaggtgaggggctgctggtgggttagttgaccaggtggcaggctggttggttggaccacatgacactgttttttccagcagtgtttccccagggggtgatctgtaagagaaatgggcatggaggggtgctgatctaaagggtctcttctctatggatcattgaaaactctggccgaggcatgaggcccaaagcaagaagtgtctgttctcagacctaaaaggacaaattcaggcttgtccttgctattaccatggcctcaggaaatccacctctggtgcttacatttttataccagatagaggattggttaaggtgggcagtggagctacccaccgcttccttcttgtgtcttgttcgcttagctgctcctgagtgacattgaacgtaaagggaaatcaactgccaggtcaccatcatctgataccacagaaactgggatggggtggggaggtgacaagcctcaaggacaaagtacaaactccttagcatggcaagcaagtgaaaactctggccctggtctccccttccctctcgcctcactcttcccttcactgctcctccatgccctgcacagactcccaacccctgctccaaaccgcggagctcaggtactccaaggaagcaagctctttcatgctccataccttttcccacactgttccttctacacagtgtatcatttccaccttttctctgcttggagaacttctattcacccttctaagtctcagctcaaatatctcctcagtcaagcttctctgattttcaaggcaggtatctactctgagctcttggctcccgtggcattttgtacatattttatgggacttaacatgctaggtgtgttttccaaactatgaatttcagtagactgtgtcttcatggtctctccaagcccatcccctgaagtgggcctggcacatatggtgtatggcccatacctgtgctgtacgcatgaattaccttcaaggctgcaaaggtttcttgtctcccttgactgactggagccttggagcttgtggggcctttattcatttatctttccctgtttcacatcatgggaggtggttcccatggatattttcaactctgcttctgtgtaatgccattgagtacaagatcccagtctgataaatggagaggacatcttttttttggaggtggggtggggggtggtttggggacaggttctagctgtgttgccaaggctgggatgcagtggtgcaatcatagctcactgcagcctcgctctgtttgtgagagcatctaaatatgctcttgggctggttcctgttgggtgtttttcacgtaagcccactatgtctcctcattcacccctggaggaaccaggaccccagaagatcatgcgaccccgttctagtaggtgccgtctccactggaaggcactttgggttcctttatgactcttgatggaggagtaaccttgccctgttgtgggagagatctgggccttttagctctggagaagaatgaagacatttcagcggccatagaggactgagagaggagtgggtcactcccccaaacggaaaagcaggtgagggcagccacgatggagaacctaaattgggcttttcttttccttgcctccctccatgccaggaactctccatagagaagaagaaaaccctggaaatgctggaggagaacgagaaccacctgcagacactggccaatcagagtgagcagccccctcccagtgggggcctccatagcaacctccggcagatcgaggagaagatgcagcagctcttagaggagaagctcctggcagagaagcggtgagggagccccgacccctgaagacaccattgactttggggtctggggactttcctcgaactggacatccagactcttgggttctacttggcactgaccaagtaggactcactcacttccttttgcctaggactctgttttcccaccaggaaagtgggaagagaactttcactacccaaagctggcttgataattatcttgtgcaatggtgtgaaccatgcagacttattaagtccttgtcaccatgctttgtgacaggctgggcaagtttttaagcccccttttacaaatgaggaaatggagcctcaggggggttgtatgacttttctgaggtcacagaacaagcaacctctggacccaggactccagtcttctgactctaaacctagggctcccagcactgaccacaccatcaatctcatcccctgggtgcctggacccacaaagttcaggggctcataaagcctgggattcaaggtttctccagcccaggtctctaagaggagctgtccatccattggcaatcccatttggcgagtgagcattgagaaagtgcctcttctgtccctacaggatgaaggagaacgaggagcgctcacgggccctggaggaggagcgtgagttctactccagccagtcccaggcactgcagaactcgctgcaggagctgacggcagagaagcagcaggctgagcgggagctcaaggtgcgacctggcctgctggtgccagggcccttccccttccctggagactccccttccacccctgcactttaccgggtagctgcatgaattatctctgtcagtctgaccagacagccaggcatgggggatggagccaccacgaggggaagcagcaagtctgctgcatcattgacagacacctgctgggtgcaggtgccaagtccagtccatctggttcaaagggtaagactcagaagcgggatgtgataactcccatccacgcccattgagccaggggtgaccaaggaaggcttccagggaagatggcagctacttccaggacctgacttccttctcatttccctctcctcaacctcaggctgaggtgaaggtccgcatggacctggagaggcgtctccgggaggcagaaggggccttgcgaagcctggaacaggggctgaattccaaggtgcggaataaggagaaggaggagaggatgcgggctgatgtgagccatctgaaaagtaagccctgcctctaggccctggcccccagctttggcactcagccccagatgggatcccggccctgtagagccaggaaacccacacagggtctgctaggcatgaggtgctccctggatattgaagggtttcttctccagttacctgcctgcaggcatctcagcaccactgctttcttgtggctgttggatctgtggtgagaggaaagccaggagcttcttccatttatcaaaagctcagagctctgttctcagcagacgtgccctgagatggctgcagattgtggtttgaaaggcaaagaaagtccccttcagcaggtggctctggaatctcgagggacggggtcaaaatatttcccactcaatctcaccaggatccttgggaagggagggactggctgggggtaaggatgcagtcggaaccccacccttcctggccctgccgccacagggttctttgaggagtgcatccggaatgccgagctggaggccaagatgcctgtgatcatgaagaactccgtgtacatccataaggcagccactcgccgcatcaagagctgccgcttccaccgacgccggtccagcacctcctggaatgacagtgagtgtggctgtctgcgtgccctggtgggatggtgacaaggcaggaagagggcaacatggggagccagaagggttggcccagctctgaggctggagagtgtggccttgaacctggccccaccatccttgggcaaacgggtgaattctcagggccctgggtttctcaaaggatatggaagcccgtgtgtgtgggaaggggctggaagaagcttggcacacataaaggagtgagggggtggcatgaggctggggacagggccaggccttcgtggagggagcactgttcacagggctgttgggctcctgtttccccagtgaagccgtcccagtccttcatgacctcccagctggatgccaacaacatggaggagctaaaggaggtggccaagcggctcagcagggaccagcgcttccgggaatccatctaccacatcatggccacccagcctggagccccctcggcactctcccggggtggaaagtgatgggcgctcctcccctgcttcccaagtctcccctggatgggcgggggaggggaaggggtggcagagggaggcctcactc

SEQ ID NO: 1797 - DNA, 8173 bp, Homo sapiens
ttcctctgaccgagcgagggctccccgtctgcggcgcggtcaggaccccgcactttcggcccggctcggggttctcggagtccgtcccaaggccgggccgcaccaccgctggggggcagcgaagcgagcctagaggagaaaaggcggtccccgccgagtgcacgccgggggcggggcacggcacgaaggctccgtggtcggacttctgggctgttcggaggccctggcccacctggagggccctggaagagtttccagcgcttcccgaggtaggcgtgagaagctcgacgcggaccacatctccctcatgcaccgcccgcacgtcccaggatgcgctgcgattaaggtactgccgcgcctcgtgtgcaaggacagacttccggggtcgagaactacaacttccgacttgcatcactgcggtggcgctaaacagcgtcagcgaggcggtgcccgacgatttccctgtcttccagttccgctccctgggatcagcggcgagaagcggggcggagtctgaggcccgagccaagatggcggctgcgaagccaaccctcacggactcgctctcgttctgcctcgcgcagctcgcggcggcggccggggaggctctgggtggggaaaaggacccagcgaccaacgagacacccctgagccgcgcgctcctagccctccgcacgcgccacatcaaggcagcggggggaatcgagcgcttccgggcacgcggcgggctccgccccctactcgcgctgctacggcgagcggctgcagcgggttccgccccgtcccaggcaggccccggctccgccccctcgtcggccgcgtcgggagcttctagccccgcccccgcgtcgggccccgccccctccgctgtgtcgtcgtctagtcctacgccgccagtgcgcctgcgcaagacgctggacttggcgctcagcatcctagccgattgctgtacggaaggggcgtgccggaccgaagtgcgcagactcggaggcatactccctttgggtaagtgctccgcccccgtttcctagaaagattaggtttgcaactcccttgctctctagacccgggcagtctggagttctttgtgtcctatcccggaataacgtgctttgtgatggcgcatcgctcctgtttctcaatctgttgtgccccgtgacgtcactgcactctctatagatgagagagagccctcccagaccagataattgtagccattatctaggaattggttgttgaggacttctttcgaagctggactagcggaggccaaagagttatttggtgattttttcagatgattcttaccgtccagttatgatgttcatagcagacattcagtgcccaactatgtgtccggccctgtgcaaggttctgaagccccactgatgagctggaaggtgtagtggttcagaaagggagatctgcaaaagtcacctaacccctccgaggctaggattccttgtaaaatggggcaataatagctacctaaaaaaatcagagtggggagaaaacgaagtacaaatatggcacgaatatgcaaatattctaagcatgatacgtatttcaagttattaaaaactagcataagctgggtgcagtggtacgcgcctgtagttccagctatttgggaggctgaggcgggaggatcccttgagcctaggaggttgaggctgcagtgaacaatgactgcctgtgaatagccactgcattccagcctgggcaacgtaacaagacctcgtatcttagaaaaccaaacaaatcagtagtcgcttaggaagcaggaaaaaataaataaaaataattaaaaccagcacagtaagaacaaatcctagcaaaacataagcttttctgtttaccagctaaattggtgcctcctagtggcaatgtgtgaaagcagtttacatgtcactacctgccttccacgaaattatgctagttttgatgacatcttaacttttcggataaagggaagcattaatatatttaaaatttacataaaatgtatctggaccatatatgtttgacaagagctttggttattaaataacccccatcattcagctactatttttcatcttaaatatcttctgaatttatctgcttctctctcttcctacttccattgtgtgcccagagactggtatctctgtgctgtgtgatgccagtagctgggttggttcaagctattgtcttttcatgcttggactattatgacagccttttgactccccccttcctattctttccccataatgcattctccctatggatgtcagattgtatcgtgtcactccccttcataaaacccttgtgtggcccccagtgccttcacattcaagtcctgaccccttggcctgacatttgaagcctttcacagacactgtatcttacctctgggcctttggaaaggctgcttccaaacctgaaatgccttctcacacccccatccaccgtgcttctggcaaataccttcctgtgtacccctccagacccagcccgagtgttagcctctttctttttatttttttgagatggagtcttgctctgtcatccaggctggagtgcagtgacacgatctcagcttactgcaacctctgcctcctgggttcaagcaattctcctgccacagcctcccgggtagctgggattacaggcgtgtaccaccatgcccagataatttttgtatttttagtagagatggggtttggccccgttggccaggctggtcttgaactcctgacctcaagtgacccacccaccttggtcccccaaagtgctaggattacaggcttgagccacggtgccctgccgaccattagcctcttctgaaagccttccaggccctctcaggccacattctccaggttattgatgtgagagacagtaaggggtagaaccctcacaagcccaaactgtcgttgcagtgaccattcttcagtgcatgaagacagacagcatccagaaccgaacggcccgtgccctggggaacttagccatggaacctgagagctgtggggacatccactgtgctggtaagaggctgtgaggttggggtctgctagggcttggggcagaagaaaggcttgagtgtctgtccttgttcaccctctgtgctcccctttcctgccctcaggtgctgttcccctgcttgtggagagcctgacagcctgccaggactcgcagtgcctacagagcgtggtgcgtgccctccgtaacctggcagactcaccccagcaccgcctggccttggcacagcagggagcagtgcgtccgctggccgagctcctggccactgccccagatgctgcactgaccttagccctcgtccgtgccctcctggaactcagccgaggctgctcccgggcctgtgctgagcagctaagtctgggtgggggattgggcccactcgtcagcctggcttcccaccccaagcgggcagtacgcgagggaaccattctgatcctcgccaacctgtgtgcccagggcctgattcggcctgcactgggcaatgctggtggcgtggaggtgctggtagatgagctccggcagcgccgggatcctaatggagctagcccaacctcccagcagcccctggtgcgggctgtgtgcctcctatgtcgtgaggccatcaaccgggcccgactgcgggatgctggtggcttggatctactgatgggcctgctgcgggaccctcgtgcaagcgcatggcaccctcgtattgtggctgcccttgtggggtttctgtatgacactggggccctgggccggctgcaggctctgggacttgtgcctctcctggctgggcagctgtgtggtgaggctggtgaggaggaagaagagggaagagaagctgcttcctgggactttcctgaggagaggacccctgagcgggcacagggtggaagcttccggagcctcaggtgagtccctgcctcagggcttgggagggtgagcagtgcagtgatgtggggtttgtgtctgtcttggtcctcttcactacctccacccctattctgtctgaataagacttttataacccagactcctgattcccacacgaccacctgccagttcctatttaacacactccactcccctgagtctacctttttttttttcgagacagagtctcactctgtcacctaggctggaatgcagtggtgccatctccactcactgcaacctctacctccttggttcaagcagttctcctgcctcagcctcccgagtagctgggattacaggtgccggccaccactcccagctaatttttgtatttttaatagagacaaggtttcaccatgttggccagcctggtctcgaactcctgacctcaggtgatccacccgcctcagcctcctaaagtcctgggattacaggcatgagccactgcactggctggatctaccttttaaccttggttccacgccagcacctttgaactttgggccccagacaagttcactgggaggtgggatatacgctggttaagatggtgggctctggagtccaagttcttactctcttaccatcactcatgagctgaagcatcacaggaaagctgaggaactctttatttttttttaaacattagcgttggggatctcgctttgttgcccaggctggtcttgaactcttggcttccagtgaccctcctggctcagcctcccaaagtgtagggattacagatgtgagccaccatgcccagcccccagcgcttcctatttcctttttattttctccatgacccctgtactctacactagccccacactaacataactcatggtactcttacttcttgtctgcttcttctcactggaacataaactccagggggacaggcactttgttcagtgcttctacccagcacctaaagaacggcttggcacgtgacaggcatcagtaattactgaatgaggttttagtcgtatccccctctcacttccgtttctcccctttctccgccctccttctctcccctggctttacctccctccaagacagcttttagctcatgcagtggctcacgcctgtaatcctagcaccttgggaggccaaggcaggaggatcgcttgagcacaggagtccgagaccagcctgggcaacatagcgagacccatctctacaaaacatttaaaaaattagctgagtgtggtgcacacagctgtagtgccagctacttgggaggctgaggtgggaggatcacttgagctcaggagttcaaggctgcagtgagctaggatcccacaactgcattccagcctgggctatagagggataccacatttctttaaaaaaaaaaaaaaaaaaaaaaaagacgcctcacgcctcttggactctgccccttaaccttggctctgggttcagtctccttccctttctgccctccgcaggtcgtggctgatctccgagggctatgccacaggccctgatgacatctcccccgactggtctcctgagcagtgtccgccggagcccatggagccggccagccccgccccgaccccgacctcgctgcgggcaccacgcacccaacgcactccgggccgcagccccgccgccgccatcgaggagccttggggacgcgaagggccagccctgctgctgctgtcgcgcttttcccaggcccctgacccaagtggggcacttgtgaccggcccggcgctgtacggcctgctgacctatgtgaccggcgcaccgggcccgcccagcccacgtgcactgcgcattctgtcacgcctcacctgcaaccctgcctgcctcgaggccttcgtgcgcagctatggcgcggcgctgctgcgggcctggctggtgctgggggtggcgcctgacgattggccggcaccacgtgcccggcccactctccacagccggcaccgagagctgggtgagttcccatacccacccgtctccttgcccccatgtgagtccccatcctcccccatggcttccatgggcccagaacctcaccttcccactcacctgtcctccccagcccgtcctccagacaacctgtcaccagagtggggtggggagcagggcgttccagtccctccatgggcccacaggcagagttctgctgtgtcctctgccctagccctgggacccagataccctaactctagatgcagccccgcgcccaggatctgggctggtctgtgcttctttcctggctctgccattggttcagcactgtcctgactgctccccaccagcacgctgacctgtgaaccccagcctcaccatcacccccagcactgccagggactgccctgtctgctgtgccctgaccacaggctgcttcatggcgttactgctagaccaaggagcccttctgctggccctgtccgggcataacagaaggctcgcactcttgtcttctggtcacacctcactatgtcccctcagctcctatctctgtatggcctggtttttcccaggttatgattatagagcgaggattattacaatattgggataaagagtaattactacaaactaatgattaatgatattcatatatctctaagatctatatctggtataactattcttgttttatattgtattatactggaacagctcgtgtcctccgtctcttgcctcggcgcctgggtggcttgccgcccacacttcaggggcccagacttacaccctgactgtcccaccttctgtccttgtcctggacctcaggttcccagcgtcccgagcccagcactgtctcttcagtgccctgatttctcacccagaggtttcaccctccttcatctcacgggcccagagccctgtctcactcaccccacctgtcttagaccccagttcccagcctgacaagctttccactcacaggggagaggctactgcagaacctgacggttcaggctgagtcgccctttggggttggggccctgacgcacctgctgctctctgggagccctgaggaccgagtggcctgcgcgctgaccctgcccttcatctgccggtgagtgggaagtgggtgccttgcggggttgggggaggagtgctgtgtttcccaggcccgttgcccaccttttgaaaggccctctcttccctgtaggaagccctctctgtggcgccggctgcttctggagcagggtggtctccggctcctccttgcggcgctgacccggccggccccacacccgctcttcctcttctttgccgcggactccctttcctgcctccaagacctggtgtctcccactgtgagcccagctgtcccacaggcagtccccatggacctagactcaccttccccttgcctctatgaacctctgctgggcccagcccctgtcccagctcccgacctgcacttcctgctggactcaggcctccagctccctgcccagcgagcggcctcagccaccgcctcccctttcttccgggccctgctgtcaggcagctttgcagaagcccagatggacctggtgcccctgcgaggtctgtcgcctggtgcagcctggcctgtcctgcatcatttgcatggttgtcgggggtgtggggctgccctggggcccgtgcccccaccaggccagcccctgctgggttcagaggccgaggaggcactggaggctgctggccgtttcctactgcctgggctggaggaggagctggaagaggccgtgggccgcatccacctgggaccccagggtggcccggagtcagtgggtgaggtgttccgcctgggccggccccggctggctgcccactgtgcccgctggacactggggtcagagcagtgcccgaggaagcggggtctggccctggtggggcttgtggaggcagcaggtgaagaggcagggcccctgacggaggctttgctggctgtggtgatggggattgagttgggggcaagggtccctgcctagactgttgacgtcccctgggaaggggacccaaggatgaattggctgtgaaggatcctccctgagactggcaagggaggaggctgagcagaaggagtcatcatggaggagcggtgagaacatggaaccggactccaagatgacgatctaaagacccgggagcgagaagccaaggccaggttctgggtgtagggcccagagaagcagaacagcccagagccccaggtgcctggcctggcctagacctctggaattgagattaaacaatttggagttggata

SEQ ID NO: 1798 - DNA, 5807 bp, Homo sapiens
cctgttcgccccgcgccaccggcccgcgccccgccatggaggacctgggtgagtggggccggatccccgggtccgtggcccctcaccgctgcccagagctgcctccccgccgtcgctctcccgcatctccccatccctgtcttcttacttctgcttttcgcctctgcccgcgcctcctttccaactccacgtcccccttcctgcctctcccttcctgcctttcctgggccggccgctccctcccttcttccctcgctgtgctcctccatcccaggctgcggcagatggaacgggaggtgcggcgcccgcgggcgcccgggcgcggggctctggggagggaggggttaaaggggcctcggcccggggaccgggaaagtagagggcacgggaaagtctggcatcaagttttggagaaaaaaagcgggcctgcctgcaccagagttttgggagaggaggagttaagggctcctgagcacagtgagggtcaggtccttgaggcaaggaagagaatagtaactcaggagtgcctaggcgcccgcgaaggcttcagggtttcacgcgggtgctcagagacgaagactgagggcaggacttctgggttctggaagtgaaagggctcaaaagacccggatctggggatgcagggatggagagaggtgtcttgtccggaagggggacccaggtatctcgtcctccctgcgaagcctggggctggaaggctgtgcgctccacgggagagaggggcttccggcccctggcggtagagggcgctgctcggtaggggtaactgacgctgtaccgcagataaacagccaatcagaaggcaggtcccagcgaagcgccagtgaggagcccagggcgggactcaggggcctgggagtggccaggctgggcggggcctgtgtaggtagagggaggagttaaccagcatggaagagagagcgtccaatcagaaagctgagggccaggcactgggccaatggagcaatttggaggggagccaaatttggcttgggtgaagagcccattttgactgcatcagagaagatggggagaataaaataatcaggaggctgggtttgtgcttggctccaagcgtgagcaactgggatattctggtcataaatattccttgctacccttcgagcagtgctctgcctggctctggccctgtgacctcttctcttaatactggcttctgtccttctccagtactgcccactgggaaccttatcttctgatctaaccgtgacccttgtctctctccctgatggcctcttcctgcagatgccctgctctctgacctggagactaccacctcgcacatgccaaggtcaggggctcccaaagagcgccctgcggagcctctcacccctcccccatcctatggccaccagccacaggtgagatcggatgttggggactggggcagccactagggccaggctcggcctggtctatggggatctcagcctcagtggggcagagtgcaggcctgtcatcccacctgtgcgtctccgctctgtagacagggtctggggagtcttcaggagcctcgggggacaaggaccacctgtacaggtgaggggcctggaaaccagggcatgggggccaactgagtctcaggtgaggaggcttggattccccacccctgaacccaggctcccactctgcttcccagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacaggtaccagggtgactgagagaggccttgatgcgataggggcaggggagggaagggtggggcagagactaagaggaatacacttcccagagtagcagttaaagggacctaaagcctcaagtgtgagggtgcgttgagcatggccctatatgtagcgtcctcctctcctctctccagatgaaatcatgtctcagttcccatctagcaaggtggcttcaggagagcagaaggaggaccagtctgaagataagaaaagacccagcctgtgagtttggcgtcgttgtcagggctgagagatgagtcctggatatctgagtcactagagggagcgttgctctgggaggctctgagatgacacaagcatgttcttcacagcccttccagcccgtctcctggcctcccaaaggcttctgccacctcagccactctggagctggatagactgatggcctcactctctgacttccgcgttcaaaaccatgtgagttgggcagtgggccagtgtccatttgtggctccccaaccccttctagacaattccacatctgctgctttgctgactcaattctcatgtcctccccgctgcagcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtaagtggagccttgtgagaagggaggcagagacctgtcacagacccatctttagtgagagctgggctttatgctgttcccttttagtaagttaatctgggaagtgggtatcattattacttatgttttatggatgaggaaactgaagctctgaaccacacagcaggttagtggtagggtgaaaattccaaccatgttaccatttattgtggtcctactgtgtgccaggcactgtgccagctcctttacaaaccctcatctcatctgatcttcacaaaacactctgtggctccacccaatatctctcaggcatctacaaaggctctctcttcctccgtcagagtctggactgggttcactggtccttgttttattgactgagcagatgtgattgacaacagctgtgcctaggggttaacctagtgccccctgctagatcaagtacctgactcccagcccagaattgcccatctcagcaaaggagggtggcattgtgacttttgtggatcataggcactttcatcttcatgagtcccttcgtccattaaaataaatagatttttatgtctgtgttggtgtaaagatgggtatgttattattgtgtattacagcattttcttctagttcatttttttattctgaatttttaaaaacggatttttcacttcctccctcttatttattttgaggcaaattctcactcttgtgacccaagctggagtgcagtggtgcgattgtggctcactgcagcctcgaccttctgggctcaagtgatcctcccagctcagcctcccgagtagctgggactaaaggcgcccgccacctcgcccagctaattttatttatttattgtagagatggggcttcgccatgttgcccaggctggtctcaaactcctggactcaagtaatcctcccacctcagcctcccaaatgctaggattagaggcacgagccacccagcctgatcgtattttgattttaaaaaaattaaaacgtttttatgggcccctaaatgtattgtgggctccaggcgctgtgcctgctgtgcctcatgtataggtcaatcctggagcgcagctggaagacggaacacgggagctagatctccatcgcttacaggctgcgtgatctcgaacactggattctttattctgatcgctcagagaggactcgaaaaacgccgcgtaaatcttgcctcactgggcatgtggttgtcagagccgctctgacccgcctcacctcccactcgcaggtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacgtgagccccgcccggccgcaccgagcccgccctatctcaccaggagagctgtgggacgggcctccaccgcatgggtcccgccccacccgcgataccccactccacccctaccccttccccttggcaatgtccacggccccttggactccactcttcctttctgacccccacgttcctagttagatcttctccccctccccccacgcatgccttagtccagtcacccgggttccgcgcgggagaggaaggcgcgaaggcacggaggccgcgctgagtgccctctccctccctgcagaagatggtgaccgccttgggcactcactggcacccagagcatttctgctgcgtcagttgcggggagcccttcggagatgagggtgagagtgaactcgactcccatcttaaaagctgcgggtcccctcgacgtctcgccccagcccctccgacctccggagtcctcagggccatggttttccttctgctctcttctggccctgccctctcctacacagactccggacccgagccctccccgctctgtcccgccatagacccggctcctccttccccaaggctccctcggactgcccctccttcggccccagatctcaggtcttgtgggtcccccgtcccgcccgcaccctttgctttcagcccactcggttccctctcctaggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggtgcgagctgcggggcggggcgttggaggggcgggtcaagggtacagggctgtggggcggggccttggaggggcgggtcaagggtgcagggcagggggcgggccctcgggggggcgggtcacgggaggtgctgctaggaacctcgggtggggcgagttttccgggcagggtcccaccggacgggattcttcgcgtctagggcgggctgcggggtcccagggcgttatccgctagtaacgcgcgttgtctggcagtggccgctgacctgtctgtcctctttcgcggcttcccttccccaggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctctc

SEQ ID NO: 1799 - DNA, 4757 bp, Homo sapiens
gggagaataaaataatcaggaggctgggtttgtgcttggctccaagcgtgagcaactgggatattctggtcataaatattccttgctacccttcgagcagtgctctgcctggctctggccctgtgacctcttctcttaatactggcttctgtccttctccagtactgcccactgggaaccttatcttctgatctaaccgtgacccttgtctctctccctgatggcctcttcctgcagatgccctgctctctgacctggagactaccacctcgcacatgccaaggtcaggggctcccaaagagcgccctgcggagcctctcacccctcccccatcctatggccaccagccacaggtgagatcggatgttggggactggggcagccactagggccaggctcggcctggtctatggggatctcagcctcagtggggcagagtgcaggcctgtcatcccacctgtgcgtctccgctctgtagacagggtctggggagtcttcaggagcctcgggggacaaggaccacctgtacaggtgaggggcctggaaaccagggcatgggggccaactgagtctcaggtgaggaggcttggattccccacccctgaacccaggctcccactctgcttcccagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacaggtaccagggtgactgagagaggccttgatgcgataggggcaggggagggaagggtggggcagagactaagaggaatacacttcccagagtagcagttaaagggacctaaagcctcaagtgtgagggtgcgttgagcatggccctatatgtagcgtcctcctctcctctctccagatgaaatcatgtctcagttcccatctagcaaggtggcttcaggagagcagaaggaggaccagtctgaagataagaaaagacccagcctgtgagtttggcgtcgttgtcagggctgagagatgagtcctggatatctgagtcactagagggagcgttgctctgggaggctctgagatgacacaagcatgttcttcacagcccttccagcccgtctcctggcctcccaaaggcttctgccacctcagccactctggagctggatagactgatggcctcactctctgacttccgcgttcaaaaccatgtgagttgggcagtgggccagtgtccatttgtggctccccaaccccttctagacaattccacatctgctgctttgctgactcaattctcatgtcctccccgctgcagcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtaagtggagccttgtgagaagggaggcagagacctgtcacagacccatctttagtgagagctgggctttatgctgttcccttttagtaagttaatctgggaagtgggtatcattattacttatgttttatggatgaggaaactgaagctctgaaccacacagcaggttagtggtagggtgaaaattccaaccatgttaccatttattgtggtcctactgtgtgccaggcactgtgccagctcctttacaaaccctcatctcatctgatcttcacaaaacactctgtggctccacccaatatctctcaggcatctacaaaggctctctcttcctccgtcagagtctggactgggttcactggtccttgttttattgactgagcagatgtgattgacaacagctgtgcctaggggttaacctagtgccccctgctagatcaagtacctgactcccagcccagaattgcccatctcagcaaaggagggtggcattgtgacttttgtggatcataggcactttcatcttcatgagtcccttcgtccattaaaataaatagatttttatgtctgtgttggtgtaaagatgggtatgttattattgtgtattacagcattttcttctagttcatttttttattctgaatttttaaaaacggatttttcacttcctccctcttatttattttgaggcaaattctcactcttgtgacccaagctggagtgcagtggtgcgattgtggctcactgcagcctcgaccttctgggctcaagtgatcctcccagctcagcctcccgagtagctgggactaaaggcgcccgccacctcgcccagctaattttatttatttattgtagagatggggcttcgccatgttgcccaggctggtctcaaactcctggactcaagtaatcctcccacctcagcctcccaaatgctaggattagaggcacgagccacccagcctgatcgtattttgattttaaaaaaattaaaacgtttttatgggcccctaaatgtattgtgggctccaggcgctgtgcctgctgtgcctcatgtataggtcaatcctggagcgcagctggaagacggaacacgggagctagatctccatcgcttacaggctgcgtgatctcgaacactggattctttattctgatcgctcagagaggactcgaaaaacgccgcgtaaatcttgcctcactgggcatgtggttgtcagagccgctctgacccgcctcacctcccactcgcaggtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacgtgagccccgcccggccgcaccgagcccgccctatctcaccaggagagctgtgggacgggcctccaccgcatgggtcccgccccacccgcgataccccactccacccctaccccttccccttggcaatgtccacggccccttggactccactcttcctttctgacccccacgttcctagttagatcttctccccctccccccacgcatgccttagtccagtcacccgggttccgcgcgggagaggaaggcgcgaaggcacggaggccgcgctgagtgccctctccctccctgcagaagatggtgaccgccttgggcactcactggcacccagagcatttctgctgcgtcagttgcggggagcccttcggagatgagggtgagagtgaactcgactcccatcttaaaagctgcgggtcccctcgacgtctcgccccagcccctccgacctccggagtcctcagggccatggttttccttctgctctcttctggccctgccctctcctacacagactccggacccgagccctccccgctctgtcccgccatagacccggctcctccttccccaaggctccctcggactgcccctccttcggccccagatctcaggtcttgtgggtcccccgtcccgcccgcaccctttgctttcagcccactcggttccctctcctaggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggtgcgagctgcggggcggggcgttggaggggcgggtcaagggtacagggctgtggggcggggccttggaggggcgggtcaagggtgcagggcagggggcgggccctcgggggggcgggtcacgggaggtgctgctaggaacctcgggtggggcgagttttccgggcagggtcccaccggacgggattcttcgcgtctagggcgggctgcggggtcccagggcgttatccgctagtaacgcgcgttgtctggcagtggccgctgacctgtctgtcctctttcgcggcttcccttccccaggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctctc

SEQ ID NO: 1800 - DNA, 5754 bp, Homo sapiens
tggggccggatccccgggtccgtggcccctcaccgctgcccagagctgcctccccgccgtcgctctcccgcatctccccatccctgtcttcttacttctgcttttcgcctctgcccgcgcctcctttccaactccacgtcccccttcctgcctctcccttcctgcctttcctgggccggccgctccctcccttcttccctcgctgtgctcctccatcccaggctgcggcagatggaacgggaggtgcggcgcccgcgggcgcccgggcgcggggctctggggagggaggggttaaaggggcctcggcccggggaccgggaaagtagagggcacgggaaagtctggcatcaagttttggagaaaaaaagcgggcctgcctgcaccagagttttgggagaggaggagttaagggctcctgagcacagtgagggtcaggtccttgaggcaaggaagagaatagtaactcaggagtgcctaggcgcccgcgaaggcttcagggtttcacgcgggtgctcagagacgaagactgagggcaggacttctgggttctggaagtgaaagggctcaaaagacccggatctggggatgcagggatggagagaggtgtcttgtccggaagggggacccaggtatctcgtcctccctgcgaagcctggggctggaaggctgtgcgctccacgggagagaggggcttccggcccctggcggtagagggcgctgctcggtaggggtaactgacgctgtaccgcagataaacagccaatcagaaggcaggtcccagcgaagcgccagtgaggagcccagggcgggactcaggggcctgggagtggccaggctgggcggggcctgtgtaggtagagggaggagttaaccagcatggaagagagagcgtccaatcagaaagctgagggccaggcactgggccaatggagcaatttggaggggagccaaatttggcttgggtgaagagcccattttgactgcatcagagaagatggggagaataaaataatcaggaggctgggtttgtgcttggctccaagcgtgagcaactgggatattctggtcataaatattccttgctacccttcgagcagtgctctgcctggctctggccctgtgacctcttctcttaatactggcttctgtccttctccagtactgcccactgggaaccttatcttctgatctaaccgtgacccttgtctctctccctgatggcctcttcctgcagatgccctgctctctgacctggagactaccacctcgcacatgccaaggtcaggggctcccaaagagcgccctgcggagcctctcacccctcccccatcctatggccaccagccacaggtgagatcggatgttggggactggggcagccactagggccaggctcggcctggtctatggggatctcagcctcagtggggcagagtgcaggcctgtcatcccacctgtgcgtctccgctctgtagacagggtctggggagtcttcaggagcctcgggggacaaggaccacctgtacaggtgaggggcctggaaaccagggcatgggggccaactgagtctcaggtgaggaggcttggattccccacccctgaacccaggctcccactctgcttcccagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacaggtaccagggtgactgagagaggccttgatgcgataggggcaggggagggaagggtggggcagagactaagaggaatacacttcccagagtagcagttaaagggacctaaagcctcaagtgtgagggtgcgttgagcatggccctatatgtagcgtcctcctctcctctctccagatgaaatcatgtctcagttcccatctagcaaggtggcttcaggagagcagaaggaggaccagtctgaagataagaaaagacccagcctgtgagtttggcgtcgttgtcagggctgagagatgagtcctggatatctgagtcactagagggagcgttgctctgggaggctctgagatgacacaagcatgttcttcacagcccttccagcccgtctcctggcctcccaaaggcttctgccacctcagccactctggagctggatagactgatggcctcactctctgacttccgcgttcaaaaccatgtgagttgggcagtgggccagtgtccatttgtggctccccaaccccttctagacaattccacatctgctgctttgctgactcaattctcatgtcctccccgctgcagcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtaagtggagccttgtgagaagggaggcagagacctgtcacagacccatctttagtgagagctgggctttatgctgttcccttttagtaagttaatctgggaagtgggtatcattattacttatgttttatggatgaggaaactgaagctctgaaccacacagcaggttagtggtagggtgaaaattccaaccatgttaccatttattgtggtcctactgtgtgccaggcactgtgccagctcctttacaaaccctcatctcatctgatcttcacaaaacactctgtggctccacccaatatctctcaggcatctacaaaggctctctcttcctccgtcagagtctggactgggttcactggtccttgttttattgactgagcagatgtgattgacaacagctgtgcctaggggttaacctagtgccccctgctagatcaagtacctgactcccagcccagaattgcccatctcagcaaaggagggtggcattgtgacttttgtggatcataggcactttcatcttcatgagtcccttcgtccattaaaataaatagatttttatgtctgtgttggtgtaaagatgggtatgttattattgtgtattacagcattttcttctagttcatttttttattctgaatttttaaaaacggatttttcacttcctccctcttatttattttgaggcaaattctcactcttgtgacccaagctggagtgcagtggtgcgattgtggctcactgcagcctcgaccttctgggctcaagtgatcctcccagctcagcctcccgagtagctgggactaaaggcgcccgccacctcgcccagctaattttatttatttattgtagagatggggcttcgccatgttgcccaggctggtctcaaactcctggactcaagtaatcctcccacctcagcctcccaaatgctaggattagaggcacgagccacccagcctgatcgtattttgattttaaaaaaattaaaacgtttttatgggcccctaaatgtattgtgggctccaggcgctgtgcctgctgtgcctcatgtataggtcaatcctggagcgcagctggaagacggaacacgggagctagatctccatcgcttacaggctgcgtgatctcgaacactggattctttattctgatcgctcagagaggactcgaaaaacgccgcgtaaatcttgcctcactgggcatgtggttgtcagagccgctctgacccgcctcacctcccactcgcaggtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacgtgagccccgcccggccgcaccgagcccgccctatctcaccaggagagctgtgggacgggcctccaccgcatgggtcccgccccacccgcgataccccactccacccctaccccttccccttggcaatgtccacggccccttggactccactcttcctttctgacccccacgttcctagttagatcttctccccctccccccacgcatgccttagtccagtcacccgggttccgcgcgggagaggaaggcgcgaaggcacggaggccgcgctgagtgccctctccctccctgcagaagatggtgaccgccttgggcactcactggcacccagagcatttctgctgcgtcagttgcggggagcccttcggagatgagggtgagagtgaactcgactcccatcttaaaagctgcgggtcccctcgacgtctcgccccagcccctccgacctccggagtcctcagggccatggttttccttctgctctcttctggccctgccctctcctacacagactccggacccgagccctccccgctctgtcccgccatagacccggctcctccttccccaaggctccctcggactgcccctccttcggccccagatctcaggtcttgtgggtcccccgtcccgcccgcaccctttgctttcagcccactcggttccctctcctaggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggtgcgagctgcggggcggggcgttggaggggcgggtcaagggtacagggctgtggggcggggccttggaggggcgggtcaagggtgcagggcagggggcgggccctcgggggggcgggtcacgggaggtgctgctaggaacctcgggtggggcgagttttccgggcagggtcccaccggacgggattcttcgcgtctagggcgggctgcggggtcccagggcgttatccgctagtaacgcgcgttgtctggcagtggccgctgacctgtctgtcctctttcgcggcttcccttccccaggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctctc

SEQ ID NO: 1801 - DNA, 8173 bp, Homo sapiens; identical to SEQ ID NO: 1797

SEQ ID NO: 1802 - DNA, 68218 bp, Homo sapiens
gggcggagctaggggcgggcccctgcgtctctgggcgctggagcgcggcgactatcacgccgcgtggcggacggacggactgacggacgcgcagccttacccgaaaggccatggcggagcacgcccctcgccgctgctgcctgggctgggacttcagcacgcagcaggtacagtcgcctggccgcagggccacggggccgcctcctccgcttcggtgggggtagggggcgggctgtcacccggacgcgggaaaacatgggcccggccgcgggcgcgcctacctctcgggcttcccggggcccccgcgcccctgccctgcgcgcggccgtggggcgccggtgccctcgcccggagatgccctgccaatgccacccgctcgcaagatgcggcctcgaccccgcctggacccagctaccccaggaaactgcaggcgctcctcggcaggacccccggtgcccagaggggccggaggactcggcgggttcctgcgctgttctgggcacccagtgacggggatccgaaggaagtcagctactgtaaggcaggggaacagacaggcgggtagccctgcgcacatgcacaaccagtgacctggaagcagattatagcccaaaacctttttttaaaaattgaaatggcccaggcctggtggctcttgccggtaatcccagcactttgggaggccgaggcgagtggatcgcttgagcccaggagttcgagaccagcctgggcaatatggagaaaccccggtctctaccagaaaatacaaaaattagccgggcatggtggagcacacctgtagtcccagtttttctggaggctgaagcggatcgcttgagcccaggaggtggagattgcagtgagctaagatggcgtcaccggtctccagcctgggcgacagaacgggaccctgtctcaaaaaaaaaaaaagaaaaaagtgaaatgcatagtgtacaagtggactttaccctgtgaccgcccttcgttgacaccagcttgcctggtctgtgcacccaggactgctggccagaggagcagtgtgctgctgccaacgccctgcagacaggcaagcaaatcaaaatttgccttcaaagagggcatggggtgaccgggggcaccttttcctttaaagtacttgggaaatatacacagttgcagtcaaacccctcttctcgaatgggtcaagggaggcaggcctctggccagtccttgggggaacgtcctgtgggactctggatgactcgagttgccttgctggacctcagttttcccatctgtccaggaaaggagttatactcccaagcttggagattgcttcagtgggacattaatgtctctggaccacaatcatggcctgtgagaatagcccatggccttgcctggtctcaggcctctgcagacatggatccccagagatgcctccaaaccttgcttcccattccttcctctctggcactttctcccgcctccttgtcaggtgcacgaaccaactcatctgtgaacatcttcctctagagggtcttggctttggctatttggggaacaaagattccttgagacatgtgggtgttcctacttagcctcagtttcttcattttactaaatctttgagtgttaccccagatgagtcctctgttaccacgattacggtgaggcagccctgccttcaaggaggtctctaggttgaactgctcctagggtgtggggcctcatctggtgacgttagtaccccctggaccagtgtagaagctgaggaaaattctacacttccttttttaaaatgcctttcaggtaaaggttgttgctgttgatgcagagttgaatgtcttctatgaggaaagtgtgcattttgacagagatcttccagaatttgggtatgtacttgatgtgcatgtgtgtgtgatgggggtgttggttttggggtcctcccgcaaacttttgtattcgcagaccgcactgttgaggctttgccaaatacaggagtggtggtctcggcagacctttcaagcatctttttttcctatacctagagtgccatctcccccatttcttcctaattccattcatccattcatgaagtaagcatcagttgagacctactttgtgccaggtgctaggacctgatggcgaaacaaaaagagaaagctctcccagagcttcccactgagtagtggagactggtatcaaacaaagaatctcacaaaagagtgtttcattataaactctgagaaggcctctgaaggaaaggaactcacttctccaagtgcttattataaaggaatgtgactcagacttgggaggggaagtcccagagcgtctctagggaagtggtgcttaagctagagatcagagtgagtgaagttagccaagcgatggaagggaagttggccaggtgatggaagagcattccaggcagaaggaacaacatgtgcgagggccctgtggcaagaaagagcatggttcattccttcatgcaattgaagaaagccaatgatgctggggagcagagagaggcggaggctggtcagagctccataggccatggtatagagtttgtctttattctaaaagctatggtcagccactaagggccataaggggtaggggtatgggtgaggtatgaatgacaggttgtatttttgttttgaaaatatctctctgggggcattgggagaacagattcggagcattgctggaatggacgtggggaactattaaagaggtttttgctggtcattcaggtatgaaatgatggataggagagagctgagtagtaaaatggacaggtcctgttacaaaattgaatgtgagatgtaagggtgggatttctggctgtccttcagagtggatgttggactgtgggaaagaatgagttttggagagaaagatcatgagttcagcttgggctgccataacaaggtaccatagactgggtgggttaaagagcggaaatttatattctcacacatctggccgttaggagtctaaaatcaaagtgctgggaagattggtctcctctgggacctctctccttggcttgcaggtgaccactctcttgctgtgtcttcacatggtggtcactcggtgcaggagtgcttggtgtctctgtcatctgtatcctaatcttcttataaggacatgagtcatactggattaaggcccattctaatgacttcattttaacttaattgcctttttaaaggccctgtctccaaataatcacaatccaaggccctcggggttaggatttcagcatatgagttttaggggcagagggggcacaattcagtccgtaacactgtggacttgctggttttgaggcaccctcgtgagggcctggtaaaagtgtccttccctgtctgttttagacacacttcctctttgaagccttcccagctgaccctttgtgcacctctcattacccatcacattgtgttgccaactctttgcccccagctaatgcggccccatggagccgaggttagaagccatcttgctttctcacattttttattattgcaggccttgcatgtttgcctttgggtagttggtatgtttcaaggaattggtcttttcaactaagccatcaaatgtgtggccatagtgttgttcataatattcctttatcctccttatgacatctgtgggaccagtaatgatgatctcttgctgttggtcatttctgatattggtaatttgtcttctctctttttttctttggttatcctggctagaggtttatcaattgtattgatcttttcaaagttcaacttttggttttgttgattttcccctgttgttttcttcaagttgtgctctaatttttattacttagtttcttctgcttgctttaggtttaaattgctcttttttccctagtttcctcaagtggaaacttagaggattgatttaagaccttcttttctaatatatgcatttaatgctataaatttctctgtaaacacaaatgctttttatgggatgccttagcagcatcccatacattttgataagttatagtttcattttttttcgttcaaaatattttttagttctcttgagacttctttgactcatgggttatttagaagaatgtttttaggctgggtacagtggctcacacctgtaatcccagcactttgggaggctgaagcaggcagaacacttaaggtccggagtttgagaccagcctggccaacatggtgaaaccctgtttctactaaaaatacaaaaaaattagctggacgtggtggcaggcatggtgacaggcaccgtgtatgctgcacgcctgtaatcctagctagctgggaggctgaggcaggagaattgcttgaactgtggagagggaggtttcggtgagccaagatcgcgccactgcactccagcctggacaacagagggagagcctgtctcaaaaaaaaaaaaaaaaaaaaaaaaaaaaggaagtctggaagtgtgttgtttaatctccagattttccagttttctgttattgatttctagtttaatttcattgtggtctgagaacataccctatatgacttctagtctttcaaaattttaaaatttcctctccctcactctctcttccacttaataagtcagtcctctccactggacatttaaaaaaaggtgtccataaccaaaatatggtattgcttttttccattatattttcaagatattttaaaccagatgcctatagatttagttcattccttccccatcacctcaattgcattgtgggttttctttttacaactttattaaggtataactgatgtacaatactgtgcatatttggagtatacagttaaaagctttaatatctgtattctttcatgaaactatcaccaaaataagacaatgagtatttccatgtcctaaaaatttcctcctgcctctttgcaagcgatgcctccttccccatacccctacccactggcaaccgctgatgtgttttctatcactagtttgtattttctagaattttgtatagatggaatcataattatgtatgcttttttaaaacctttaaaattttacatcacagttttgagattcatccatgttgctacatgtggcaatagttggttcctattattgccgagtagtatttcattgtatgatgttgtatggatggactacaattggtttcacctgatgagggatattggggttgtttctcttttctgttgttataagcaaagggctatgagagtcacatacaagtcttttcgtggacatatgatttcatttttcttggaaatgacataccaggagtacagtggctgagttatacggcaggtatatgtttaacttcttaaggaattctcttccaaagtggtgattttaagaaaaaaaattttatattgttaacaggcattacattgcacttaatatgtaactcaatgaaaagtatacagtgaaaagtctttttttttctttttttctttctttttttgagacagagtctggctctgtcgcgcaggctggagtgcagtggcacgatctcggctcactgcaagttccgcctcccgggttgtcctccattaggaaatggtacatctacacaatggaatactacacatctataaaaaagaacacagaagtttttatgtattgacatgtaaacacagccacgttactgtgaagtgagtaaagcaaagtacagatcagtgagtatagtatgctttctcttgtatgaaaggaggaaaatcagaatattcataccttcctatatttccatgtaaaaacactggaaggagcctggcacagtggctcaagcctgtaatcctagcactttgggaggctgaagcgggtggattgcttgagtccaggagttcaagaccagcctaggcaatatggtgataccctgtctctaccacaaaagtgcaaaaattagtcatgtgtggtggcgtgcacctctagtcccagctacacaggaggctgaggtgggaggatcacttgagtccagaaggtggaggatacaatgagccaagatcataccactgtactccagtttgagggacagagccataccttgtctaaaaagtaaaaaaaaaaactagaaggatacacaacaaattaaagtcatctgtagagaagggacggagaggagagatgagctcacaggtgggattaagacttttcactgttatatggggtttcaccatgttagccaggatggtctcgatctcccaacctcgtgatctgcctgcctcagcctcccaaagtgctgagattacaggcgtgagccaccacacctggccaagttgtcgctattattgccacgcacagatatttatgtcattgaatttcccagtctcttttattgcttctagattttgagtcatagttcaaaaggccttcctcactccaaaattatgaaggaactcacctatgtttttatctagttcttgtaagatttcagctttcttacataaaaatatttggagtttatccaggtacgtagtatgacatttgtatccaactttaatttttcccagatgattcttcagttgttgtaacaccaaccatgtttttatttaatttattttttttatttgagacaggagctggctgtcacccaagctggagtgcagtggtgtgattcagctcactgctatctatgcctcccgggctcaagcaatcctccctccttagcctcccaagtagctggaaccacaggtgcgcccctaccatgaccagctaatttttttgtattttttttgtagagatggggtctcactctgttgcccaggctggtctcgaactcctgggctcaagcagtccacccacctctgcctcctaaagtgctgagattacaggcgtgaaccaccacacccagcctcaaccgggtttttagaagcccatctttacctttaagaggctgaggtgggcggattacctgaggtcaggagttcaagaccagcctggctaacatggtgaaaccctgtctgtactgaaaatacaaaaattagctgagcatggtggtgggtgcctgtagtctcagctacttgggaggctgaggcaggagaatcacctgaacctgggaggcagaggttgcagtgagctgagattgtgccactgcattccagcctgggtgacaaagtgagactccatataaaaaaaaaaaaaaaaagaagtccatctttacctccatgatttgagatgtgaggcttatcatgtgctactttctgtgttcacttaggtccatttttgggcttttgtttttgttccatggtttggtagatctgttcataagccagtaacacattgtttcaattatcccagctctgtaatatgtttgtttgtttgtttatttacttttgagttggagtctcgctctgtcgcccaggctggagtgcagtggcatgatctcggctcactgcaacctctgcctcctgggttcaagtgattcttctgcctcagcctcctgagtaattgggattacaggcgcccgccactggctaatttttgtatttttagtagagatgggtttttgccatgttggccaggttggtctctaactcctgacctcaggtgatccgcctgccttggcctcctgaagtgctgggattacaggtgtgagccattgcacccggcctgtaatatgttttaatatctagaattgttggtcccctctgtttgtttttttttccagagtttccatggctattcttgttctttttcaatatgtacttcagaatcagcttttcaggttccagaaagccaaattgttaatttttttttttttttggacatggagtctagctctggagcccaggttgaagtgcagtggtgtgttctctgctcactgcaacctccacctcctgggttcaagcaattctcctgtctcagcctcccaagtagctgggactacaggcacataccactacacttggctaatttttgagtttttagtggagacagggtttcaccataattggtcaggctggtctggaactcctgacctcaggtgatccacccacctcggcctcccagggtgctgggattacaggcgtgagccaccacacccagcctgttgttaatatttttattgagatcatattatctttataaattaacttggcagaattgacaactttatgagattaagtcttcctgtctaagcacacgttatgactttccatttgttcaagtcttcttttgaatacttcacatgtgttttaatatgtttaacatacagcttttgctcactttggtagattgcacaaatgaccacaatactccacccatccctgtacccacaccctttgcaatgtgactgtaattcctcccatcaaggagtcgtttccctacctgttgatttgctttatccagtagaacaggggaagtggcattgtgccagttctaagcctaagcctcaagcagccttatgtgcttctgctgtcattcttggaactctgcctagccaccaaatgaacaagctcaggctatactgctggagagttggacatatgtggcctagttgccccaacttcttcccctaagagccagccagcccctagctactgttagctacctatgaagcagagccttctagctaccgttaactgactgcagatgtatgagtgagcccagctgagccccatccaatgatagcaagtagaattgtgagcttaatggttttgagccactaagttttgaagtggtttgtgacaatgcagaaattacccaatgtagataattatttttaagtttatttctaacttttttatccttttactactgtaagtggggaagggaggtttctagcagaaacttatcagctgtcttccaaactcatttccctttcttcctaggcactctcctgccttccttgtagttatgttcagccatgtgactgagttctagccagtggaatataagaaaatgtgatcaggcctctaaaagacctagtccatcaaaacctccttctctgacttttctcccatttttggctgatgtgggtgtccagagcaaccttggaagcacatgtggaacatgacagagccaccatcaacctggttcctgaatgactgcatggagcagaactccccactccccactcatgttcctaaccacctactgattgtgctttacatgaggagaaagaaacttcagctgtatcaagccatagaaatgtgtttttccttaactaatataattttttccctcatatcctttttttaaagaaaatactggggccaggtgtggtcgctcacgcctgtaatcccagcactttgggattacagaggcgggcacatcacgaggtcaggagatcgagaccatcctggctaatgcagtgaaaccccgtctctactaaaaatacaaaaatttagccaggcttggtgccgggcgcctgtagtcccagctactcgggaggctgaggcaggagaatggcgtgaacctgggaggcagagtttgtagtgagccgagataatgccactgcactccagcctgggtgacagagcaagactctgtctcaaaaaaaaaaaaaaaagaaagagaaaatactgtttctattgaaatgtaattcacataccataaaattcaccttttaaaatgtacaatttgatggttttagtatattcaaagaacaatatcactatcaccactatgtaatcttagaacattttcaccacctggaaaggaaaccctgtattaattagcatccactgtatagtccccctcctgccagtagtggcaaccacaatcaactctctatctctggatttgctgattctggacatttcgtagacatgaatatatataatatgtgacagccttcttttacttagcataatgctttctttttaaaaaattttcatagctttttgtttatttcaaataccaacttgaaccagatacctggcataatgttttcaaagttcatccatgtcatagcgtgtgtcagtacttcattcctttttgtggttcagtaatattccattgcattgatatatcagagtttgtttttccattcaacttttagacatttgagttgttctgcttttttgctattgtgagttattctgctatgaacatccacatatgttatggattgaattgtggccccccagaattcatatgttggaagcctaccctcatcatgacagtatatttggaggtgaggcctttaggtagataattaaggttaaatgaggttgtaagggtggggctctaatttgataggacctgtttccttataagaaggagagacaccagtgctatcccacttcatgcgcagatgcacagaggaaaggccttgtgagaaggcggctgtctgcaagctggaaagagagccctaaccagaaactgaatttgctggcaccttaattgtggacttctagcctccagaactgtgagaaaataaatgcctgttgtttaaaccatctagtttatggtattttgttatagcaacctgagcaaactaatacaatgtatacgtttttgtgtggacatatattttcatttctattgggtatattacctaaaattggaattgcggggtcacatggtaactctgtgttcaacattttgaagaattgccaaactgttttccaaagtggctgtactattttccattcccaccagtggtagatggtgcctctagtttctctacatccttttttttttttgagatggagtcttgctctgtcacccaggctggagtgcagtggcgtgatctcggctcactgcaagctccacctcctgggttcatgccattctcctgtctcagcctccctagtagctggaactacaggcacccgccaccacgcctggctaattttttgtatttttagtagagatggggtttcaccgtgttagccaggatggtctcgatctcctgaccttgtgatccgcccgcctcggcctcccaaagtgctgggattacaggcgtgagccaccgcatccttgcttaacatttattattgactgtctttttaattacagacggcagccatcctagtggatgtgaaatgcaatctcactgtgcttttgatttgcatttatctaatgataataatgatgttgagtatctttgccatttgtgtatcttctttagagaaatgtctattaagatcttttgcccttttttaaaaaaaaactgtgttatttctcttttattattgagttgtaaaagttttttttaatgtatattctggaaacaagtcccttgttagatatgtgatctcaaaatttttgtcccattctgtgggttgtcttttcactttcttgatgatcctttgaagcaatgtttttaattttgataaagtctaatcttcctacttttttccttttgctatttgtgctttggtgcagtattggttaggttttggtatcaattttatatttacttcactaaaataattggaaaaattttccttcttttcaggtgctctagaacaatttaaatagtattagaaatatttgctatttaaaagtttggtataatttttctgtcaaaccatttgggcctggtgcttttggggcatggggtggctctggtcttccttcttagctggaaatgccagttttgttttgtgtgtgtgtgtgtgtgtgtgtgtgtgtgtgtgtgtgtgtgtgtgtgtttgagacagagccttgctctgttgcacccaggctggagtgcagtggcaagatctcagctcattgcatcctccgcctcctgggttcaaacaattctcccaccttagtctcccaagtagctgggattacaggtgccctccaccatgcctggctaatttttgtatttttgtagagatggggtttcaccatattggccaggttggtcttgaactcccgacttcaggtgatctgcctgccttggcctcccaaagcactgggattataggtatgagccaccgtgcccagccgaaatgccagttttaagttgttaaatacatggcagaatgtctggttacagtttttatctgttttgtgaaggcaacattttttggtgagcttttattgtctgtagtaaaattttgttgctctcttcctctttttccctagtagtatctttttaaaaaatccatattattgagtataatttatgtacaaaaaatgccatccattaaaaatgtataattaaaggtactttgccagatatagacctatagctgtgaaactaccaccacaatcaagatacagaatgtttatatcaccccccaaaagatcgcttttttccctgcttaccgagacaagctcggttgtggagactccaacgcaccagcactagaggaatgaagacaaagacccagaaataaagtgcagtgtgggaatcggctaaaagcctttagagctgagagccacaaacagagttttgcccacatatttattgacagtaagcctgtgataaacattgtttctaaagattatagattagctgaaagcatttcttatgggaaacaaagcattcttttcaagaagcagagaaacaggctgtggctgattatctgcagcaggaacatgtccgtaaggcacagatcgcttatgccattgtttgtggtttaggaatgccttgagtggttttccgccctggatgggccaggtgttccttgccctcattccggtaaaccagcaacctccagtgtgagtgtcatagccatcgggaacatgtcacattgctgcagaaatcctgtttatggccagtttctttaaggcctgtttatgacaggcttagggcctgttcccagcacccactagacttagacaaccactgatctccttttctcagtatagatgaatttgcgtcttctagtctgttcctatataagttataattgtgtacatatgaatagttcatattttttcttgctctgtagtatgatatcacaaatatacaccacgatttatctgttcacttgtttagggacactgggttgactccagttaattattacaaataagtctgctatgaatatttgtgtacaaatctttctatgggcttagactttcatttctcttggctggatacttaggaattgaatggctagatcacatggttatctaatagcatcttggtgtggattctgagcctggttttctctttcctaacacatagttaaaagggttggattttatcagatcagctctttgcactagagtcttctaggggtgaggtgggtggggagagggttccagtcaaacttccaaagcctgtagtccaaggacttgttggtctgttgtgatagtagagacactcttccctccgacgcagcatctctgtgtggctgcccctcctctacctctccaaacctatggggcttgagagggattttataatccaacactgcactcccctagggtgagcctttcttatctagaaggcttctttagaagatgcttctgagaattgccacatctgggccactctgggcaatttgcctgtcttctctttccatctttgcagccctcgtgcctgttcaatcaacagttcccacttggggttggggaaggttctccttcatctggacatttccagagtcatccaccatagggtttctcctggctttgcaatggtctgcctgccctgaggctctggtctacattctctgttgttcttgcaggactcagggtggtgttcatgtgcacaaggatgggctgacggtcacttctccagtactaatgtgggtccaggtaagcgcagggattcctattctccttctatccccaggctgtctcactggcagactcggtgatttgctaggaagtccaaaggtggcagccaatgagagcatctgttgtcaccaggtcctcatgggaaggtggagttggcatgactcctgggatcaggctcagcctcagctggtgtcaacactcccaggctcagaggacttacaaaaaacttccaggtactggagctacagcagatggcaagtcctgccattaaccacctttaaaataacacagagcaaatcttttccaaacatctgcagtcaggccctgtggcctcccttgtaccatgaaatatacaaacatagactgggcatggtggctcatgcctgtaatcccagcactttgggaggccgaggcaggtggatcacctgaggtcaggggttcaagaccagcctggccaacatggtgaaaccttgtctctactaaaaatacaaaaaattagccgggcgtggtggcccatgcttgtaatcccagctactcaggaggctgaggtaggagaatcacttgaacttgggaggtggaggttgcagtgagctgagactgcaccattgcactccagcctggataacaagagtgaaactccatctcaaaaaaaaagaaaaaaaagaaatacaaacatagcccttagggtcttagtgctcagcctccaagatcccttagctccctaatcacctagaatggcaagttatggcctggccagtcagactcatatcaatgccaagccaggcctgcctgctgaggatcaacaggaaaggagaatgcctgtagcaggatctggtgacctagggggccacaggagcagggatgtggacagcatagacaggcgtggtagctccaggggctacctcatcatatgctgcagggtccccgagtccctgaaactggaggccagctaagtgtgtgtcttccaaaagcttttttcagtcctccaatacctatctaaccaattccctatattacattctttttgttcaaaataactggtatgatttcttttttattggtgtaaccctgattcatacactggagaattggggtaaaggatggattttatccagataaactggctagaatgtacttcagagggggctgagccagaccaaggggcagagtgggagggtcgggggttagagacaatggtcagtgtcaggaggtcccagtgatgatgtcgagggcatctcataggccaaggccttcacctggggaggtgagcagtgggtgagaaccaggcttgggggcagggccaaggtgatttctgatctgacgcagcctccaggaccaaacttgatcctagctctgccagcccctgctccggctgcaccccactgcctgcccaaggtttgatgggcacagatagagatggcagccacagccagggctgaaagaagccctcccagcaaaggctgggggtggtggagtcaggcaaaagtgagagagtcttctctgccctcaggaaaacacaggtcagagtgaatctctaattcctgccatgaaatcttaggagggtggtgccaagctctgctgggcaccaccatccatcccactcactgggttttgctagaaaggagggtccaaccagacagtggaggctggaataggggcctggaacaggtggccatcatctctatccactccctccagcctctggctcctggacacagggagtctgggcctgatgctttgctctcacgggagctctctcctttgctcttcacttccctgttgcagtgaagtcagatcactaatatagagggttgaaaatgcaaataaaagaaggcaaaagttggctgccttactttgttagtttttgagacaaggtctcactgtgttgcccaggctggagtgcagtggtgtgatcatggctcactatagcctcaatctcctgggctcaggtatcctccctcctcagcctcctgagtagctgggattacaggctcatgccaccacacccagctaaatttttcattttttgtagagatgggatctcattatgttgcccacactggtcttgaactcctgagctcaagtgatcctcctgccttggcctccaaaagtgctgggattacaggtgtgaggtgatggcatgcacccgtagttccagccacttgggaggctgagatggaaggatcacttgggcctgggaggttgaggctgcagtgagctgagattgcgccactccatttcagtctgggaaccagagcgagaccctgtctcgaagaaaaaaaaatggagaagtaaaatttgaggattggtggtttatgattccatttatttaaaatatttttagcatagttgacctttttatttgattgatgcctacttgtttaattaatgtactctagtgcttacaaatcccaagtcatgagtttcttcatcatctgcccagagtactctgctgtaatggcaggcacttgcgtttcaattctgaggcttgcgtgtctgattcagtggttctgtacagtcatggtgggttctgtttttcttcttaggcactggatatcatcttggagaagatgaaggcttcgggcttcgacttctctcaagtcctagccttgtccggggcgggccaggttcgtttgcagcagactctgtctgccatgtgagggtgactgtcctgggcaatggtgtgggtgttgaagagatggcaacccttggatggggagcggctcattcttgacagccactgcacaaatttcactgtgaataaaaatccctacaactattttactttggagactgtataacttgtctcgttgcaaaaggatctgagacagttcttaggagtaagtattatataaaataggacgcttggtgagagaactgagttcctctgaaggggatggaggaagcaattgacatgaatttattatgactgcttgggggcaccacaattgcttttctatttcctgaaagtaaaagcaaagtcaaaaatgatcctaataatgatagtagtttcagtagaaggaagagtattaataatgatatcagaggacattgactgagcacttagtgcatgccagatacaactctgaggcctttccagatgtcatccaacttaatccttatgattctacagggtggtgctgtggagtgcttggtacacactcagggcatactgtctgggtttgatccctggctctgccatttacaggcagtgacctgggatacgtcatctggctttctggtgcccccgtattctcatctgtcatagggtcattgtgagtgtaagtacatagcacagtgcctcctattaatacgcagtaaacattattaaagcttgggcttctgttattatcgttgatatttacatgaggcacggagaggtgatgtcacttacccaagatcacacagtgctgggagtgggagtcaggacctgagtctatctcattcagtcccttggctgtgctgggatcacttttctccatgctggattactgtattttcaaatcctcactaggatgtaactaatttttctgaagatgcttcttcctccatgacctaacaggaatttattgttttggttcttgttaaacacaacagagattccctgggtgatcttgtccacttctctctcccgaatcccaggcctggacacccatctccctcctagctaatccccgacccccatggctggatatcccacagatgcctcagacttagcatgtcccagactgagttctgtctcccttcagacctcctcctttctgggttctctttctcagggaattctccccatccacccagggcacaactcaagtgtcatccctgcctcctccaccttcccaccccacatccaagggtcctcacgtcccactgatttgtctgtgactcttgactctaccatctcttctccagcgctatctgcttgtcattcttctccaggtctctaccgcagcctccttgcctccagcctaccttccccgtgactcccacaagcctttaatacattcagctctgtgcacgctgctccccctggtaatccagggttcctaccacctccaagataaaccccagcctcctgagcatggtttcaggctcagtgctcaggctgtcccctctctcttcagcccatcacccacccccgacccagcctcaggcccactgcttagaatgccactcatcccgggacttgcctggcgcccctcacctgcagattctctgcatgcaacacacactaggaccatttcctgatactcatgaccacttcctctcatctgtacccgagttggttaggtgcctctgttcccacgaccctgtcactgcagctccatagggttttatagttgtacatttgtgtccttttccctgactcaactccagtagcctgaagaatagggatgaaagtatcctattcatctgtcgcaagcctggcatgatctatgtgcttaataaatgttcattgaatgaatgaatgaatgaatgaatggggtgagtgaataaataaatgaatttcaggtaatattacaagcaatgtctttaaatgcagttttacaaaaggcattaaaatccagaccaataattagttcttggaccttttctataagttgtagggtagacagggcagagttcctccccattttcttgaagtggaaaccaagtcccaggagggtgatgagctctgtgactaagaagtggcaggggcaggtgtggagcccagttctttggcatgtggtctggggtctttctgtgtcttcaggaggctgtgacactggtgtgtggtcatgtgaccatgtgcttgggtttcccaacagcaacacggaagtatatactggaaggctggagcccagcaggcactgacaagcttatcaccagacctccggctacaccagcagctgcaggtaactgtggctacgttgtgtgagtgtgagaaacttctgcagagtcccaagtcctgtgggtcctgaagcctgctcatctcagtgttgcagctgtgctcacgcgccctcaccagaagagctttcaacctcaggcttttggggagagaccccactgggccagttctaagttacagcacaaagggctggcccatgtgtctccaaccaaggtcacctgggaagaagcgtcatgactgccgtgatgggcagtgtgaccgccagccctggggcagatctccaagtcagcggatggagcttaagcctgtgcctttgccctccttcccaggactgtttctccatcagcgactgcccggtgtggatggactccagcaccacagcccagtgccgccagctggaggctgctgtgggtggtgctcaggctctcagctgcctcacggggtcccgtgcctatgaggtaggctgaggatgcggggggtgcagggggtggtctggttgcaagctccggaggcatagtgggtgacctgcctctggggggatcacatgaggtcatggaggtgttgtggagccagcaacaggcactctggcccctgggtcctgatccaggccacctgctgccctgtgtgttcccaggccaggctgggtgtgcacatggctgtgctcctgacatggaggtgctgtgcatgggggtgagggtaccccctcaatgagaaggcacctcctgtcattatttgtaacccggggattacaacaggacttacgttttgggtaggtttgaagctgaaagaagtcagtgcatgtaaggcacttagtgtagtgcctggcaatgttaaaaaaaaaaaaaaaaggaaaaaaaataatagtgtctctgttccacaggttcaaccttgtccccaggggtgattgtgattaggccagcttgggttacatgacctcgctggagtagaagttttggggatagggccaactctacttgggccacctgaaataacaatatgtgggtggggaaaataccccgatccctcacctggtggcttggtcagaacagtcaccgtgctgtgtgaagagcaagggttattcactcagggttgtccagtcctgatgtgggagaggccctccaggaaggcccagaagttactcacttctctatcctgtgggtgcagagccattgtttactgcctgagtatttgattactaaggacattttaaggattcaaaggccaagatcacattgttcagtagatatcaaacagatttaatgcttatttttaaaatatttaattattagaaacgaggtctcactgtgttgcccaggctggactcctgggctccagagttcctctcgcttcagcctcctgagtagctgggattacaagcgcacactactgtgcctggttggggcttacttttaaaagcttttatggtacctactcctatccagagcatgctacattaaactcactttgtggaggtaattgttcattctgtgtaggatttgggttcctaagaatttatattccttttccagcgttttacagggaaccaaattgcaaaaatttaccagcagaaccccgaggcctactcacatacggaggttggttaaatgttcctgtttgattgaaagtcacagttgaattcttttcataatatgttagaatagatacatcttacgtgcagtgactgaaaacattgataagcagacattaacaaatgatatatttgatttgcttttttctcattgtcaggacatttccaaagaggaggggaagaatggaatgtgggaaagagaagtcaggggttctcctgaccagaagggtgagggtgagggtccaggtgggagcactggggactgacgtgttcctgaggccacctgaatggaagatctgagtgtctgagcaggctgtgtctgctcactttcctatgtggttaacgcaggagggctaccaggcacatgattggcatagagtcagtgttttctttggaaatgtataggactgggcatttgtgtccccagctgtggcccttcagccagagcctctgtcacaggaacccaggttcattcctggctccacagttgctgaagccagcacttgttgctgcctgagaaacagccccacgccctggctagtgattttcatcttgtgataaggaaacgatcagctcacattaaaccaaagcacctttttaatcttagaaattaacatgtggtttattatttaatgatttgaggttccagattattctgcagcattagccattaatgtaggctttgggtagaggggtgaaaaccctccctaaattctgtgtgtggaacgaagtttgcctgacagaggacaggaggtgataacattctctccacagttccaaaggcccatgattctcatgtggaagtacagacccttagggtggcattgaaaatccatcatctatttctctggctagtgctcagggtctgtggcttctgaggagccagctttcctgacgccctgagagtgtcctggttggttctgaggccacacatccacttcccttgtaaccagaaggaaatgccaaggagatagaggaaggaaatcagggcacacattccccagcatgtggattccggatggaaatgcagcttccctaagccctttctcatagggcttttggtttttgtctcttttgaacttggcagttttatggcccatcagaaactgtagagaatgaatgctctcccgaggagtctgctcatggtattccagctgctcctatctgagatgcacagtctccaccattacttgggccttttgttcaaagtttccacttccctctccaattttttttcatgctttgtgtgtgtcagaagcattcagtagcgtagggtatgtggaagtgaggcacctctcactgtttctttcctttacagagaatttctttggtcagtagctttgctgcttccctgttccttggctcttactcccctattgactacagtgatggtgagcctcggggtatggggtgggtgcctgggcagtgtgcatgtggcatgtgggtgtgcaagcagtgggagccccacctaccccgagtgggtgccaatcttgtagccctgtcatctgttgccaggaaggaagtgtattcattatcttttaccacataacaaatgaccccaacacttagcagctgaagaccaccgtgtttattttctcacctagtgtctgagagtcaggaatgtgggggcagcttagcttggaggtactggttcgggatctcccacaaggtggcagtcaagctggcagccggggctgcagtcatctgaagggttgactggggctggaggatccatttccagcatcatgcacatgactacaggcaagaggcctcagttcctcacatgtggctgttagtgacactgcagagagggagggaggagacagaggccaagcagaagctgaggagtcttttataccctaatcttgaagtgatgtgccatcacttttgtctcatcttactggtcacacactaggtacggttgacccagtataatgttggggagaacctcacaaggggtgaacaccaggaggtggggatcagtaggggacgatcatggagcctggctcctgcaaggagctattaaagtttttgtttcacatttggtgaactcatgagatttgtgagcttctagaatcaaaaccccgaaaaaaataaattgcagttgatgccagtgaggagggaaagctgggaggaggttgctgcaggaactcttggatgagcctaagtgtgagaagagtgtggacagaatgggggtagagaatgcagggcaggagcccagagccgtggatatggcttcagaatggagcctgggatgctctgagcctcgtgggaattcatgggaagttttcgagggctgttgtatgccaggctttattctggtttcaggagagagagtgactaaggagtgctgttaagcttccctcacaatctggaggaggcaacagggttccctacagctagttctgtagaactcagacaggcagaacagtcaacttggagtagcctgcatgtccacccgttctgcacacctgccacagagctgataaccgcagcagctgttccggggggcattccagaggtttatgttccttagccacagctgggccctccactctgccccccttcactcacctgagatgtcacctcctcatttcacctgggcaggtgacaccatcagcatcccagcccacctctgtctgcctccaccttggcccagtggaggaggagttctctccacccatgctctgggttccctgtcctttcccatcctcaggaaagccttgggagaaggaggatgttttaggaaagagctagtaggttgatctcagtgaccagaaggaagtttagaggactctgagacctttccttgaaaagttagatgagattgagaaatccctgggagctgacctggaaacctaagggacatggagagtggttcctggtcagtgtgttgctgctagttccaggccccctgggaggtctttgagcagcagatttccaagctaactgtagtgtttgagttgatgaggaatatttggaggaggtgtggtgccgtgtgtttccaagggcccctcttgtctctggttctctggttctagaacaacacaagcatatataccttccatgaagaaagagctccaggtacaagttgtggcaagagaattatctgctctgtgccagatttgtgcattttcacaaaaggtccattttcaagattgtctgttgtttgtttccttccttcctcaggttctggaatgaatttgttgcagatacaggataaagtctggtcccaggcttgccttggtgcctgtgcacctcatttagaggagaagcttagcccaccagtaccatcatgctcagttgtggtaggtctcctttctggtgatgtggctcatttaagagctggcagctaccagggaagcactgtagcgcacacacacacacacacacacacacactctgcacacacccttatttgttcactcacccacaggcatacacatgcagggtcttcagtttagcctaagatgtaagtcagtgtctggatcagtgccttgcacacagtaggtgctcaggtacatgccttatggtcagcgggactttggaaaattccactagaaatttattagaatagggataaaaatggcaggtgattgcatagctaaagaaaaagtgcacagagtgctgaaattctagggactactgatgaagcttgaaggaggcagccttggggaaaatagaaataccagcggggctggcacagcacaggccctggcactggacagcatgggactgaattctggttctatcagctttgtgactttgtgtctcggtttcctcatctggaacaaggggaatgatgctattcatcttacagggctgttgtgcaaattagatgagttaatacttttaaagcacttaaaaaatagtgcctggtcccacaggtaatgggaaaaacatttacccatcacagcggccccacccatttgcagtggacactggctgtgaatgccctggggtgttctacttggccagccctgttctccattgtcctgtggggacagtggagtagagagagagagaaaaagatctgggtgctgcccctggggccctttggtgggaaatgcttaccacagagccagaacaaccagaaggaactctgggtgggacagagtgctggtgtgaagaagggacaagggcaccctgaggcctggagggagtcgtgtaactgggaatcttgggccatgtggaggaggggctgctgtgaggacttcgcgttgggagtctcagccacagaagcacttttgttttcttttcagagacagagtctcaccttgtcacccaagttggagtgcagtggcatgatcatagctacggcagccaccaactcctgggctcaagtgatcctcctgcctcagcttcctgagtagctgggaccataggcttgctccaccatgcacagctaatttttttttttttttgagacagagtctcgcttttgtcacccaggctggagtgcagtggcgcagtctcggctcactgcaagctccgcctcctgggttcacgccattctcctgcctcagcctcccgagtagctgggactataggtgcccgccaccacgcctggctaatttttttatatttttagtagagacggggtttcaccgtgttagccaggatggtctcgatctcctgacctcgtgatctgcccgcctcggccttccaaagtgctgggattacaggcgtgagccaccgcacccggcctaatttttttttattttggtagtgacagggtctcactatgttgcttagattgggcaattctgcctcagtctcccaaagtgctggaattacaggtgtgaaccaccgtgctcggccgtttttcttgtatgattcacactgacatgctgaaaacagcctctgccaccatgaggcagaatgtcaaagccaaaccatcagcatccaaagtatgccatgaggccagtgcatggagctgaaggaacagccatgtggccctgtggaagctgacagcacagctttctgacccgctttctgacgcaggtcagaaaggcagagaaagggcagacagaaaacagccaagccaccgggactggtaatccacacacggcttttagttggatgtgaaattcagagcaggctttgtttgccttgtgcgagaacacatgcctccaagaaggagcctgtgcagacaagcagcttgaggatcgggaaagaactgactctgaaaaggcattttcatttgtcacgtaggtgtcacatgtgggggaaccactcaagacccatgtttttcgtcatccctctttttgcaggtagtgctcagatagccctccctgcactctgtcttttttggattactttccttagaacattgctctctgcacgttcacgtccaattattgttaatccagtcactggggtgatagagtgagtgtgtgaggcattatctgctcccatgagtttgcttactggtgtcctgttacctttttttttttaatgctatatccagaatttggagcttataaagcaagcacaagttaggggttggtttgttctctctatcttaaatctcaagatcagcagtttttgaaatgacctcatgctcgtggtttccaaacctgcactggacttctctggcgatttgtgaacaggagggacatgcccagtttgtgacaggaagtgatgtgactccaggctctgcaaaagattccttcaggtctggtgacctggagactgtagcgttttcgtggcctgaagggtgggtggctgtgctgggcaggcgggatttacctcaacagagcacctttgctttgtccccgtccctcagggagccatttcttcctactacgtccagcgctacggatttcctccaggatgcaaagtggtggccttcactggggacaacccaggtgagtatctcggggagtttcactctccagtgagcctgactgggtccatgctggatgtttgagaattccagtccagcctcttggtgaaaccttctgtggtcattcctcaccacccccacccatgctggatgtttgagaattccagtccagcctcttggtgaagccttctgtggtcattcctcaccactcccaccctgcgatctgactccttgtacctgccccatcttagctccgactctgccctcaggagctggtcagtctgctctctctggatgaaaactgcccaatgattatggaaggcagtcgtgcccaccccatccctaacctgtcttttctgtttcaagatgaatagctcaattcctccaacccttcctctaggacatggttttaagtctctgccctgtcatctgatctgcagcaatgacttgtttctcgtccagacacctcatctccttccctagcctcttctcttcctcctcctctcctctgggtagccctgaagccactcctggaggggcccttggatctctgaaggaaggccaggtgggctacactgaataacaacctaactactacccctcaacctcacccccaccccaggaaaagtaagtctttttctaacgatccaccagattagggttacatttaacagtaactagaaaggttaattttaaccttaatcagaaagattaatttctgtcctttcagtcttctttctgtgctcataaataagcattgtttcttttaatcaacctgggcagtatctttctcattttaacagttgtctagagctcagttgtcccagcatttatttcactggtccctgatggatggagggtggtgttgcttcagtgtttgggcagtgcagacgatgttgagattcacattcggtctcgtctctttgttgttataggataagttctcaaaggtgggattcctagatccaaggcttctgacacacacactgctgattgaacctcagtggcagtgtttgagtgcacctgttcctcactcccatttcacctttattcacatgttgattcactcagcatttagtgagtgcctattatgtgccaggccttccttcagtgctggggcccttcagcaatcaaggcagataaagattgctgttgtgagccatgtgtggtagtgtgcacctgtagtcttagctacttgggaggctgaggtgggaggattgcgtgatcccggagttctaggctgccgtgagctatgatcatgccactgcactccagcctgggtgacagagtgagaccccacctatatatctcttaaaaaaaaaaaagattgctgttgtgggctttgtgtctaaggcagggcacagagagtgaacataacctcacccccttcttttccattactgcctttgtctttctttgctgtatatccttggtgtcttgtcttggcctccttgattctctgcactctcggaagtgcctgacagtggagggatgtttggaccccttcagggaagagacttcacagctcaaatcagcggccctgctaacagagacttcaccccgtgacccctatgaccttctcctcttagggcctcctgagcgctcagctcccctgctcctgcctccaccctagggtgtgggtgggggttggaggtgggggctctgcgcctgcctggagagccctgtggtttgctttgtggttcccatgtggccgccagctaaccagaagctcccctcccattctcagcgtcgctggcaggcatgagactggaggaaggtgacattgcggtaaggcgacttcccacacccataggctctttctgtttccacactcacacccacactctgataagtagcagaggtgctgctgagacccagatcccagggtcccagggtctgggtcccagcaggatctctgctacttatcagagtgtctgccggttccaaaagacagtggagggaggggatgggggcgcacatctttctcagaaagtcattgttctttgctagatgggcaggacccctgcctgcttcacagtggccagtcttagtgcatgcagtggcagagggtcagatgtggggccaaagggctgtgagcagcgcagatgaataaggaagacataacccagacattcctacttctagtgggaaagtcatatggggaaccagccatcacccaaaccattatttagatgcagttgtgggaaatcagcacagaagatccatgagatctgcatctggggagctaactcctggctcatctggtatgggagggtcagaagtggctcttagaaagtggccttgcatctgaggtctgcagcatgagtgaagtgacagggttaaggtgggtggagtacagcgcgtcgctggcagagggcagcgtgtgtgggcaaagcccaaggtgcccacctctgcctatctctcctcaggtcagcctgggcaccagtgacaccctgtttctctggctccaagagcccatgcctgccctggaaggccacatcttctgcaacccggttgactcccagcactacatggcactcctgtggtgagcttgggtgttggttggcaccattccctgggtgaggaggtgtgggcaggtctggcaccatcttgaggaccccaagtcattccactaagctctggaatgactccctccactttcccgggctctgctgggcaactgagacccccaaggactcaccagctcttgctgacagcagagctgggtggggaataacccaagaccctgtgtccttcaagcccaggttcaaattctatcctcaccagctatatcctgtgtgaccttgggcaaactctgtagtgtggcatgtctgagccacactttcctcatgagatggggagggtaagagcatttacctcacattgttactgtgacccgtctggcatgtggtggaccctcagcaaatggcgggaaggacatcctgcctcccgacggctctcatggaagggacatgctctgtgctctgaccacaggcctttggagacctgtccaaagctcctgagggaaatggtttctgagctcctaagccctaagaaccattggagaatgtggctagttaatctagccctccctgcctcattgtgcccatggtagaatgtgcagaaacccaagctccctgtctctacctggggctcctctgtgtcagcctcctgtgtaaacagcccaagacaagggcgtttccggcacctcccagggacattcaggggcctgaatctgaggaagagcctccgatacctaagtttcaaagcctgctgtgcactgactaggggtcgtggtccagcctgacctgcagttcctctgcctgagtctcttcactgaaactcatgggtccagtcagcaagcaccagctccctccctcagagctatgccctcttctgcagctttaaaaatggctccctcatgagagagaagatccgcaacgagtctgtatcccgttcctggagcgatttctctaaggcactgcagtccacagagatgggcaacggtggaaacctgggtaggccagttggtggtgcccaggcctgtgaagggtcagcagctgccgactggaggggcagagcctggggccccatgagctgggggagaggagggccgtggagaagtccaggggagtcctgtctgtctgcacttatattccacacatcctacaagctggtgtggaaccctgtgttctgagcaagggtggggctgtaaggctgtccttggcttctgctctgagcagaacatcaggccatagctatgtcttctgtccccaccaagcccctggtgacagcatcagagagggcagcctctaccctggtgcatccccgttcacagcctctgccccaggcacaaggaaaagtccccagtgtctgggcaggcctgagcagggagggtctgtgcctcccttggtcaaacctgttttgatattttaggattggctgggcagctgcttcctattccaggctgccaagtgagagcaggaagagttgtctttgagaaaagctagctcagggctccctggttcccttctatcctgttggagagaaggaactgagaatattcacaggtctcatctgggggatgaaagagccaggggacccagggatatggggtcattttgtcctgttctaagtctgttaagaagctgatcttttgttttttgactaatgacggctgatctcttcctggttttatttcaggtttttattttgatgtaatggagatcacccctgaaattattggacgtcataggtttaacacagaaaaccacaaggtacatgtgctgttggtgttggagttacattggctccatttgtgagtgtaaaatttaacaattgcctatcaaattatgttacttttagggacttcattcattcactcatccattaatatcatacacacttgtggtgtgccagggtgcattctagatcctggggaatctgcaggacctaagacagacacggtcctttccctcagggaggaatgcagaaaacctgagagttctcttcctatttaacaaatgctaacactatcattgtgtatcacagaacttatttccttggcgagttttatcctatacccatcaagaacccatggatcttgagatcatgaatttcctcctggttgaaagagctgctgagcccaggaggtactaacgtttattgagcccatttggtgccaggcattgtgctcatggttttctataccttcctcatttacttttctttttttttttttttaattttttgagatggagtctcactctgttgcccaggcttgagtgcagcgggacgatctcggctcactgcaacccccacctcgtgggttcaaacgatcctcctgcctcagcctcctgagtagctgggattatagatgcaagccaccacacctggctaatttttgtatttttagtagataggggtttctccatgttggccaggctggtctcgaactcctaacctcaagtgatacgccccctcccaaaatgctgggattacaggtttgagccaccatgcccggctatcatttacttttcaaagcaataggcactattgttcctctttctagatggagaggttgagactcagaggctcaggctaaataatctgcccagagtcacaaggtcatagatggtggagggggctcaaacccattcctctctggctctgaagctgctgttttctttctcctccacaatgtgacctttctcgggaaggatttagttggttcttgctcctcaaaattgacattgctgctggagagtcactggagagtcatcaccacattttgggttgtacctgagagatgtttctgaccccagtaaatggggggtttatgtaagacactctgtctggaaactgtaactgtcagagttggcgttggattcagtggcagatgatggcactacatgttggattatgaatggaaagctttgtataaagtaggaagttcatctcaatcttctgatggaggatcagtttggtttcttttgttagagtgagaagctatgcctgttctctttcatgcatatcaatcctagatttgtcaaggagaaagtagtgttcttcattcattcattcaaccagcagatatgtatgattggtgccaggcaccggggacacaaaggagaacaaaacattggtggcccttgctccccagagcctgctgtctaggagggagagggacagtagacgactgaatgagcatgtacatgaatgcagcaggtgctaaggctaggttgcagaagaacagagtgccgcaaaggaaagcagctggtgggcgggttggagacttaccctgggtggggtgatcaagcctgggcgtctctgagaaggtggcctttaggttgagacctgaaagtactcaggatctcaccatggaaagagtaggatagactttcaggcagagggagcagcttgggaactagaagaaggtcagtaaggttagagtgtagctgtttatgagggggatggcggcaggttctagcattggtctcaggtgccagagaagcaggagtgagcctggggttgatgcccatcagtgctagcttgaaggacatgccacaggggtgggatctcagcgtaagctcgtggctctcacttatctagtatgtactgcattttccaggctctgttgtctaatctgatcattgcaacaaccctaaaaaacaggcgccactattacctctgttttgttaagaaaaagaatgatagcaagactaatgtaacttattgaagattgcagagctgaatggtagacagaacttgaactctcagctgcctgagactaagttctgtaatgtctcttgactctcttcaaagtgacatgcatgtgaggctgtgagcttgtgtgcttgagtagtgtgtttgtgtgagtgtgtgtgacaggcaaagatagtggttaaagagcccagctatgagtttcaaatctgggctgttgtttaaaaagatcacacacagacacacacatacacacacgaatggacaatgagagttccttactctgtgcccaccttttcctggagacaggttgcagcattccctggggatgtggaggttcgagcactaattgaaggacaattcatggccaagaggattcacgcagaaggcctgggctatcgagtcagtaagtgagccactggcagcatgtgtcccggggtgggggctcagggccagctcactcgcaggggccagggctagtggggcaatatctactaaagttttcttacagggggacttgtgcaggagggaggtggagcctgacctcagggatggggtgagaaagtgtcaattggcacttgtaggcaagcatagaatagcagacaggttgttcccgcttctcagctgtgtccacaatagcctgaccttttggccaggacctgtaagacttcggaatggtctttctgaaaccctaagctccaagctgcagatgagctgtcctgagctctggactgcaaagacataggcagtgcaaggtctggggacatgaatggatcttggccttctagcctggccaggtcccattgcctgtgggacacagtctgggtctttcagcttggacagggaagagggggatgtagtaccactgtcaaaactcggaagactgatgtcttagttcattttctgttgcctataacagaatacctgttcctgggtaatttataaggaaaagaaatttatttcttacagttatggaggctgagaagtccaaggttgaggggccatatctgaagagggcctgcttgctagtagggctctctgcagagtcctgaggaggtagagggcatcacatggtgagggagctgagtgtgctggctcaggtctcccttcctcttctcagaaagccaccagtcccgttcccacgataacccgttaatccattaacctgttactttgttaacccatgaatggattaatccactcataaagccctcatgacccaatctccttaaaggtcccatctttcaatatgtcatgttggagataaagcttcaacatgagttttggaggggacacatattcaaaccatagcaactggcatggagagggcagacccagggccgggggaggcaaaaggaggagaaagggatttctgacaacttgagctgtagaataatcagcattaggatgtcagtgagttccccttacaggtggcgttggaatggtctaagggtctgtaaggaggttggactggccgcctatagagtccaggtttctaagatgtatttgtctctctgggctatagctgttgtcattagagaagatagtgaagctgctttgcttgagggccttcctatgatactctatggacaatccaagttctatgtaatatatattttatacctttgaatcaactgagtaaaaggatactataaaaatacctattagggaaacctcttagaaaacctgttagacagcatctgctaaagctgaatatacgcctacccagcaatctcatttctaagtaaaggcacaacaggaatttttgcatgtgtttactaaagatgtacaggagaacattcattgcagtactatgctgaatagccccacagtggaagtggcccagtgcccattaatagtagacagaaaaaatgcattgtggtgcatttgtacaacaggatactacacacaaatgaaaatgaaccagcctcagtgatccacaatgaaatgggtgaatctcaccaaatgtaacactgagcaaaagaggccaaacatggacatacatatggcaggggtctctgtacatcaaattcaaaagcagatggcactacaggccaggcacagtggctcacacctgtaatctccacattttgggaggccgaggcaggtggattgcttgagtccaggagttcgagaccagactgggcaacatggtgtgttgcgggaagtcagggaccccaaacggagggactggctgaagccatggcagaagaatgtggattgtgaagatttcatggacatttattagttccccaaattaatacttttataatttcttacacctgtctttactgcaatctctaaacataaattgtaaagatttcatggacacttatcacttccccaatcaatacccttgtgatttcctatgcctgtctttactttaatctcttgatcctgtcagctgaggaggatatatcgcctcaggaccctgtaataattgcattaactgcacaaattgtacagcatgtgtgtttgagcaatgtgaagtgtgggcaccttgaaaaaagaacaggataacagcaattgttcagggaataagagagataaccttaaactctgactgctggtgagctgggcagaacagaaccatgtttctcttccttcaaaagcaaatgggaaaaatatcgctgaattctttttctcagcatggaacatccctgaaaaagagaatgtgcgcctgcgggtaggtctctgaactggcccccctgggcgtagcctgtctcttatggttgaggctgcagagatgaaataaactccagtctcccatagtgctcccaggcttattaggaagaggaaattcccacctaataaattttggtcagactggttgatcccaaaaccctgtctcctgataagatgttaccaatgacaatggtgcccgaaacttcattagcaattttaatttcacctcggtcctgtggtcctgtgatctcaccctgcctccacttgccttgtgatattctattatcctgttaagtacttgatgtctgtcacccacacctattcgcacactccctccccttttgaaaatccctaataaaaacttgctggtttttgtggcttgtggggcatcacggatcctaccaacgtgggatgtctcccccagacacccagctttaaaatttctctcttttgtactctgtccctttgtttctcaagccagccgatgcttaggaaaaatggaaaagaacctacgtgattatcggggcaggttccccgataatggtgaaaccccttctctacaaaaaatacgaaaattagccaggcgtggtggcacatgcctgtagtcccagctactcaggagactgaggtgggaggatcgcttaagcctaggaggttgaggctgcagtgagccatgagaccctgtctcaaaaaaaataaaaaaagcagatgaaactatttactattgttggaagtcgggataattagtagttacctttcagaaggggcctgtggggtgctgtcaatgttctgtttcatgttccatgggtgtgtttagtttttaaaaatttatgaacattataggcttatgatgtgtgcatttttcaggatgtgtgttctaggtcaatacaagattttaacatgtgtaaaatgaccaccatgagcattctgattgccctcatcccaccaccctaagtgtaaaaagacgtttcctaaaggtctgcaaagacttccaagttccctgaaaatgagactgggtgagcagggcagggttggtgctggagttggtggagtgcctggcaggggtcctccggctgtcagaagagaaccccagggaacggaacagcccagcatacagggagaagcagttagggcaaaaggcccccatgggctcaggaggagctgatgggattgtggcattattcccagcctctaaggcatttcttgtgcaaaacagcatagagttacttatcctcttagcaagcttaaatgcagaatcagacctgtcttgccgctctgctgagtgatcacttaaatagacatacttggaaccaacagaggttgcacgcacgtgaggactcattctccaggctgctgtgtggactggccagctctttcgttcttgcccagacatcatctcatttggctttaatagtgtctaagggcaataaagaggcactttgaataaaaatgattattgtgatactaacagctgccagcatttgttgggcactgagtgtgtgcccggcccagttccttagcaattaatctttattaacaacagtaccgctgaagtaggtactgatatgattcccacttcacaaccgaggaaaccaaatcttgcagtggttaaataacttggtcagggctggcagagctgggatctgaaccaagccagtctggctccagatgctggattctcaaccactggctgaacctgctttttttaaggaacaatcgccctcttgatgtttatagacaccatcagacatgatagaaaccagctgggcagggctaataagccatagttttcagtttatatttcagtgtgtttcatgttgtttaggttgattgtaaaaacagtcaaatcttgtaataacaagtttgaaaaataaagaaaatgggcctggtgctcacacctgtaatcccagcactttgggaggtggaggcgggaggatcacttgagcccaggagtttgagactggcaacagagagaccatatcttcacaaataataataattataaatatcccagtatagtggcatgtgcttgtggtcccagctactgggggtggggtggcaggggtggcaggaggccggggggatcgctggagcctgggaggtcaaggctgcaatgagctgtgattgcaccacttcactctagcctgggcgacagagcgagaccatgtctcaaaaaaataaaggaaaatgactcataatcccatcccctctctccaaccactggtatcatttagggacattttctcccagtctcctttatgagcttatttccatacagccatagttttgttcctttgtaccttatatgcaaagggtgtatacaagaaccaaagtttgtcagaagtcatctttgtggtgctgcgtatgatggccaggttacttttcctgcatttgggcactgagggtgttcttgttttttttgtttgtttgttttctttgttttgttttgttttgtttttctggagacagggtttcactcctgttgcccagactggagtgcagtggtgtgatcttggctcactacaacctccgcctcccgggttcaagtgatcctcctgcctcagtctcctaagtaactgggactacaggtgcacaccaccacgcccagctagttttgtatttttagtagagacggggtttcaccgtgttggccaagctggtctcgaacttctgacctcaaatgatccacctgcctcggcctcccaaagtgctgggattgcaagtgtgagccaccgtgcctggccattgttcttggttttccaacgtggaatcacactagagcatcttccatagcttgaattatttccccaggaggatggcagtccttctctcttcccagacactgtcttcacggccagcgatgaagatgggagaagctgagaggtgggggctgaatgtcttcttctggacagagccaaggggctggatggaaagcagcaggtcttaaaaacaactatttgttttaaaatacataacgaatggatgtctttttatcacaaaagattcatgcaaaacagaaatatggaataagaagcaaatgcccccttcatttgcctcccagactcctttccttctttccagactgtgacttccttcctgtgagtttctgtgttagattgaatcatacggaattgccaatattgaagaagttttgatttacaaaaatggcaatttcatatggttcgacctgacacgtgtgtgtgtgtatatatttaacagaaatgctattacattctatgtgttattctgagacttgctttccataacagtatgtacaggtctacctttttgttttctaatgactggcatgaggtctgataaattattttatagccctagttgaaggacattaagattatttcttgttttgttttgtttttgtttttgttcttgttttgagacagagtctcactctgtcacccaggctggagtgcagtggtacaatctcagctcactgcaaccttcgcctcccgggttcaagcgattcttgcacctcagccacctgagtagctgggattacaggtgcgcgccataccacctggctaatttttgtatttttgtagagacggggtttcgccatgttgcctaggctggtctcaaactcttgacctcacgtgatccactcatcttggcctccaaagtgctgggattgtaacctccactttcaccatctcattctatgccctatacccttgtccctagttcattcttgtttgtgtattttttttcccttgagcatgttagctaaaggttggtatattttattaagcaatgttaatattttgttttgtgctcccttttattaatttctaattttatctttttaaatgctttccttctactttatgaattttttctttttctgtatttttaagttgaaattttagctcatttattcctatcctgtattaacttctaatttatgcatttcagaatgctacatgttaactttatttacataacatatctttcatttctaaaaagatagtaattttcatctttttctgcatcagtgagtggtccttcaaactggcccctcgtccttttgacatatcttccatcattccttgagcatttccatagcttctagtataaaaaaagtttcaggctcatcttgttttttccttggatcagccttgtaatcttccatttatccaaggggccctgacttctctgagtgggagagatgtttggatgctctctctggatgctcattgctactgggatgatgctgttcccagcccctttcagtgggctgagctgggaatatgtaaggatatataacaacccctttcagtgggctgagctgggaaatattaggatatatatatacatatccaaatatatatatgtctgtatcaatacacacgttacctttctatttgtctgtctgtctacttctccatgtgttgaaaaacatgagttcaaccctatacactctacttccagtccaacaccatggggttcattctggctttcttccttcccatatttgtatcttatcctaacagtgacaaagttgattcttctgacccctccagattgctgcctccttgacatgcaagccccattttggcttctctgcttacccttacctgtgttgtctctgtgtcgtctctccagcagcctcttgaatctgccccactctggttatgtacttacatgtggcccttgagccacttctgtttgcctatttaatggctttttagagaaggaagaagaaaaaagaaaggtaggaaggtagacaggcaataaatatttttaaagggaagggtccatttacatttaatgtaattattgaaatgattggatttaattgaatctatccatttattttttatttttttaatccatccatttacaaaatggattacatatcaatttttctttttcttttcttttgttctatatgttcttttttctttcttattcttttcctgtcttatttttggattaactgagcaatgtctagtattccattttatctcctctgttggctttttaaggtatacactttttaattgatttttaaattgaaatccttaatttgaaaagtctggtttgcactaatattatacacttgaattttttacgaacatgcttgcactacaagaatgactaaaggatgtcttccgggctaaagggaaaatcataccagatggaaagtcagagcttcaggaaggaatgtagaacatctataaaaagtggattctcttaagttttactttgtctgaaaatgtatttattttacttcatattaaaataatgttttctgctgtggaattctaggttggcactttttactttcagcactctgaaaatgtcatttcattgttttcttgacttctaatgtttcagataagaaattaactgtcattcttaatgttattctcctgaatgtaatggggttttcttctctggctgatttaagatttttctattaatctttgattttcagcagtttgattatgatatacctaagtaagggttttttaattattattttgtatgtatcccctttgtgattcactgagcttcttggatctgtgggttaatgtcttccatcaattttggaaaattcttagccattatttcttcaaatatttatttttccctattccctctttcctttcctctggacttcagttacacatctgctgttgtcccataggactttgattttctattcttttttttttttctctctctccctgcttcagttggacaagttcattttttgttttgttttgttatgttttgtttttttgagacagagtcttgctctgttgcccaggctggagtgcagtggcatgatctcggctcactccaacctccacctgctgggctcaagcgcttctcctgcctcagcctcctgagttgctgggactacaggcaagcgccaccacatctggctaattttttgtatttttagtagagatggggtttcaccatgttaggcaggctggtcttgaactcctgacctcaggtgatccgcctgcctcagcctcccaaagtgctgggattacaggcatgagtcactgtgcccggacttcagatggacaatttctatcacacctctttttattcatgtttctgctgtagacagtctgctattaagtccatctaacaaattcattttggatattatattttttctatttctagaatttccatttcattctcttatactttcttatgtctctgctgaaatttttcatattttaaccattttgtccatctcttcctctgactttatatcatctttataattattataaagctcctatctgctaattcatctcagagtctgcttttatttactattttactgccatttcctgcttcttaaaatgctatttaattttgtttgaatgctgtacgttgtgtttaaaagtacggtgttgactaaagtggctaatttttaaaccttttacttttgagataattgtagattcacatgcagttgttaaataaatagctaatgtttacctgcagaaaaggcttgcccttctatcaggaagtgcgggtgaggtggtggtttttttttgttttttttttttttttttttttacttttatcatttaatttttatttttaaaaatgtatatagtaaaaaagctgggttgcggagatgtcggtcagtggattaaaaattttggttagggtacaggaacatattcaagagatttattgtacaacatggtgatgatagtttataacagtgtattgtattcgtcaaaattgccaagagattttaggtgttctcaccacaaaagataagtatgtgaagtaatgcataagttaattagctcaatttagtcattccacaatatatacatatttcaaaacatgttgtataggataaatatgtgcaatttttattgtcaatttaaataagtaacaaaataagtaaaaaaaagtctagaagcctatataacagcatactaacagtgtaactctggtgtaactagggttggtttttactttcttcattttgtcttttctaattttttgtatagtaacttttatcactgggcttaacaggaatctaaaaaatgtatttttagcaattgttatgttatatccacaacatgatctatatattttgtcagggaggtttattttttgactcagaactagtttgttcttgaaatatgtactttattcttttaattagggcttaaaatgttaaaatatttctaaagaggactattttgggactctacagtgtacctctttaatgagaacacccacagtttaggcctattaaggcatacttcctttattttactaaagaattaaaataataaagatttgataattttctttcttttttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacagcaaccatccgatttctcaatcttttccccacctttcccccttttctattccacaaaaccgccatcgtcatcatggcccgttctcaatgagctgttgggtacacctcccagatggggtggtggccgggcagaggggctcctcacttcccagaaggggcggccgggcagaggcaccccccacctccctcccagacggggcggctggccgggcgggggctgaccccccacctccctcccggacggggcggctggccgggtttttttttgtttaatcaggggttggatcagtactagttagttttagttcaccagtagttgcagtgtcttgggatcaggatcagcaggatcaggcccctccctccatcaagtctttgggacctaaccactgagattacagagctctttctctgttttccagctcttcccccacttccacatcactgcttccatagtagttcactggagacatttggtgggtagggaggactagctctatattggagactcttccagatttcagtcctccataccagcccaaatgtagttgtttttcttttctagcaaattttatctgcctgtagagtcttacttcttcatgtctcccatgctgcaggtatgaatcagcacttaagggctcatctcattctggaatttattttatttagacttcttgaatttacaattttttgatagcttcaagcaaaaatatgatgctctggttgttgttgtttattccattctgtcattgttacagcacaaatgtgttctttcttgaccatcatcatcttagctggaagtggaactatatgtcttttattagattaaggtttattattattttactatttatttttatttatttattctaaaatggagtttcacttgctctgtggcccaggctggagtgcaatggtgcattctcggctcactgcaacctctgcctcctgggtttaagcaattctcctacctcagcctcctgagtagctgggattacaggtgcccaccaccacacctggctaagttttgtatttttagtagagacggggtttcaccatattggccaggctggtctcgaactcctgacctcaggtggtcttcctgcctcggcctcccaaactgttgggattacaggtatgagccactgtgcccagcctattatatttttttggagacaaagtctggctttgtcaggcaggaatacacccaggctggagtacagtggtgtgatcacggctcattgcagccttgaattcctgggctcaagcaatcctcccacttcaacctcccgagtagctgggaccacaggcatgcatcaccgtttccagctaatttttgtattttttgtagggacagaatctttgttgtccaggttggtctcaaattcctgagctcaagcaatcctcctcctgccttggcctactgaagtgctaggattagtaggcataagccactatgctcagtcagtttattgtgaaaaatatcatgtatacagtagagtatatgtatcttacagcaagttataaaacatattaatcaaacatctgatgatcagcactcgggttaagaaatagaacatcagccaggcacagtcacttacacctgtaatcccagcactttgggaggccgatacaggcggatcgcttgaggtcaggagttcaagaccagcttggccaacatggtgaaaccccgtctctactgaaaacacaaaattagccaggcatggtggcggacgcttatagcctactcaggaggctgaggcgggagaatcacttgaacccaggaggcggaggttgcagtgagccaagatcaccccattgcactccagcctgggagacagagcgagacttcatctcaaaaacaacaacaacaacaacaacaaaaaaaaagaagaaatagaacactagaaccttggagtcttgctgtgctcctcttccactgtatcctcatcttcccctcatccctgcagagatcatttctatccagatttttgtattataatttccctggaattctttatggttttgccagctgtgtatgcattcctttaaatacattgtggctttttgccctttctgaacttcatgatacatggaattatactacatgcggtgtgatttgctgctttagatcaacgtcatgtttatgaattcatccatgttaatgtgcatagatagctattagctgttaattttcattgtactgtgatattccatcacatgattatacaaccatttatccatttgctatgacctgactgtgtctccccaaattcacatgttaaaaacttaatccccaatgtgacagtgttgggagatgggcctgatggaaggtgtttaggtcatgagggctcttgtgtattaatgccactataaaagtgctttcaggagtgagttcaccattttctgcttttcagccatgtgaggacatagcattctggggattctgctaaacattctacaatatacgggacgatccctcacaaaaagaattatccaacccaaaataagcagggttttattctggttggaagaggaatcaagcttttttctgtgatgagtagagctactttccatgtttgtctccatgcctgctgtgggagctcagtgtcatttcaagttcctcttcactcagtccccccatgcaccctccccagctagtagcccactttcactaatgagcacttctttactttagcttggggacaaacactgctgctgcttctgctgctgagtgtaagggagtggagggaagggtcttgagacccctgctgtcatgaagtcagttgtgtactctcagcagcagtttatgagggttcttattttcccatatccccaccaacacttaacagcaacaacctttaaatctgttgccagtctgatgggtgcaaactggtatctcagtgttagtttaatttgtgttttcttaattaacgatgattttgttttgttttgttttgagatggagtttcgctctttttgcccaggctggagtgcaatggcgcgatctcggctcactgcaacctccacctcccggttcaagtgattctcctgcctcagcctcctgaataactgggattacaggcgcacaccaccatgcccagctaattttgtatttttagtagagatgggatttcaccatgttggccaggctgatctcaaactcctgacctcaggtgatacacccgtctcggtctcccaaagtgctgggattacaggcgtgagccaccgtgcctggccaattaataatgattttgaacagctctttgtaactctggtttctttctctgaattggctatgtacattctttcccatttttctatttgatttcctatctttctcttattgatttgtaggattttattgtatactttgaatattaggtttttgacagttttttgtgttgcagatatctctcatttatctgttgcttatttatagtgtcagcaatttaacagaattttgatgaaattcatcaatttttcatcttccattttatgcttttgagatattgtttaagagatttccccccactccagtatcacagaagtactgttttatgtttctcctgttgatgttacaattttaccttccacatttaggactttgatccatctgaagtctttgcgaatgatgtaacttgggatccaatttgattttttccacatgttgatccagttttccaaacactatttactaagtggtctgttttaccccattacttgtagtgccccctttatcatttatccagtccctatatatacatgggtctttctctgtactccctttcattttttttttcctttttttggagacagggtctcactttgccgcacaggctggagtgcagcggcgcgatctcagctcactgcaacctccacctcctgggttcctcccacctcagcatcccgagtagctaggactacagacaacgtgctaccatgcctggctaatttttaaatagtttttatagaaacagggtcttgccatttttcccaggctggtctcaaagtcctgggctcaagcaatctacctgccttggcctcccaaagtgctgggattacaggcatgaaccatggcacctgacctgcactcctgtttctacttcatgggtttattggtcttgttcttggggcagaaaaactgttgtattattgtggctttgtagtatgtcagtattagttggctagggctgccataagaatgtgccacagaatgggtggcttaagcaacagaaatttattttctcacagttctggaggctaaaagtctgcgatcaaggtgtcggcagggttaatttcttcttaggcctctttccttagcttgtagatggtcaccttcttcctgtgtctccacatggtctcctcctgtgtgtccctgtgtcttcattttctcttctcataaggacatcagtcatactggattagggcccacccctaatgactttatttttaacttaattacctctttaaagaggtaatatctgtctttatcttcaaatacactcacattctgagaaactggggtttaggacttccacatataaatttagggtagacacacttcagcccataataatgttttaatatgtagtatagcaattatcccctccttgcttttctttttaaaatattgtctgagctgtttataggtcttcatttttccacaaatattttataagaaattggtctagttccttaaaagagtccagctggaatttttatttaggttgaataggatgtatacattaattggaaaagattgacatatttataatgttaattcatattcattcaagaccatggaatatcttttaatttatttagatattcttttttgtactttaacaacaatttcaactttttcttaatagagacttttgaattctttgttaaggtattcccttacatgtaagtctaccttacatttctggttgctgttgtgaaagttaatttatatattttctattgtatttgatagttgattattattagaaatgccattgattattataagttgattttgtatctggcaaacttattaaactcttgttagttttattagtttgtttattctttattttttccaaatagatggactattgtctgcaaatgacagttttcttttcctttatttcaatacttatatattttagttgtttttgttatcttatggcattgactggtagatctaatactgtgttaaacagtggactggatactgtgaatctttgttttgtttgtagttgtattagttatctattgccatgtaacaaattatctcaaaatttagcagcttaaaacagtaataaatgtttattctcttatacagtttctttgggtcaagaatttggtttcagcatggttgggtgattctgattgaggatatctcctgaggttgcagtcacaatgtcatctggggctgcagtcatctgaaggcttgactgacgctggaggatctgcctccaggctggctcactcatgtggctgttggcaagaggcctcagtctcctgccatgtagacctctccctagggctgcttgagtgtcttcaggatgtggcacttagctttccccaaagtgagtgatccaagagagcatgatctgtgtcagagcgagatggaagcctcaatgtcttttatcatctagtcttggacttcatacttcatcatttacacaaggttctattgggtatacaagtcggccctattgaatgtgaggggggactacttgaaggtgtgaatatcaggagggagggattatgtggaggccattttggaatctggctgacacaccagtctgaaagaaagtgcttctaaatctctgttaagaatgacatttgttataagttgtggatatatgacttttatcatttaaggaagttcccttctcctgttttgttgagatatttaaaacaaaaaaagtattaaagacagttaaggtgggtggggcagcaaccttacaagcaaatgaatgtgacaggcctgcacacacagagccagctttggatctctcccgtagtcctgtgtgataagtgggaggcattggcccatcatgagccctctgtagctgaagaactctgcaaaaacagccctttctgccttgggagaactggcatagctattttacttttttcttttcccttgcagtgtccaagacaaagattttggccacaggaggagcatctcacaatagagaaatcttacaggtaagcgttagtagtgggccttacaccatggcctctcccatatctgttatgtctaagagccagagactggataggaaggacagcctccattcccactcctgcaggaatggggagctcttagctcacactccaggaagcagctctgttgccttacagctcacactgtgagtgggatctgtctcacatgcaggtgaattctatggctgtgtacaatccactctctgataccagcactgtcctctggagtcacatggaaagtgcctgttcttccacatggcaaaccttctcacatctagtgccagtgttcttgtcttcctcaaggcctctgccttccaatgtaaccatcgctgattctccaaccagtcctcttataacacagttgccagactgttactgtccttctggtccttcattatgccagaaacatatgaccaaaagtagaatcaacctgcagatgtctgacactcagactgtcacctgtggggctgtcagagcctgttatggagacattgtgcatttttgggtgtagcctggggctgccttaactgttagagtaactgtattagctgtttgcttgtgactacctatcttaggtaagatttttctagaaacagagcctgaaatgggaattcttctataagcagtttgttgagagagtactcccaggaagaaggaagtgagggactcagggcagtgcagaggaagaaggataagtgaggatatggtcttgtctggagtctacttcagctccatcctggtggggaggtggggctctggaacatgaattataccacagagctgattttaccttgggacaagggggccaacaggccaccctggggaggttaaatctcctgtgagcggtggcctatgctcagccaaggtcagctttcttgaggaggtagtgctgcaagccattagtagccagtactcacagcagctggggcaggatgcacaatggtccagtgagggggatctgggtcggcatcagtggcatctactacaatatctctggtcaactaagacctcccccaagttctttccatgtgaactcctcttagtacaggtcctccatttgaaatgtatgcaatttatttgtgaacctaaatgggaaacttcaccattatgcccatgaaacatgctcttgttagcttgggtttgtttgggcttgttaatgttagtctaatacccagctgtctccagccctaggtcagtgccatttgctaaacatacttcctaaatcttctgccttgtctttggtgaaatggctaaaaagtacagggacagcctggggagctgtggctctccactacggacttcccccagctcatcctgactctattatcaccagggtagcatgaccaagcatactcctcttaaggcagtcgaggtggaatggaaggggtcagaagacatatgagggagagagcctggaaagtgcatcccacaatgtctgtgttccctctgaggaatggctcaccacagtagaacctctgtgtccttttcaggtgcttgcagatgtgtttgatgccccggtgtatgttatagacactgccaactcggcctgtgtgggttctgcataccgagcttttcatggtaggttgatggagggagacagctatctctggaagtggccaggacatggggtgggctgaggagggtggaaaggggagagtgaggtgtacccagtctttggggacattggagtcttggggacttcagcttcatttttctagctcccagcaggtgagaaccaacccatactctctgttcctttattctttgcttaaagtggagaaaaagaggctgggtcctaactgaatgaggtctggtcagagttaaggtcagcacagggacatgggaaaagaacacagggcatggttgagagcacgtgggcatgagtctggacagctagagggcaggagaggtggacaaagtccagagccgtcttttcagcaagaacagaagttgaaacaaaggggaaggcttcaggcccaagcagtccaggaccctggacagcaccatggagccctgttgccctgttggaggcctcgctaaaactctgggtattaagggaagctccccgatctaggcgagttctggcaggagcagcacctacctgcaagggcagtccttcaagttggatcaatttgctctgtctcctgcttgctcagggagctcctgtagcagcccaggtggttctattcttttcatattcttaacatttaacatacctatttcagcttatatttttcttttcttttttttttttttgagacggagtcttgctctgtcaccaggttggagtgcagtggtgcaatcttggttcaatgcaagctctgcctcccgggttcacaccattctcctgcctcagcctcccgagtaggtgggactacaggtgcctgccaccatgcccagctaattttttgtatttttagtagaggaggggtttcactgtgttagccaggatggtctcgatctcctgactttgtgatctgcccaccttggcctcccaaagtactgggattacaggcgtgagccaccgcacccggcctaagcttatgtttttctatcaacgttgagaattaatcaggcaacatatccttctctcaataattaaccttggccgggtgtggtggctcatgcctgtaattccagcattttgggaggccgaggcgggtggatcacaaggtcaggagttcgagaccagcctggacaatatggtgaaaccccatctctactaaaaatacaaaaattagctgggcatagtggcacacacctgtagtcccagctactcgggaggctgaggcaggagaatcgcttgaacccgggaggcagaggttgcagtgagccgagattgcgccattgcactccagcctgggtgacaaagtgagattccatctcaaaaaacaaaaaaaaataattaacctcttactcatttattctctccccaccccatctacctcaccctgcctcatgccatatcctatatcaagatcacttgggaatttatttccagattcttatattaagtacatttaatattatattggcttttattcacacttacctatgagtctgcctgcctgcctgcctgcctgcctgcctgcctgccttccttccttccttcctctgtttgttactttgtcttttttttttttttaacttcctgacatttcggttgggtgcagtagctcacgcctgtaatcccagcactttgggaggccaaggtaggcggattatgaggtcaggagatcgagatcatcctggcctagagggtgaaaccccgtctctactaaaatacaaaaaaaaaaagaaaatagctgggcatggtggcgcacgcctgtagtcccagctactcgggaggctgaggcaggggaatagcttgaacttgggaggcggaggttgcagtgagctgttgcagtgagccgagatcgcaccactgcactccagcctggcaacagagcaagactccatctcaaaacaaaaaacaaaaaaaaacaaacttcttcttctttctcctttatttctatgctgaggttttgttttgttttgtttaagacaaggtctctgttgtccagcctggagtgcagtggcgtagtcatggctcactgcagcctcgacctcctagactcaggtgatcttcccacccccacctcagcctcccggatagctgggactacaggcacacaccaccacacctggctaatttttgtagatatagggtttcgccatgttgcccaggctgaactcgaactcctgggctcaagtgatcccacccacttcaccctcccaaagtactaggattacaggcatgaatcctagtgctaggattaccgcacccaggctgtatggtagttttgttggaatatacaacctaaataaatattttaagagagaattcaataggtgatggttttgaggcctgacatgtccaacaaggcctttgtttcatcctcccaaatactggctgggtaaaagactctatgttcaaaatacttttcctgagaactgtgaagatactcttccataatcttctggccttcagggttgctgatgagaagtatggggtctgcttcataattcttttgtggaagtgggaaaggagtttccctttagggacttcactgccatcctgcactgtgttttgttttattctttttccctttctgtgcttgccaaagggtacctgggccactgccctgctctgccctccaaaaccaaagcccgagccaaatcttagctcaccagtccctacccagagggatactaaccacttcatttggagatatcttctccccatctgggtctggggatgactgtcttgtgtagccagtctgcgagtatgagtggagatggaaccagagtcttttgattagtttctctgctgtccaccccaccaccattccagtccctcatccattctgctctgagctgggattttctagcatttggttaggaaaactggtcctcacatcttcagagggcccttcttcactcctggtggtggtggtgtttgtatatctgacgctactacctaccttccctagaaattgctcattgtttcttgcccaccaatggcaaccttccccctgctactcatttgcttggtgagtaattattgagtgccccctgtatgccagatggtgtgctaggcaccatggttatagtggtgacccggagagacacagtatctggcctcgtggactttacagctcagcaaaagagggatcttaaaccaataatcactgaaatatatgggcacaagttgggaaaagtgctctgaggaaaagcagatggtgctgagcgctaaggagggcctcctgagcaagtgatggtcttaggtgcatcttagctgaggagaagggaacaggcatgtgaagagtggaaagaacattccatacagtgaaaaggctctgaggcagaatgagtggagagaagaccaggctgtccagaatgtggtgaacgaggggagagaggaggggcaggcagacccttccccatcatatgtcgaggttacccgacctattccatgaaaggcacaaccacaaagagaaagacaagctgggtcctgctggagacaagcctgcacttgccatttttttgttttgttttgtaattttattgaggtacaatctatatgacataaaaatcatccattttaagtgtccaattcattgatttttcataaatgtactgaattgtgcaaccatcactataatccagttttagaacagtttgccaccccagtgagatccttcgtggtgtttttggttaacgtcttcacttgcaacatgcactaatgtgaagtgacctttcccttctaggtcttgcaggtggaacagatgtgcccttttcagaggttgtgaagttagctccaaatcccagactagctgctaccccaagcccgggagcttctcaggtgagagaccatcggaatttgtttgtagcatttgcattatgaaagcccgctagggttttttcccccaccaaaaggtcacctacattgaacgtgatgtgctcaactaaaggagaaattctgctttattgaaattatcaagaaaatggagctaaagggccatgttgtcagctgcaagtcacagatactgctgattttacagccagggtcagatggattgctgggcatatttgtattgcttcttatgcctcacggtgggcccttccatgtcactgggctataaaagctactgaaaggatccatcactgaaattcaagacatgctgggtttctagcactgaaatctcaagtctagacccaagatagctgtgcagtcacccaggccaggaaatccctgtgaaggcagacctcacttgttgcaggttgggtccctcagaaagcagagtctgagatgtcaactaagatatatgaggtttatgggagtcgggggagttgctcttggaatccacaactgcagaaaggaaagggagtagacaggattggacagagggagaaggtgagcagcaatgcaatttctggagcctaagctattcctacagaaagctccgaagctgagatgacctttagagttttacccagttggtctaaggggctgggcctttataccccatgtcaatcagtcatcacatgtgggccaccccaggatggggtgaggcagctctttatagctaaagcagtctccaaagtgggctgtcagctgagggctctctgccaacagcactcccatcagttgggagaataagttcttcattcccgaggtgaatctggatggcacaccatagcatccgccacaccactgcacctatttacagaagggtctggcagcccagcagcaggggtgggtgcatcttgtaaggaactgtgaagggtctgagatttacctgacttgcaagctaacaagtgagcctgccaccattttgtagcggcaggcagaagacacgggactcctggatcagagacaaagggctttattatgatgaaccatgatgaactcatggttcatcaggaagcatgagcttcatgcttgcctcattttcccttggcccccaaattccacagggtgatgcaaagtgggcccaggtggatactggcacataatagtctgtgatacaactaaatgatcccgagcatagaaaactcccaaccttgtaaagaaactgcgagcaaacctgtctaaactttgccaccaaaggagacattatcctttttattcttgtcagcaaacagataaacattctctccagtgtctctgccctggagagagacactatctttatgtctctatactttacaaacatccttgaaaagatggtctgaaacgaaagctgtcataagacatgtagaaacactatggagaattgtctcccagcatatcttggaagcaagagctcatgctgtctagagcagacaaaccacacacataggtgtgcccaagcatctgtaatttttctgtttgtgagaggctatttttctctcatgttcgagaggccactcgatacactggaaagattcaatgtcgagataaaggacatttaagttctgattcttattctgcttctccttcaccatgagaccttaagcagcactccttgtctccagacctctgtttgtttatctgtgaagtgggcacaccatctgtcctgcctccctttaacttgctaattgtgaggcttaaaaagaatccttgaccaaaatggctttataatctaataggaaatctgggggtagaattggttcagtggttcaacatgagaactctggtcatcttccctgcaattccttaggtcagcagtggacaatgggaacataatgtgagccacatatgtcatttaaaatattcggttgcctcattttttaaagtaaaagtaaaaataaaaataaatgattaaaattaattttaatacattttatttaatccactatatctgaaatattgtcatgtcaacgtgataaatttgaagttactaatgtggggccggatgcagtggctcacacctgtaatcccagcactttgggaagccaaggtgggcagattgcttgagcccaggagttcgagaccagcctgggcagcatggcaaaaaccgtgtctctacaaaaaattaaaaaattagctgggtgggtatgtgcctgtaatcccagctactcgggaggctgaggtgggaggattacttgagcccagaaggtggaggttgcagtaagccaagatcacaccactgcactccagcctgggcgacagagaccctgtctcaaaaaaaaaaaaaaaaagttactaatatgatattttacatttccttttttgcatgaagcttttgaaatttggtgtgcatttaacacttatagttctgggcatgcttcaagtatgcaaaggtatacatggcttgcagctactgtattggatagtgcagctctggatgtgctccacatggtgacaggacagctatagctgccccaaacatcatgtcttcacagctgtattcgaaggcagggatcagaaggtgacattgggcagagagtctctcctcacacacctcttgctcatcagggagaaaaatactggcctatccctcccctatcccacacacgcccaacaggctaccacttggtcatatggtcaattctggttgtaggaaagtctagggtagggtctggctctttcattctatctagaaggaggccagcaaggaggaagataactggggaaagttttagggcagcacagcagcgtctgcctcatctagagtacggagtggccaatcctctgagctgtatgtgcctcatcactctccctggcctgcccatggccgaaatcactgacaactcatggaaccctttaccattggatccaaatgtaacctcaaaagcccacccaacagcaggttgcaagcagtgacagtctatatgattgtcagcgtatgtgacttatatgcagactgaatttgtggactagagttaaacttcttgagagcagggccacatccttcattctctctgtggcacctacagcactgcttgtgctcaaggggaaactcaaagcagtaagaatgttttctcccttagctcagctgaacgttgcagtttctccatgaggagaaatcaaagccccttagctttgttctctgactccttaatgtccaatacaggctaggacaaccttaggcccctcgcctgtgggcctctttataaagggtcacctgttatcttttgctttattttactcatggggtctattcccaagtacttcacaaacacataattcacagggtagaaccagaacatcagctgtgtcaccctcatttggaagagcaaaggaatttatctccctaagcccttctaggcagcacagacttatcgtggactcagaagccagcaggctccttctctctggctctgacaccctgtgtaactgtccctgagccttctcagacagagctgctccagctgcaccaagagtaggccccagttgcataatcagttgttaaaatacttggcttccagctgggcgtggtgactcactcctgtaatcccagcactttcggaggccgaggcggatggatcacatgaggtcaggagttagagaccagcctggccaacatggtgaaaccccatctctactaaaaaagaaaaaaacacaaaaattagctgggtgtggtggtgcacacctgtagtcccagctacttgagaggttcaggcacgagaatcacttgaaaccaggaggtggaagcttcagttaatcaagattgcaccactgcacctccagcctgggtaacagagtgagaccctgtctcaaaaaataaaaaaacaaaacttaactttggagcaaattaaaccaaattaagaaggaatggggttggcatgagctcctacttgtgtttacttgcgagtcgcaggaaaatccgggtccttggtcttgttgtttgtctgtaagacagcgtgtgcttgcctgaagtgcatctgcatttctcaggtaagatggacagccacagggaaaactgcttagggggataaaagaagagtaagaatgtggggttgtgtttctttttggtcttttttctctgttgggctttttgtttatttattttggcttataatgcagcacattgtatatataattttgtagcttctttaaaatttctacattacaaaataaatatttcattcttaaaaatgtatgtgcataccatttttaatgactgtataatattctatctgggtagaccaggcacggtggctcatacctataatcccagcactttgggaggctgaggcgggaggatcacttgaggccaggagctggagaccagcctgggcaaacatgagacctcatctctttaaaaaaaaaaaaaaaaaaaaaaagctggcagccaagatggccaaataggaacagctcgggtctacagctcccagcatgagcaacgcagaagacgggtgatttctgcattttccatctgaggtactgggttcatctcactagggagtgccagacagtgggcacaggacagtgggtgcagtgcaccgtgcgcaagccgaagcagggcgaggcattgcctcactcgagaagtgcaaggggtcagggagttccctttcctagtcaaagaaaggggtgacagatggcacctggaaaatcgggtcactctcaccctaatactgcgcttttccgacaggcttaaaaaacggcgcaccaggagattatatcccgcacctggctcagagggtcctacgcccacggagtcttgctgattgctagcacagcagtctgagatcaaactgcaaggcggcagccaggctgggggaggggcgcctgccattgcccaggcttgcttaggtaaacaaagcagccaggaggctcgaactgggtggagcccaccacagctcaaggaggcctgcctgcctctgtaggctccacctctgggggcagggcacagacaaacaaaaagacagcagtaacctctgcagtgttaaatatccctgtctgacagctttgaagagagcagtggttctcccagcacacctctggagatctgagaatgggcagactgcctcctcaagtgggtccctgacccctgacccccgagcagcctacctgggaggcaccccccagtaggggcagattgacagcccacacggccgggtactcctctgagacaaaacttccagagaaatgatcagacagcagcattcgtggttcacgaaaatctgctgttctgcagccaccactgctgatacccaggcaaacagggtctggagtggaccgctagcaaactccaacagacctgcagctgagggtcctgtctgttagaaggaaaactaacaaacagaaagacatccgcaccaaaaacccatctgtacatcaccatcatcagagaccaaaagtagataaaaccacaaagatggggaaaaaacagagcagaaaaactggaaactctaaaaagcagagcgcctctcctcctccaaaggaacgcagttcctcaccagcaacggaacaaagctggatggagaatgactttgacgagttgagagaaggcttcagatgatcaaactactctgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactatgtgaagaatgcagaagcctcaggagccgatgcgatcagctggaagaaagggtatcagtgatggaagatgaaatgaatgaaatgaagtgagaagggaagtttagagaaaaaagaataaaaagaaacaagcaaagcctccaggaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaagaagaaataaaatactttacagacaagcaaatgctgagagattttgtcaccaccaggcctgccctaaaagagctcctgaaggaagcactaaacatggaaaggaacaacctgtaccagccactgcaaaatcatgccaaattgtaaagaccatcgaggctaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagactcatcagtgtgctgtattcaggaaacccatctcatgtgcagagacacacataggctcaaaataaaaggatggaggaagatctaccaaacaaatggaaaacaaaaaaaggcaggggttgcaatcctagtctctgataaaacagactttaaaccaacaaagatcaaaagagacaaagaaggccattacataatggtaaagggatcagttcaacaagaagagctaactgtcctaaatatatatgcacccaatacaggagcacccagattcataaagcaagtcctgagtgacctacaaagagacttagactcccacacaataataatgggagactttaacaccccactgtcaacattagacagaacaacgagacagaaagttaacaaggatacccagaaattgaactcagctctgcaccaagcggacctaatagacatctacagaactctccaccccaaatcaacagaatatacatttttttcagcaccacaccacacctattccaaaattgaccacatacttggaagtaaagctctcctcagcaaacgtaaaagaacagaaattataacaaactgtctctcagaccacagtgcaatcaaactagaactcaggattaagaaactcactcaaaaccactcagctgcatggaaactgaacaacctgctcctgaatgactactgggtacataacgaaatgaaggcagaaataaagatgttctttgaaaccaacaagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagaagaactgaaggaaatacagacacaaaaaaacccttcaaaaaattaatgaattcaggagctggttttttgaaaggatcaacaaaattgatagaccactagcaagactaataaagaagaaaagagagaagaatcaaatagacgcaataaaaaatgataaaggggatatcaccaccgagcccacagaaatacaaactaccatcagagaatactgcaaacacctctacgcaaataaactagaaaatctagaagaaatggataaattcctcgacacatacaccctcccaagactaaaccaggaagaagttgaatctctgaatagaccaataacaggctctgaaattgtggcaataaccaatagcttaccaaccaaaaagagtccaggaccagatggattcacagccgaattctaccagaggtacaaggaggaactggtaccattccttctgaaactattccaatcaatagaaaaagagggaatcctccctaactcattttataaggccagcagcatcctgataccaaagccgggcagagacagaaacaaaaaagagaattttagaccaatatccttgatgagcattgatgcaaaaaccctcaataaaatactggcaaaccaaatccagcagcacatccaaaagcttatccaccatgatcaagtgggcctcatccctgagatgcaaggctggttcaatatatgcaaatcaataaatgtaatccaacatataaacagaaccaaagacaaaaaccacatgattatctcaatagatgcagaaaaggcctttgacaaaattcaacaatgcttcatgctaaaaactctcaataaattaggtattgatgggacatatctcaaaataataagagctatctatgacaaacccacagccaatatcatactgaatgggcaaaaactagaagcattccccttgaaaactggcacaagacagggatgccctctctcaccactcctattcaacgtagtgttggaagttctggccagggcaattaggcaggagaaggaaataaagggtactcagttaggaaaagaggaagtcaaattgtccctgtttgcagatgacatgattgtatatctagaaaaccccattttctcagcacaaaatctcctaaagctgataagcaacttcagcaaagtctcaggatacaaaatcaatgtacaaaaatcacaagcattcttatacaccaagaagagacagagagccaaatcatgagtgaactcccattcacaattgcttcaaagagaataaaatacttaggaatccaacttacaagggacatgaaggacctcttcaaggagaactacaaaccactgctcaatgaaataaaagaggttacaaacaaatggaagaacattccatgctcatggataggaggaatcaatatcacgaaaatggccatactgcccaaggtaatttatagattcaatgccatccccatcaagctaccaatgactttcttcacagaattggaaaatactactttaaagttcatatggaaccaaaaaagagcccgcatcgccaagtcaatcctaagccaaaagaacaaagctggaggcatcatgctacctgacttcaaactatactacaaggctacagtaatcaaaacagcatggtactggtaccaaaacagagatatagatcaatggaacagaacagagccctcagaaataatgctgcatatctacaactatctgatctttgacaaacctgagaaaaacaagaaatggggaaaggattccctatttaataaatggtgctgggaaaactggctagccatgtgtagaaagctgaaactggatcccttccttacaccttatacaaaaatcaattcaagatggattaaagacttaaatgttagacctaaaaccataaaaaccctagaggaaaacctaggcattaccattcaggacagaggcatgggcaaggacttcatgtctaaaacaccaaaagcaatggcaacagaagccaaaattgacaaatgggatctaattaaactaaagagcttctgcacagcaaacgaaactaccatcagagcgaacaggtaacctacaaaatgggagaaaatttttgcaatctactcatctgacaaagggctaatatccagaatctacaatgaactcaaacaaatttacaagaaaaaaacaaccccatcaaaaagtgggtgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcaaggatctagaactagaaataccatttgacccagccatcccattactaggtatatacccaaaggactataaatcatgctgctataaagacacatgcagacatatgtttattgcggcactattcacaatagcaaagacttggaaccaacccaaatgtctacaatgatagactagattaagaaaatgtggcacatatacaccatggaatactatgcagccataaaaaaggatgatttcatgtcctttgtagggacatggatgaaattggaaatcatcattctctgtaaactatcgcaaggacaaaaaaccaaacaccacatgttctcactcataggtgggaattgaacaatgagaacacatggacacaggaaggggaacatcacactctggggactgttgtggggtggggggagaggggagggatagcattaggagatatacctgatgctaaatgacgagttaatgagtgcagcacaccagcatggcacatgtatacatatgtaactaacctgcacattgtgcacatgtaccctaaaacttaaagtataaaaaaaaaaatctggcaaattttttgccagaactgcaatttactcgaacattttccttgccttagtacagttgcttttagtttttcaattataattaagtcttcttagataaaggatttaaaaaaaaaaaaaaccctttcctattctacatgagaatttgacctttggttaactttctagctctgttttccttgagatctcataaaagtggactatcaacggttttactaggcaacattgcttatgtaaaaatggcctttgcttgggaaactgcatctgaactgagaaaaccataactacctggtgagaagtcttcctcagggcctccttgagtgcagtgactcctcctggtcctgcctcctacctactaagttgttacaggagatacttttgtagggcatatgaggttttgaagccagggtcattcttttgtctgtatgatgtggatctcaactctttttttttttttttcttttttttgagacagagtcttgctctgtcacccaggctggagtgcagtggtgcaatcttggctcactgcaacccccggctcccaggttcaagtgattctcctacctcagcctctcgagtagttgggattacaggcacctgccaccacacccagctaatttttgtatttttagtagagacggggtttcaccaggttggtcaggctggtctcaaactcctggcctcaggtgatccacccgccttggcctcccaaagtgctgggattgcaggcatgagctaccatgcccggccagatctcaactgtttgtgcctgggctgtaacctggttgggaggcaaagagaccctctcctggacagctgtgtgaactgctgtatggactgctacatggtcttccattgagaggagcacctcctgccactgtgtttctccaggctgtcttcccttggctcatggtggtcttataagtctgaatgtttagtggtatcaaagaagacccttggtggacttggcatcctacatttaggattatttccttaggagagcttcaccaaagtagaataactgggtcccatactatgggctccttaatacagatataaagtcaagtctatttcccaaagagttgtatcaccagctttcaccagctgtgcaatgaggcagccatttctaggtactctcaccagaatttttttgaaattttgtagatttgatcataaaaattggtttcttgtcataatttacagttttaaaaaatcttaaactgtaggtttgagaactgctagcatttcctcttttgtgaattgatgctttctttcgcccagaaaaaaagttaaattgcaagtaaacgggatttaaaaattttaaattgcaaagtgcaaccagatgtaagaggcattttccccctctgttctaaactgctttttctgcccttctaggtctacgaggcccttctcccccagtatgccaaactcgagcagagaatcttgtctcagacccgggggcctccggagtgaacaggcatccctgttgcccctgcctgcccagatttactgaccccatttgtcgacatggccccagacaggagggatccacttctctgttctgaacagctcttcctgcccctactgactccttggagtgtccaggaccatcttaaagccgccctcagcacatctgcatgaagatagataggcactcctgtccctgtgcccgtgtgccccagggcaggaaagcatctctcttttcctgtcttttatcccaggaggcaggacaacactgagactgggatatgtccaataaaaactatgacttttccccttgcagaggcagaattaaagctaatctagggactcaaatcagcagaatgggggagacaaagcccggtctcaccccctaacctcatcctatctctttctccaaccctgactgcccactcctccacaaaccgtgacccatagccgcccccaccccataccttgatctaccatccatcctcttccccaatccaaaccccacagtctcttctctcccacaccctgccctccttgtttcagctgtctgaggtgcctcgcagggcctctcttacttgccccatgctcaccctttccatgctgtccccattctctcctttcaccatctctcctctccccctccttcatctctcctccctccccaaactcacttggcataattcacaacctcccacccaaacaatgggcctggtggacgtgcttcctgtgccctccctttagctatgcccacagatcactgagagggaccatctcccaagtggtgcagtttagaacttctctccctttttctccctcattccctctctcttcttgcagtccacttgctgaagaagttgtgtcatttctctggaagaatttccaaaattctggatttcttttttattttggagtatttcatcagctgaaaagtgattctcactttgagttttcttcctatatttgtatagtgagttcctttttccttcctctttatccctcctgttttactttatacctctctattccttgctcaaattattgcaaaagcctctatagaaagtcctctgtgatctgactcctgcagactcttccagatttttctgcccaaggcctttactgagctcaggactccagctaaatcaaaatacgcatgttctcacccagagtgacaaaatcctgcagataggtttaagacctagtggctcagagcagtagctactgggaagttaaaaggaaggggcttagaaaatgaatgggaccaaaggcatcacttctgatggagatgaagccatcttgaaagtgagtggtgtcctttggaggcatggtggatgaaaggcgcaaaggaagcaagaggttaaagataatggcccattagatacaacagcaagcccaagattccgaagaagacagacaactccccctagtaccacctagacattactttttaaagacattttacattattgtccagcagaaaaaggctgtcttggaccatgaaacagtaaactgtaactaaacacttcaacatgaatttgaaaataaataattgtggatataaaagaacaccagagatcagaaattcaaaaactcagaataaaaatgaaaaagctacaagcatatatgagaagagaactgactgaacttgggaaataatttgaacaaaaagataaatcttcacagatatgaatactaaattatatcttaatgaaaatagatatggtcacaagtacattaaggcacgtagaaggtaggagtaagaaaagctaagagaagcaaaacaaacaaagcaatattaaaggaagagccaaaaagacccagaaataaaatgacagataaagaagattgtcaaagaaaagatgatacaggtaagattggaactcatgaagacaaaagataagacagtggcatagagttaatatttaaaattcaaatattaaaactcaaataaaccccaaagaacttttgg

SEQ ID NO: 1803 - DNA, 88 bp, Homo sapiens
gtctcgggctgtgactctccaaagggaagaattttctcttgtctaaaagaaaagaacgcacttccctttagagtgttaccgtgtgaga

SEQ ID NO: 1804 - DNA, 88 bp, Homo sapiens
atctcaagctgtgagtctacaaagggaagccctttctgttgtctaaaagaaaagaaagtgcttctctttggtgggttacggtttgaga

SEQ ID NO: 1805 - DNA, 91 bp, Homo sapiens
atcccatgctgtgaccctctagaggaagcactttctgtttgttgtctgagaaaaaacaaagtgcttccctttagagtgttaccgtttggga

SEQ ID NO: 1806 - DNA, 68 bp, Homo sapiens
tgtgaccctctagatggaagcactgtctgttgtctaagaaaagatcgtgcatccctttagagtgttac

SEQ ID NO: 1807 - DNA, 66 bp, Homo sapiens
tgtgaccctctagagggaagcactttctgttgaaagaaaagaacatgcatcctttcagagggttac

SEQ ID NO: 1808 - DNA, 31059 bp, Homo sapiens
caagatggctgccctaatgtacacttgggaccttgcctggcgcctcttccgggcttggcagcgggcggggtccattgagtaaagccttgcgtgcctgcgcccgcgacggaggcgcgcttcaaagcgcaggcgcggggagggggtgggggaggagggaaagcggcgagtaagatggaagatgaggaggtcgctgagagctgggaagaggcggcagacagcggggtaaggaggagccgccgtcccatggcagggccgggcgagacctggcgtgaggggagcctccggggagcgggtctggagatagttctccccaaggaagggccccatacgccgggctgggggtggtggagaggcccccagttcctgagcgccgtgaaggcctcttaaaggggccgcgatccatttctctcctttcctttgcctggtgcgcctccctccgcccactaacgcgcgcgtcacccggggcgccccacccgccacccggggcctcctttcctgaccccccgcgcccacttgctggccgtgggcctctgtgactctttccgatgagccttgtggcccgaggcaccattttaaagttcttgtgctctgaccgggacggacacaccatgtgggtggtggtggggcttgcgcggaccaaggaggcatgtccggcttcgcaggaaagcgggaggaggcagccgagggcggggggaaattgaatcctctttgggctactcaactctgctaaaatcccccaccatccgtcacggtggacgagtcgggttttttttctctttcacttttactccaagaagagtttgtgggcaggcaggcaggtctcacggggactctgccaaagcaaccgaaagctctgcggggcagctcctctgccactcagcgatccgaggccccgggaaggtctaggagttcgcttgtcggagtccagggtgtgatatgtaaaacagccacattcttgggagaggagtggggagatggaccgttcgacttgtttttggagtttttgtttgcctccagaaactgtaggaaaatagtttatctcaaagaggatctgtcaattctcttagatttgtgaataatttggtcttttcagagtttgtctgtggtgacccttgtgaatatggggagatgctttttttgtctccccgtgttcgcgtctgttcaatgctggctgcactgacatccaccttaaaggtttacgtgtgcgaggagtcgagcgtaccagggtagagtaggcgctgggttttttttcctaagcgctttttgggggtgcttatgagctctggaagaggccgggaaattgaccctggcagcagtcagtgggtgtatctagctctacgggaatgttgaaacttggctttgaagttttttccgctggttcagcatttctctcaacggttgtttatgtttttccatttagcataattgagaatttgaaggattcgttcgttcagaggatatttagtagagttcttaatgtgacaaccatctttcttgagttttggcttaagaaagttaaagattttatagggagtaacaggtgtcagttggctccttgttcattcaaccagcatttttgagtgtctgctatatgctaggcagtgtgcttatcagtgactttgtgccagaaaatgcaacattttcggtacaggcgtttattgcctaccactaatctgagtgaatcatccagacatccctataaaaaagcttggcttacaactttaatatcatgcaaatgatacgtttcttgggcatcttggcctttctttggttttcctcacctgtttcaaagggtcataaatccctcatgttagagaagttggaggcaaatgaacaaaaatgaataggattcagcagaaattggggcttactttagtttttcagaatgggtaagtcaattagaaatagctagtacagtcccccatttaacagctgaataagcctagagatgtgagatttagagacttaggtctttctgacgcttgtcgcgtgttctttcttttttcttttggttcccaagttttattgaaaaacttatacaaaatattccagataaatgaaatttaatcctcatcttcctcctctttgtcctggttaatctggaagtaacataatttgtagctatctttgctgttagtaactaggagcaaccaatcacgtaaattattcttcatatatgttttggtgagatatttgaaataccttttggagaaaggcacctcggatgtcacgttgatcttgctcttactcctttcaatggtcgccatccctccaccaaggttctcagcttttccgttcactttgatcctttcttgcaaaaactgctcaaaattggcagcatccatgattccatcttctacggggtgagtgcattcaagagtgaacttcagaacctgcttcttttttttgccccccttcaccacaggctttttcacagaagccatggcagcagcggaggcagaaagccagagttctttctgctatcccttactttagtaatatcctttaaaaatgtaccgcggccaggtgctgtggctcacgcctgtaatcccagcactgtgggaggctgaggtgggtggataacctgaggttaggagttccagaccagcctggccaacatggtgaaaccccatctctactaaaaatacaaaaattagctggaccctatggtacatacctgtaatcctagctacttgggaggctgagccaggagaattgcttgaacctaggaggcggaggttgcagtgagccgagatcatgccattgcactccagcctgggcaacaagagtgaaactccatcaaaaaaaaaaacaaaaaaaaaaaactacagaggtggaacacaaaccttgccttattgacatcatgaacacttctgccaaaatgcaggttctctaatatattttatttaattgaatccttgaaacaacctgttgaggcattgtcccccttttatagacaaggaaacggaggtttcgagagtaacctgttttgcgcaagatcacacagctgggggaagctgggatttgatcccaagcatgtctgacttcaaggctgggctttttttctctagcattttgctgctacctctctacctggggacatgtggaaaatttgggaattgggtgttctttcttttccttttttttttttttgtttgagagaaggtcttactccattgcccaggctggagtgcagtggctcaatctcatctcactgcaacctctacctcccaggttcaagcgattctcgtgcctcagcctcccgagtagctgggattacaaggcgcatgctaccacgcccagctaatttttgtatttttagtagagacggggtttcaccatgttggccacgctgatctcgaactcctggcctcaagtgatcctcctgccttaggctcccaaagtgctgggattacaggcatgagccgctgcacctggcctttttttttttaattttttttttattttttgagatgagattgcccaggctgggcctcccagtagattataggcatgtgccactatgcctggcagctttcattaaaaaaaaaaatatttatttattttagatacagggtctcatttggtttcccaggctgaagtgcagtggcataatcatagcttactgcaaccttgaattcttgggctctagcagtcctcctgcctcagcctcccagagttctgggattataggcatgagccactgccctcagccagctttcatttttaatagtttgtctgggcttatatttgaacgctgtcttgaatttgattcccttttcaaatttcacaaaggttcttgtaaatatgcacttttgaaagaggggagccagggagatgttatgtccacatcactgggaaaccaatggactgcaggctatacatgtctttcatatataggcaattgcgtaaaagtcttggcttcaggttatcccctcttcctactggtaatgagctttgaataccctactccaaaacagcaaaaactgggtgaagactaataacctaaatgggaaaattgaaactacacaaaaatccagcggcagttctaatccttggaagtaaaggattttggagatccctgccctccaacaccacaagaaaatttttgtcttttttctttgagacagggtcttgctctgttgcccaggctggggtgcagtggggaacactcactgcagtctcaggcaatttctgtctcaggcaatctccacccgcctcagcctcccaaggtgctgggattacaggcatgagccatcatgcccagccaaaaattttttgacatcatgtagaatttctcccctcccctcccctccctctgctcccatccctctgctcccccctctcccttccttttttttcctttttttttttccccttttttttttttcccgagatggagtcttgctctgtcgcccaggctggagtgcagtggcgcaatctcggctcattgcaagctccgcctcccgggttcacaccattctcctgcctcagcctcccgagtagctgggactacaggcacccaccaccacgcctggctaattttttgtatttttagtagagatggggtttcactgtgttagccaggatggtctcgatctcctgacctcgtgatccgcccgcctcggcctcccaaagtgctgggattacaggcgtgagctgctgcgcctggcccctttcttaagacagaagggtcttgctctgttgccaaggttggagtgcagtggtcggaatacagctcactgcagcctcagcctcctgagtagctgggcccacaggcgtgtaccactatgtgcctggctaatttaaaaagaaaatttttttgtagagacagggtcttgccatattgcccagactggaagaatttttgtgtgtgtgagtcatctgaggtcattgtttcctgtatagcttccgaattcttagtatcaagtcctattgtgtcatttggagaaagactgactttgagaagtccctcacatattctgtgaatagactttttgcttttagttagtatggcaaacacttttttctttttctttttcttttttttttgagacagggtttcgtcctatatccccaattgtttaagacaatcaataaaatatgccaggcgtggtggctcacgcctgtaatcccaacactttgggaggctgaggcgggcagatcacctgaggtcacgagttcaagaccagcgtggccaacatggtgaaaccccgtctctattaaaaatacaaaaatgagcttggcatggtggcaggtgcctgtaatcccagctactccggaggctgaggcaggagaatctcttgaacctgggaggcagaggttgcagtgagcagagatcgcaccactgcattccagcctgggtgacagagtgagactctgtctcaaaaaaaaagagttcatagtgttggtaatgagctaacccagctaggggaaggcagcagatgatataaaaatgtaattggaccagtggttattataaagcactgacaacctctctgatttccctgtatcttgcaagtttccttttattctttttctccaggtcaaggcatgcagctagtgggaagaaaatgcatcttgaataagttaaaggatgactggtgttctggattaagaattgaaatttatgtttactttctacccccatgagccagttatccaaacattgccccatcagtgatgctggatggtgtatgagtccataggaaggtgtcattaaacattaaataactattgcataccaggcatggaggccctgtttagtgggggagtcagacaggtccggcagcaccttcaggaagaggcataagtggggtaccatggctggatcagagaaagtcttgtaaagaagacgatgcctaagttaagatttgaaagatcagttgaattaagcagtggtaagtctgggagaggcaggtagagtgtagggccaaagcaggcatggatgaggaggccgagagacaaatacacagcattgggagggctacaagtatttccttctggctgaaggggagagggttggcagggttgagtggaaagagatgagaccacagaggtatgtaggggccagattgggaaaggcttccttgtacttggttctggaagcttgaactttgtcctgaaagtgcaaggagctttgaagttttttttttttttttaagcagaagagtgatatagctagatttatttatttatgttttaaattttttgccggacacgatggctcatgcctgtaatgccagcactttgggaggctgaggcaggtggatcacctgaggtcaggagttcgagaccagcttgaccaacatggagaaaccctgtctctactaaaaatacaaaattagccaggtgtggtggtgcctgcttgtaatcccagctactcgggaggccaaggcaggagaatcgcttgaacctgggaggtggaggttgcggtgagccgagattgcaccattgcactccagcctgggcaacaagagtggaactccgtctcaaaaaaaaaaaaaaaacaaaacacgttttttttttttgagacagggtctcactctgtcacccaggctgagcgcagtggtgcaatgatgacttactgctgtctcgacctcccaggctcaagtgatcctcccacttcagcctcaacctcccgagtagctgggactacaggcatgcgccaccacacctgactatttttgatttttttgtagagacagggtctcaccatgttgcccatgttggtctcgaatgcctgaacataagtgatcctcccgtttcagcctcccggagtgctgggattgcaggcgtgagccaccacacccggcccatagttagattaaattcaggagatcagaactttgattttcttctctttctttggagaagaggccattctccccaaagtgtgactgccgcttcactctggggtccccaatgctttgtgtagctgctgtcattttggaacatgtacaacaaaacaacaaaaaaaggctatgggtagtgggaaaaaagagatcaattagtttggggctatctggtgctgatttctttatgtctgtccctgcagtaaaaagaaggcatttaagatttgtggtatcacagaaagcacagttccagatacaccatgcctaaaggggccacctctcagttggtgctagtctttctggaaaggttgagccttatggactgtgatgtcctcagaaggggctttctgtgaagcagttgggcagtttaggcatgattctgctgagcagtctgtccctgggactctggaaaaaggttggtttcactgtggcttcaaagaaaggaggataatgagcttttcactagtaacttctcagcccttttttcattggctgcatgggagggcctgttcccagcgtgctctgggtatcaagagagctgccatggttgccgtgggctagaaattccagcaatcacaggccttcttgtttttacttctatgacaggagaggatttagtgcgtctttctaaaactgttggtgcagtcctgcagagaaaagtcacagttgtctaggtctgatgactgaaaacattccaggggccagccctttccagtttccacctctccactgctgttggccccgacagctagcatcagtttctggctgtatcaggtagctagcctctacaaggtgtgttctgtcaggaaaactactgacctgttggtttcctaggagaaggttgagtttagctacttaaatctgtggccaaagtataaaataaaataaaaaaattttaatgtagtatccatagagatttctcttcttgagtgtttttgttttgttttgtttttttgagacggagtctagctctgtcgccgaggctggagtgcagtggcgcaatctcagctcgctgcaacctctgcctcccgggttcgagcgattctcctgcctcagcctcccaagtagctgggattacaggtgctcgccactacacccagccaatttttgtatttttagtagagatggggtttcactgtgttggctaggccggtctcaaactcgtgacctcgtgatccgcccgcctcggcctcccaaaatgctgggattacaagcgtgagccaccacgcctggcctttgagtgtttttcttaaaaccgtttgctcctaccaagcatccttctctttaacatctagctctgtgcaggatattaaggtaaaaccatgccccacagaaattagcaacaaaccccaatagtctgtatggagacagataatttttttttcttttttttgagaaggagtttctctctgtcacccaggctagagtgcagtggcgcaatttctgctcactgaacctctgccttccgggttcaagcaattctcatgcctcaccctcccaagtagctgggactacaggctcatgtcaccatgcccgactcatgttttgtattttagtagagacgggttcaccatgttgcccaagctggtctggaactcctgagctcaggcagtctgcccacatcggcctcccaaagtgttaggattacaggcgtgagccaccgcgcccggtccgagacagagaatcttgtccttgacggtgagacatttcaaaatgcccatcacagtaagccagcccctccccccaacaaactcgttcccttataaaaggaacacaggaaataacagtcattcctttctaaaaggaataataaatatgtacagctaaaattgcattcttcaggggccatggcgattagatgagattgtatagaaggaaagtatgacttgagtctggaaaggtcaggactgtcaccactcttcactgaccttgagaacaattcccagcccagcccttcctagcttataaaaacatttgtgaccttccatatgtcagtagtgtttctgctatctagttgttcatctcactggcgaacaagcgcgcagcctgtgggaagctcccaagttcctcgggccctttttggaagagcttctaagatatatgttgtatggctgcctacagcccagggggagtgcatttttacaatcattagcagtgaccttgtgaggtgtaggtgctattattcctggtccggggaggaaatcatgtggtcggtccagccctggctgttaggcctgagcccacactctgagggaccttttttggagcaatttgtttacatttgcttctcaccagataattaactagttaagtgctttaggatgcttagttactagctcctttgaagcatttcatttgttttcacctgggattgacctcctgcctctgtagcctgcatgagctcataaactgcatctgagaaatttgaactcagtgctgaagagccaagcgataatcctgctctcagttataatgctaagaacagtgactacaagtgagatgctggtcgaaatcttgatcataaatgagaaataactttttaacatttggccaagtggaaaaagataacataaataattattgggcagggcgcattgggtcacgcctgtaatcccagcactttggggggccgaggcaggcggatcacttgaggtcaggagttccagatcagcctggccaacatggtgaaaccttgtctctactgaaaatacaaaaattagccaggtgtggtggcaggtgcctgtaacccaagctacctgggaggctgaggcaggagaatcgcttgaacttgggaggcagaggttgcaatgagctgagattgtgtcactgcactccagcctgggcgacacagcgagactctgtctcaaaaaaaaaaaaaaaaaaacgttgctcaggatttttaaatggagggggcggtggtcttgccttgttacccagactgatctgaactcagatcgcttcaagtgatactcccacctcagcctcctcctgagtagctcagagtacaggtgcgtgagccactgcacctagccggcaggatttttaaatattgaacttgaatgcctttaccggctgttggctgctctctgctgtcctctcctctgctctcccctgcaatcctcctttacctgttgttacctcttgtgttccattctgcctgctttagccatttgggcttggaggcattgtgtttgccacccctgctgagtgctggcgattctaactgggatttgatgagggcacccttgggtgttaaagtgaaatctggtggatgagggttaatagtgtctttgtttcatcctccaaagtcagtaatgcctggtatttcctttgggagaggagccttgcagtcattataaaaggtagcaagagtggcttacacctgtaatcccagcactttgggaagtcaaggcgggtggattgcctgaggtcaagagttcaagaccagtctggccaacatggtgaaaccctgtcactactaaaaatacaaaaaaatgagcgggacgtggtcgtgtgcacctgtaatcccagctactcaggaggctgaggcaggggaattgcttgaactagggaggtggaggttgcagttagccaagatcatgacagagacagactctgtctcaaaaaaaaaaaaaaaaaaagcaagaaaggataggttctctctgccagttaacggcctacttttctccattaatggcaataggtcagaagactgggatttaaatgcctggtctgatttttggacaaatcactacctacccttctgtccacatcaatctcttaatttgtaaaactgaattaatagaatttgccttgcctggtagtgagagttaaaacacttagtaaagcgtcattcacaggtggatgtgggagccgagagtgccattgctctgagtgtgaaggcattgttcccggctctccagccactcacagtgtagcctctatctggtttgggttcaggattcctaagactggctgaagggtcactttcttgctgcccctgaggactaatatactctcctccgagaattgtattgcttagtgttgtacgaaaatcaacagggagaagcagttacagaaacacagagaaagcaggagccccattagattcgaccccattttatttccagggcaagactcttcaccattacatctgcctatcccgttactttcaggtatagggctgagtgtatccctccggcatggagaccctttgaggaggcactcaaaacaatacattgtctcaagatggcatctacaaagtttttgaggctttctagcctgggatacatctaaactgctaggcctggttgctgctgaagaattatttctgtttggcaacttcttttttttttttttttttgagatggagtcttgctctgtcgcccaggctggagtgcagtggtgtgatcagctcactgcaacctccgcctcccaggtttgagcaaattctcctgcctcagcctcccgagtagctggaattacaggcacctgccaccgtgacacctggctaatttttgtatttttattagagacagggtttcaccatgttggccggtctggtcttgaactcttgacctcaggtgatccacccacatcggcctcgcaaagtgttgggattacaggtttgagccaccgtgcttttggcaacttatttatagctttaagatcggggccttgggagtcagctgtttttgtctgttactgctataggccttaggaaacctgggcttgcactgacctggcctgaggtgtagcagcaggctgggatgttgttatctgtcagcccttatcctactttatttatttattttgagacggagtcttgcaggctggagtgcagtggtgcagtctcggctcattacaacctccaccctctgggttcaagtgattctcctgcctgagcctcccgagtagctgggattacaggcacgtgccaccacgcccggctaatttttgtatttttggtggagaggaggttttgccattttgaccaggctggtctcgagctcctgacctcaggggatccacccgcctcggcctcccaaagtgctggggttacaggtgtgagccactgtgcccgacctccttatatcctactttattagctcctgatgccacctgcctgccagtgtcctgaacatttttgcttccccttcttgagatttagggttcagttgtgttttgttttgtttttgagatggagtctcgctctgtcgcccaggctggagtgcagtggcacgatcttggctcactgcaagctccgcctctgggattcacgccattctcctgcctcagcctcccaagtagctgggactacatgtgcctgccaccacgcccggctaattttttgtttttagtagagacggggttttaccatgttagccagaatggcctcgtgatccgcccgcctcgtcctcccaaagtgctgggattacaggcgtgagccactacgccctgccttagggttcagttctgtcacttactagttgtgcatagttgtgcagtcagaggcaaatcacttaacttccgggtatgcagcaaggctgctggacgctccacaggttgtagcgaagataagaggtggtaaagggaggacgtaatacctgttttttgccaagaaatgcctaaggcagcctgagctcttattttgaatatggatagtgtcatttgtcaactggatccagatagatccagttcaaattctggctccacttcatactagctgtggaaccatggtcaaattatataacctatctgaattgattcctcttcatttgtaaaatcaagatatatctataaaatcctgttgatttggggttttttttttttttttttgagacgaagtctcgctctgttgcccaggctggagtgcagtggcgcagtcttggctcactgcaacctttgcctctcgggttcaagcaattctcctgcctcagcctcccaagtaggtgggattacaggcgccagccaccacaccccgctaattttttgtatttttagtagagacagggcttcaccatgttggccaggctggtgattgttctttaattcgtgtgttgggtactattttagacattggacaaatgcagtgaatgaagtttctgctctcataaggcttactttctactggggaaagatggacaataaacagtaagtgttttatataccactcagtaaagaaaagtaaaacagattaagggttttagaaagtgactgtggtggaattgccatcttacaaaaaatggtcagaggcaggcaaggtggtgcgcggctgtattcccatctacttgggaggctgaggcaggaggatcgcttgagggcaggagtttgagaccagcctgagcaacatagagagacgctcgtctctttatttatttttgagctggagtctcaccctgtctcccaggctggagtgcagtggcatgatctcagctcactgctgagatcctcccaggttcaagcaatcctcctgcctcagcctcccaagcagctggaattacaagcatgtgccaccatgcctggcttttatttttttttttgagatggagtttctctcttgctgcccaggctactggagtgcagtggcgtgatcgcggttcaccacagcctccacctcccgggttcaagcgattctcccacctcagcctcccgagtagctggaattacaggcatgtgccatcacgcctggctaattttgtattttccgtagagacggggtttctccatgttggtcaggctggtctcaaactcctgacctcaggtgatctgcctgcctcgggctcccaaagtgctgggattacagacgtgagccaccgtgcgtggccacctgataatttttgtatttgtagagatgggattttgccattttggccaggctggtctcgaactcctgagctcaagcaatccacttgccttggccttccaaagtgctgagattacagatgtgagccactgcacccagcccctcatcttttttttttttttaaagaaaaaaatagctgggcatagtggcatgtgcttgtaatcccagctgctcaggaggctgaggcagatcgcttgagtccaggaaatcaaggctacagtgagctatgattgcatcactgcactccagcctgggcaacagagcaagaccctggctcgttaaaaaaaaaaaaaaaaaaactagccaggtgtggtggcacatgcctataatcccagctgctcaggaggccgaggccgaaggatcacttgagtccaggagtgtgaggctgcagtgagctgtgattgtaccattgcactgtagtttgaacaacagagcaagaacttgtttcttaaaaaaataaataaaaaataatgttgggcatggtggctcacacctgtaatcccagcactttggaaggccgaggtgggtggatcacttgaagtcaggagtttgacagcctggccagcatggtgaaaccccatctctgtagaaatacaaaaaaattagccaggtgtggtggcacacgcctgtaatcccagctacttgggaggctgagacaggagaatcgcttgaacccctgaggtggaggttgcagtgagctgagatcgtgccattgcactccagcctgggcgacagcgagacttcatctcaaaaaaaaaaaaaaaaagatcagagaaggtctcttaaagataggtagagagatttaaaagaagtgcagcaacaagctgcttagaagctcgttgaaggccgagtgcggtggctcacccatgtaatctcagcactttgggaggctgaagcaggcggatcacctaaggtcaggagttcaagaccagcctgggcaacatggtgaagctctgtctctactaaaaatacaaaaattagccgggtgtggtggcaggcgcctgtaatcccagctactcagaaggttgaggcaggtttgaacccaggaggtggaggttgcagtgagctgagatcgtgccactgcactccagcctgggcgacagagcaagactccattgcaaaacaaaaccaaaaagaaagaagctggttgaagtgcgttctaggcagagggaacagcaaatgctaaggcccagaggctggagcatgattgttttgtcttgaacagtggggccaatgtggtggccatgcttgataggggagagtggtaggagatgaggtcagaggtagtggacagccagatttagtagagacccgtaggccaagatggatatcacctcaaaatagcaccaggagagggtgctgagcaggggctagcatgggtgggttttttttttcttttttgagatggagtcttgtctgtcgcccaggctggagtgcagtggcccgatctcagctcactgcagcctccgcctcccgggttcaagcgattctcctgcctcagcctcctgagtagctgggactacaggtgcacgccactgtgcccagctgatttttatgtttttagtagaaatagggtttcaccatgttggccaggctggtctggaactcctgatctcaggtgatccgcccacttcggcctcccaaaatgctgggattacaggcatgaaccactgcgcctggccacatggtttttttttttgtttttttttaatggagtctcactctgtcacccaggctggagtgcagtgacacaatctcagctcaccgcaacctccccctcccgagttcaagcgattctcctgcctcagtctcccgagcagctgggattacaggcatgcgccatcacacctggctaatttttgcacttttggtggagacagggtttcaccatgttggctatgctggtcttaaactcctgacctcaggtgatccgccagcctcggcactcccagagttctgggattacaggcgtgagccactgtgccgagtcgggacccatcttctaaggttagactctaaagcagtgttgtccaacagaaggtacaatgtgagccacatggataattttttttttttttgagacggagtctcactctctcccccctgctagagtacaatggtgcaatctcagcttactgcaacctccgcctcccgggttctagcgattctcctgcctcagcctcctgagtagctggaattacaggtgcccgccaccacgtccggctaatttttgtatttttagaagggacagggtttcaccatattgctcaggctggtctggaactcctgacctcaggtgatgcacccacctcggcctcccaaagacacatgggtaattttatattttctttttcttttctttctttctttctctccttccttccttccttccttcttgcttgcttctttccttttttttttcttttctttcgaggtggggccccactctgtcatgcacctggagtgcaatggcacaatcatagctcactgctgcctcaaactcttggacttaagcaatcctcccacttcagcagcctcccaagtagctgggactacaggtgtgtgccaccatgcccagctaattttttattttttgtagagttgaggtcttactttcttgtccaggctggtcttgaactcctggtttcaagcaattctcctctttcagcctcccaaagtgttgggattacaggcatgagccactgcctcagccttaattttatattttctagaagcaacattttaaaagtacaaagaaacagatgaaattaattttaatttttttctttttttttcttttctttctttctttttttcctttttttttttttttagacagagtcttgctctgttgcccaggctggagtgcagtggtgcaatctcagctcactgcaacctctgcctcctgggttcaagcgattctcctgcctcagcctcctgagtagctgggattacaggcatgcgccaccacgcctggctaatttttgtatttttagtagagatagggtttcaccatgttggccaggctggtctggaactcctgacctcgtgatccgcccgcctgggcctctcaaagtgctgggattacaggcgtgagccaccgcggctggccagttttaatatttttaatttaactcagtatgtccaaaatagtataattgtaacatgattattattttaaaatacgtgaattgtttaaaaatatgtgaagcatccctgtaaaatcaaacctggggtgataggacttggggtgtgtccctctctgggattagtcaggggaagtagaataattacaggagcattggaggtggccagtcctagtcataccaggccaggacactgtcactgctatgctactgatggaaacaaggcagagacgaaacagaattaaatcaacatggaggttgtttggagaagtccatggattgtacatctgaacttgaaatggccagtggccaggcacagtggctcacacataatcccagtactttgggagagtgaggtgggaggatcacttgagcccacagttcaagagcagcctggagaacatagcaagaccccgtctccaccaaaaaaaaaaaaaaaagggaaaaagaaatggctaatgatgcgggagacatttttatctgatagttttagaccagattttgctgttgtagattgcttctacctgtgaattctttgactgtattcccaagtgaaattgggaattctgattcccaaggaatcagaatcccatccatatttgtggtatgggaaacaagaccccttgcaggggagactggtccaccaggagaccctgtagcccagggacctgggcgccagtgtccctcccaaggcctgaagacataaggctagcatgggccgtggctggctgtgtgggagttcagggccggaacaggttggaaggtagtctcgcctgctatcccttatttcttctctttgcttttttctttgccctttgctttttgtgttactcagggcctgtgggaccctgattctgggagaaatctgttgtgctctccaggttcctgtctcttcttcagatctccccgggtccacttgtagacttgtgcaccctgattcaggatgagaccagaggaccctgtggggcagcgattcatagggagctcaaggccagttgttattctttgaatttgagagaaacattggaaatgtcatcttctgaaatgaaaactaacagagaaaggcaaatcatttgggaaaagttacttaaatggtaaccttgttgccaataaaagagtattttctaattcaaagtccaaagcaagggtccctcttagatctctgttcaatataagattgctctatttcttgggagtcgtgttggtgacactggagaccagaggattccggttctcagagagagggatgctgtgatggagtaggacagtacagtcttttggcttgtatactgaggcacagagtggggaggcctgctgtccttggggagtgggtagcagcagatcaggcaccagaaagggtgagacaccccctctgacccttgtagtgtaacaggtgtgagtttgttcactttgtctcttgtgagcttggctagttcgaatcagtcccccagggcatcatcaccccaggctgttgtgtaaacattcgtacctgagaaggtacaactgtaatggtgcttatacttgctgtgctttacactaagacccagaatagcctatttcttcctctcctctgcctttctcacctttcttttttccttgtcatcgacctcttaacgttacaggagtaaacctaccactgtaatctgcttcaccttacagacacatccctatcttttgtcacctttgttccttttgtagcttgtgacagtaacaaactgggttgtttgaggtgaccccttccctgctctcctccttgggaatgatcttatccgcattgtactcctaggtcccataccctaacttttcagccagaggcacatttatagcaaggttaagggcatcagcagccagtgaagctgagcttcctcctctggtgagttaaaattgcaaatgttgacatctgatcccattcaccttgtggttgtggctctcctttacctcccataaaggaccagccctgtcgagaaccaccttcctccccactgtgcttcttcatgatttcctgcctccgctctttccttctggctttgcttgttctctgagaccgagaagcttgtgtcccatttctgtagatgtgtagcctcataggacaagtgatgtcaaggtttggcaacagtagatcttttgcttaggatttggacccggaacacagaatgtcaccttctgtgggctgcttggtgctacttggctgaagagcctttccaggagcaggagccataggagatcactttcctggccaccgccctgtgtggtatgcttgtgccctagcacttgccttgtgcccactcacagcagtcacagcgatggttttctttgactagcgatggaggtcaggcctctaacacaggagcctagaccttgggcaggactctgcatccttgtctaaagagagggttcccttaggtagtacgattccttatttcaggcctgcatctagatgcttccccacacaagttctgaggcctgtttaattccattgggctattgcatctctgggggagatgcacattttccttgtaatacaccctgtaggaaagttttgacttggtccagcttttcagagcatgagtctgagagcagattgattgcaaggccttgtctgagaagagaatagactgactcatgatacctggacagactccagagggagatgcgatgccctctccagctgctggcagagcattccttctcctgcttgggcgcctctgagcatgctggcgtccagctggccatctaaagatgaccaggatccactttccaccaaagctgcttgggtttccatcccattctgtaatcttatggaagaatccctctccagctctgataaagctcttctgcctttcacagtggagttggatgagagttgtagttcttggcatgccagggagcagtgtggaattgggggagatgaccaatatctaatggtttatactggcatttccaggggatttgagcaattgtcgggggagggtggtatgtcagcataggggcctcaaaaggcgaattctagggctgtctctgtggtttactaccttgtgaccttgggtaagttccctaaccctcatctgacagaaggataaaagctactttgtctgccaaacagggctggtgtgagcagaaaatgaatgtctggggaagaatgttgacagccataatacattatatcgatataaggtattattttaaaagctattagtattatattacatgccaagtatgttaatcatgttctagtttggggacagaggcgcatttactcagacatggcctacgatgtcctcttgaagcgcttttcttccacccaggctccttgtgctggaactgggcagatggtccatcttccttaaaccctagaggaagaaggaagcagtttgctttcctcagaggagacctggatgggacttctcaaattcactctaatgtgtgaggcccatttctctctctgtcttatttggctctcgcagcgatatgaaagtgaaagttcacatagtgaagttggaaaattcagtgcattgccataaaaatactgatttggtttcttctgcgctagatctggccctgtctgccaaagcttgttggccgtcattaggcagggcaagtgctctttggtgccctgcagccccttcacttccccaggtatgctccgtgcgagtggagtttggctgcttgcctggtctatgaaggcatttggtctcaaccctcaaaggcttctaaattctacagctgtcaaggctctgtttatgatggagaaactcgaataggcagtcttgtatttagagtggagcgaaatgatacagtatgaaactttaaaacaagaagttacttgtgagaagcccttaaaaggtaataggcaatagactaatatgagctgtagtacttactcaggtaataacactggtattaatagaattaatacaattccatcaatacagtcattttcaggacagagtacgtagtggacatagattctgtgtgagtgtctgtgtttgtcagttcacagaaaacatccaggtcgttctcttattattggtgtaccttttccattcagtcattcagcattctttggcaccaactgtgttccaagctggagcgagaggtttccattttagtgcctttctggcccctccagagatttgatggtgcctcagaatacaataaattacatatatatatatattttgagacagagtcatgctctattgcccaggcaggagtgcagtggcataatctcggctcactgcaacctccgtctcccaggttcaagagattctcctgcctcagcctcctgagtagctgggataccacgcccagctaatttttgtatttttagtagagacggggtttcaccttgttgaccaggctggtcttgaactcctgacctcaagtgattcacccacctcggcctcccaaagtcaaagtgctaggattgtaggcgtgagctaccatgcccagccaaatatataaatatattttaaacacaagttagtaccaatcaggataggtgtcagtgttagactagatttaaatctagtttcatatggttaatctagttcatactgtttacaagagatgcaaataaggacatggaaaggtgagaaaaactatgttctaggaaatactgaccaaaagaaagctggccaactttattaatatgaaacaatacattataaggcaaaaaagatcacatcataatgatacactgtttaacttactagaaagaataagtctttttttttttttttttttttttttgagacagagtcttgccctgtcgcccaggctggagtgcagtggtgtgatctccactcactgcagcctccctagtagctgggattacatgtgcgcaccaccacgcctggataattgttgaatttttaaatagaaacaggttttcaccctgttgccaaactggtcacaaactcctgaccccaagtgatccgcctgcctcagcctcccaaaatgttgggattacaggcataagccactgtcactgtgcctggccaataattcttaattctttacctggtcagtagatcaaatgagtcagtaagaatttacaagattagaacaatatagctaaccagcttgaactttgaactgcacccatcaactggagaatagttatttcctttttttttttttttttttttgagacagagtctcgctctgtcgcccaggctggagtgcagtggcacgatctcagctcactgcaagctccacctcccaggttcacgccatcctcctgcctcagcctcccgagtagctgggactacaggcacccaccaccacgcccggctaattttttgtatttttttgagggggggtggggggggggcagagtcttgctctgtcgcccaggctggagtgcagtggcgccatctcggctcactgcaagcttcgcctcccgggttcacgccattctcctgcctcagccttctgagtagctgggactacaggcgtcctgcctcagccttctgagtagctgggactacaggcgcccgccacaacgcctggctaattttttttttttttgtatgtttagtagagatggggtttccactgtgttagccaggatggtctcgatctcctgacctcgtgatccgcccacctcggcctcccaaagtgctggcattgcaggcgtgagccaccgtgcctggccaattttttgtatttttattagagacggggtttcaccgcgttagccaggatggtctcaatctcctgccctcgtgatccgcccgcctcggcctcccaaagtgctgggattataggcgtgagccaccgcgctgggctgagaatagttattttcagaacatacagagcacttacgaaaatggcctacatgctgagccatggggcagatctcaccaaatttcaaagtctccacactacggctgtggttcttcacattttgcaagtgatggacttctttgaaaatcccagtctaataaattaaggttgcccagacttagcactgttgacttttggggttaaatagttctttgtgtggggctgtcctgtacactgtaggacatttagcatttccccaatagtggcaaccaaaaatggcttgacattgtccagtgtcccctgagggacagaatcttatctggttgagaaccaccattagagatcttgtctctagaaaaacacagaattttgcatacagtttcttccatctccattagagctagttgatcttgtcctcactgaggatggctgagggagtgggactttttctaagaaaggccgtagggcagccaagcagcctgggggtttggtctttgttctgtgcacggcctctccccacacccctgtcctggatatagatgctcacacgcgtgtgtggaggtgtcataggcatgctggtgctgatgggctgagggctcagactgccatgagcccaatgtcctgctcagggcttgaagagatgaggccagggcgtgttggaaggcagtcctgcctgctcctccttctcagcctctttcttctctctgcttttctctaaaatggtggtgttgttttaatcaagacctgtcaggctctggttctgagagaaatacttgctgcactctcaggtgtcttgtctcttcctcaggttccccatgttcacttgtagaccatggacctccaaagccacaaacataaggcataggttttactctaagcctttcggtaggtgccagtcacagagagttcaagtccgtaacagtaaaaaatacattattaaaatattagatatgaccataaaggaatgtaaaagggagagtttattctgaggaccaggtgatgcaccatgctggtgggatcagaggagactttataaaggagaggtagacatccaggctgggttgtgcaggatcaatgggagtttgcaaggggaggggacattgcaggcaggtggaacagcatgctgagttctgggggctagtgatagcaaaacagagacagaaggtaaaagaaggtatgggtgaggcatgctcagaagctttgactaggtctgcaagcagttgaagggtttaaagtagggaagtgacatgatcagatttatgtttaattttttttccaactctttatttcataaaatagagtaagtgttcctaagtttaggtttagaagttgatatgagtggctctgtgaaagacagattacaggtcagaaaactggttggaggctatgcaaagaacccagctgaacaatgaggtttagaactgtcatggcggccatggggctagaagggagatggacctgcagagggtatcaggtccccaaaccccaaaatctagtccacatttgttatgttgaaggacacagtcatgtccctggctagagaaaggacactgcccttagctccaaaaataaagactaagtttttatttgagagagattttttcctctttttatatacatttttttcctctaggaaatagacagacggttggaaaaaaaactgaagatcacacaaaaagagaggtaaggctgctgtctggtctgagggctcatgctctctgtggtttgagagccgggcagtcagtggtgttctccagctggccattaggattagcaggtcctagcaggtcaggctctggggcagcaaacccttccctccaaattggagaccaggacgtggtggcttgaggctttagggttgaggctggggtgttgcacctgcctctgaccttcgtgggctccctgtgtgaggtcatctgatgcaatgtgaggaagtgacaagttggaagacttgagttttaggcctggcagtgccccagttgctctgaggtctggggcaagtcatttcccagatctggacatcagtttctttctctgtggcatgaggagtgtgggcagatgatttctctgggtccccagtgacttggtggtctagggtattatgagggtatcctggaagaaaacattctaggaaattcttgaaaaaacctttaaaaatagctttgttttccacctagacgacagaggagggtgtttccagagtaggtgaaagttgacttcggctttctgcttttgggcttagggaacctgttggttttccataggtacaagggacaggaaggaggatagggcccctctggatttgctcacggggctgcacagtcattccccaggaaactctgggtgctctgcccgcccgctagttttcctggctccctgcctctttgatcagattgctggctccttgtctgtctgctcatctcagcaaccacgctaaccctgggttacagtcctcgttccataccatttgtgtcctacccgagacttgtttccatccaccctggctcagttcctccaatcccgactcctcctgacagccaaggctctggaagcaggcttgtttggttctgaagagaagctggttgactgctctgggtagggtcctggtggctgttgtcgggtggtcattcctgcctgggttcctgtctcctcctgtggcttttgtttctttcccttcctgtgttgttgtccctctttgttttttgtcattccacctctccctgtggacacatcgccttgatgtacgcgtccaccagccttggacaatgcttttcttttgagcattgccaagcactgtttctaggagcatccttcactccagccccgccgctgtccaaaagaccagggagccctggcaagggaggtttctctgttcagaagctttttgaagaggattcagttgtctggtgtagcttgtctctgggaggcacaggtcactctcactagaaggtggcttggtaaatcttgatgccaggcagggatggcgtagtgggctcctttgtagtgtttgtctggtttgagcatgtgatggaagatttggctgagtgaacactgctgacccccaagttcaaaggctcccaccccaccagccagtcctactctgatctgcgtagagaagctgggatcttaactgacgtcattcaattctggacataaactgttttgctgcagggccaaatagtggttgatgtggctgtggtgaacatggggatagaagtgccagaatgaggtggcgttccagcccctgtggccaggggttagggctgaggagcagttcctgtggcctgtcagagctggtcgcaagcttacttttttgggacacccttcttgaggagtggaaattttgctgtctggtcagaggccagagaatcatgcatgggtagaattagggagggagaggaaagtgatgagaggtgggtgtgggacatggacagggcctccttagtcaggagcatgatttgtgaagctgtgtttgctctttgtcagcaggaaatccaaatctcctcccaaagtgcccattgtgattcaggacgatagccttcccgcggggccccctccacagatccgcatcctcaagaggcccaccagcaacggtgtggtcagcagccccaactccaccagcaggcccacccttccagtcaagtccctagcacagcgagaggccgagtacgccgaggcccggaagcggatcctgggcagcgccagccccgaggaggagcaggagaaacccatcctcgacaggtgagtgtggctggcagggccggccagtgatggctgtcccagtccacccgggaagaggagagcatcctggctgcgtgtagagtagtgagaagcaagcagagtcagggtaggaaccatgcagctccacttgctgatcccagcctgctggcactagttcactgtgccgcattggctggagagggctctgaaagccttgccagggaggaggtggcagtttgctggcatgctccctctgcggttggtagtcaccgggggcactgttgtgtagagagtgaaggcacagatgagcttgtgtcaaaatctgcctcttacctcttctttagaacgacttgacctctctgggccttagttttctcatctgaaaaaatgggataataatagtaccaaccttatcaaggtgttgtgcaattcagtgagtaaatgagcataggatgtggagagcctgggctggcagagtggaaagtaccccagataagtgctttgatgatattttctgggtctccagtatgcccactgtgatgtttttgtgaattttctaaattcctttttactcttaacatttttttctctgcagtattaaaggttgcatcatataagtttatcactttcgaatcaaacagtattcattaagatggcctccttctaactttgaggggctgctatggtttggtattctgggacttgaagaaaaaatctgcgtaccttctttctagctcttcataattttgaagagatacctgttctttttgttgtttctcctctaagtcttcacctttccagggtggaaaaatagtcatatgagtcaaccgttaaccgcagagtttggagaggagtgggagggaagaattggggggcgggggatgtgtccctctgctgagctcttgattccagttctttactttggcctaacactctggagattccaaatggttctgcggagcatgtgctatccatggtcactgcctctgggcagagtgggccctcaagcactccccctgcctacaagtgcatgatggcagctgagcagggggaaaggatgctgtagctgctagaggtgaatgtgcaccaccgaccctgcctgctcacaggggcctctcaacttggaggtgccctgagtcagcttcccaaagaagcaggcttgcggagccagagtgacgtgggcccagctatatggacagttgattttaagatgggggacatctaggccaggtgcagtaatcccagtactttgagaggccgaggtggacggatcacttgaggtcaggagttcaagaccagcctggccgacatggtgaaaccccatctctactaaaattacaaaaattagctgggtgtggtagcatatgcctgtagtcccagctactcggtaggctgaggtaggaggatcacttgaactcaggaggtgggggttgcagtgagcggagatcgtgccactgcactccaatctaggtgacagaatgagactccgtctcaaaaataaataaaaaataaagaaatgatgggggacatctattatatccttcttcaggccttcctctgcttttcttcctttcaggccaaccaggatctcccaacccgaagacagcaggcagcccaataatgtgatcagacagcctttgggtcctgatgggtctcaaggcttcaaacagcgcagataaatgcaggcaagaaaagatgccgccgttgctgccgtcaccgcctcctgggtcgtccgccacgggttgcactgccgtggcagacagctggacttgagcagagggaacgacctgacttacttgcactgtgatcccccttgctccgcccactgtgaccttgaaccccatgcactgtgacctccccccttctcccccttcccactgtgattggcacatcgacaagggctgtcccaagtcaatggaaagggaaagggtgggggttaggggaaggttggggggacccagcaaggactcagagagtcagacagtgccacttggccacttggggtaaagccagtgccagcaataacagtttatcatgctcattaatttgggatttcaaaacacaaatgaaaactcacacccacccacccccaagtgcatgtctccatcacttaaaaagtaagttccatttgaaaatatcctttcttttttttttcttcctatttttgtttgtttatacaaatatctgatttgcaagaaaaagtgcatgggaggggttttagtggtttaatgaatttttaattaagaaagggtagtttggtagtctacttaaaaatgtttctgggaaattcactagaaacattaaccaataggattttggtgagcttagcttctgtattcctactgccgcccagaaaaggggcagggctctgcagccgccaggacagacgagcaccccatgcctatacctccctccccgagctaagtcccagggcatctgggccttgcctggagactgggctagctctgtaggctcggagagcctggggagggtgccaaccccacctctagtattttgggagatagggaaagtgaaccgacttccccttcccatacccctcagggtggttccctaccagccaggcttactacttctagaagaaagcagagtgccagggagtgagattgcatccctgggcttagaagtgacggagagaagacttgtttagtattttgccatcagcacaaggaaaaccaggagagagtctgcctccaggactctgagccttctgcctcgtatgttcagaaggtggataggtcttcccactccagcatggcttgaactcttaggggtctgcagtgctccatctccattggtggccccagctcagtaactatacctggtacatttcctgtgtgcaatcagtaccttgaaggcagaacattctgaataaagttggaaaaagaacagctttgctttgcaaagattgatgacagactggttcctcagaggcctaggctacccgtcacccctttttccagagcgagggcctggaatgaaggcagtttatcctctgtccctggagcctggggtttgctttggctccttgaggtggaagagactaagagggcagctgcccagagcagctgtgtgtacctggctcctctcaggcttcctgatcccttccgttgcactgcgccttatccctcagccagccagacagcctccctgctcctgaccagcagatacgtttcggagtggttggtgtggtttttgtgatgagggcagcacgtggtggccaaggtggcaagctgagtctcacaggctcactccctcgttggttccctgtgggaatggtaggccaggcccagtaagccatgccccaacacgtcctctcctccggaggaagggccagctgccagctgagtcagcagctagtccatagcacagccttataactgtaaagccaggcattgcccatgagcagagctggaaccagagcttcagtcagtaagagggaggattaccttcaggagaaggcaaggaagaaaactggctgctatctttatagttccactgccctaaccaagtgtccacattctaaatgtgtagtgtccatcccttatgtaatagtggtttcccgcccaaagtgagactttccttttaattggagaagggtatagaggtagtccaggtgggaacgccagaagtgctgattgcccagccattgggaccacctgttcttgccccactaccctctagtgggaggccaaagtaaaggctggctggtgggtgtctgtggattgaggatgtggcagggactggtcctcccacctccctctggccaaagatgggctttgcccgctgtgtgcctgtcaccacccaccagcagtcatgccctgggcttcccaaatggagaggtagcaggcaacgtttttaaaaagaaagaaaacaggaaactgtattgtgtcgggggaggcgggagggagatgaggaaacggtttggattttgtgtgtgggagggtattttttgggggtagttgtctgtaactttcctaagtgctttttttccttttcttttttaaagtaagttgcaggctttggcttggaaaaccccagggggatggggggcagaaacctgaggctgctgcccctttatctgccttcacggtactgtccccttcccccagctcctccctgaccccatgggccaggcctcagaccttccagctaaccgcttcccatgagccactactctgatgtcagcctataaccaaaggagctggggggtccaggcctggtgaccaacctttctcagcccactcaatcagggtgctccccacctgcaggcaggaggcaacaccctatctgctaccatcagccccttccagagcccatctgccccgcccagccctgccctgcccagccataccctgctctgccccatctgggggtgccctgctcagggatgggctggcagggctgtacccagcctccctggtaagcagagactcaagaaacctctggggtcctgttttctggtcgtgtgatcccaggggtgcacatgggccccttgggtgtctgaacagaagggcatgggagggagggctgcacccctgcagtcttactctgctggtgtagcgggcagctgcccactcccaccccaccctgcaccgcgggctcctgagtcggcagattaagcattttataaattgtattttaaatacatgttttaaacttgtca

SEQ ID NO: 1809 - DNA, 31059 bp, Homo sapiens; identical to SEQ ID NO: 1808

SEQ ID NO: 1810 - DNA, 6230 bp, Homo sapiens
gacttccggcgttgggactgtcacttggctgctcgcgtcaggccacaccggtggtctgggctgtggcgcgcgggtcggggcccgaggcgggcggccaggaaggtacggaccacgagcagccggccgcgcccccaagcctcggtatcttcgagtatgacgtggtcggcccgggggcggtcgggccccggcgggaaccacgcgttctcccgccccgcggaagcccaggaggcagcgcattgggcattctgcgcccatgactgccgggcaggctgaggcgcggggcagccgcgggaggctgctggcggggatggcggtcccgggtggtccatgcctttcttccctcccagttgcgggttccgctggcggcggtggcgctgacaagcccgcgccgggggggcgggggagtccctgctcacacagactgcgcccccacggagtgaggccgcttcctagacctcgcctagtcgtctttcctctccctgccctgggggggttgcgggggtcagtgcaaactcctgcgtccagggcactggtgagctcccgacttccggcagccagggggctgaggtcccgaaggaggctccgaggggagagtcctgcgtgtgcaaaacctgggaggggagccgaagcccagatgcttctgggactgagcgctctcgatgtggagctggagtagaggggatgtgtgcggctgcagtagcaggcgagggagtgggctttatctcgagggcgtcgggagacatagaagttttgaacagaatcaggacatcctctgagttgggactttaaaacggttccaccgtttgttgcgtggagaacagacatgcaggggtgtcggcatgaagggaagaaccgactgccacagtctgggcagcagtggaggtgggcgaccaggtgaattctggtggatctgcggatgcatcaggtgtgggctgtttgaagaactaagtaccccatgttgttcagcctgagcgcctggaagaagagagctgctgtagatagaaaggagaattgaaaggaaagcaggtttccttcaggggaaagatcaagagtctgggatgtcccaggttggtcatgtcactggacctgacgttgttggtgtcctgggctgaggacagggcctataaactggactgaagaaggcgatgagcagtcaggcgtgcggagttacagcttgagggtaaagaaaaccggctggggtgcctgaggctatcaggggaggagttcggcaggtggctgaataggagagggtggcagcaatgtgggaaagaaattgcgggagcgctgagatcgagaccatcctggctcacacagtgaaacccggtctctactaaaaatccaaaaaaattagccaggtgtggtggcgggaggctgaggcaggagaatggcgtgaacccgggagccggagcttgcagtgagccgagattgccccactgcactccagcctgggtgacggagtgagactccgtctccaaaataaaaataaataaataaataaataaataaataaataaataaataaataaattgaggagggggcgccatgtggagggaggaagggattgagttcccctgtgttcacaggttcttggggctgcacccctatgacgactggtggggatcatccagtccctcaggctggatgagcagcctggaaatgtcaggcaagcgcagcaggggaaggtctcagtgatgggcatgcctggggggtccacagctgggacttacacccttgcttattacaaaagcaagaagggcacatctggggagggtcatgaatggtcatgctgagtcacgagtggatatttggggctgcccttggtgtggcagctaagggcccagccagggcttgctctagcctgcttgtgtaggggtggccagtggggaagtcaagaagccatctggggcctggaccaggagggcagaggggaggggtcccagacaggtgagggaagtgccacctgaagataatctcggggtggaacccaaggaaggagggacactgggggaggtgactgttgggatggggagcttggtcctggctcacagccataccttagaccatgcctacctccacctccctgctgttttaggacctgatgaccttcgaggatgtggccgtgtacttctcccaggaggagtgggggctcctggacacagcgcagagggccctgtaccgccacgtgatgctggaaaacttcacacttgtgacctcacttggtaaggccctgggtgctccatgaaaagtgcacttggtgacaatcaggactgcctcttcacttccctcctggttgatgagcaggatcaaatctggccagggccacgtggaacaagggtctggtcctgtagacacaaagtttggttgggtcagccactccttgccgccctgtccagctgtggcctctctcatgcctgggctcagtcccgttgctttggtgctctgggcacagttgctgctctggggacacatgagctattcctatgagccccttgccctgtgctatctttagattctcccagttgcacagattactgtctatttccatgaagccctgactcctgctctctgttgggaggtgggttgtcttgacctggggctgggctctcacctgctcctcctcacaggactctctacctcccgacctcgtgtggtcattcaacttgagcgtggcgaggagccctgggttcccagtggaaaggacatgaccctggccaggaacacctacgggaggctcaactctggtgagtgggagctcaggtggggtgaactaaggaccaacctgtggccaagcccatgtccctgcttttctgactctggaaacacatcctcctctcctgcctcctacctgactcccttctcttccatcatcagcctctcctggaggctgctgccttagtaggtgcccttgaagggagagctccaagggcacaggagctgggttcacacagaagggcctaccttcagctgggctgtgtggccttgaaccctccacaactagcagccattattgataggtatttatttcgcccatcatttatctttgtattcatcaaatgtttcctgagggcttgtgggcattgtagacacagccttgaccaggacactcatggtcctgcctttgtggggctgatggtgctaggggagacgcagtgagtacgtaggattcaggagtgcagtcttgagcattggttggaggtcattgcaagagcaggtttgggagtgggtgcccaagacggggcaccaggggagaagggagtgagctatggaaagggagggggtggaacagccagtgtggagacgtgggtggcacgcagcagctgctgttttcctcagcttcacatcctgggtgtctgggggctgccgccttgatcatgggagtccccactgcagtcagtgccacacctgtcagggcagatgcttcctccaaaccccagcccctcctgcagagccagcctcacctcttctttttccctaagcttttgtcccggctcctgggctcccccttgcctgtccactcagcctgccctggtcctctcctaaccaggatgccccaggcaaccaccgtttctctgcgtttaggttcctggagtttgacagaggatagagatgtttctggagaatggccacgagctttcccagataccccacctgggatgactactagcgtcttcccagttgccgatgcctgccacagtgtaaaaagcctgcagcgacaaccgggtgcctccccatctcaggagagaaaacccacgggggtgtcggtgatctactgggagaggctcctgctaggctcgcgcagtgaccaggccagcatcagcctgcgactgacctccccactcaggccccccaagagcagccggcccagggaaaagaccttcacagagtaccgggtgcctgggaggcagcccaggacgcctgagcggcagaagccatgtgcacaggaggtccctgggagagccttcgggaatgcctcggacctgaaggccgccagtggtggcagggatcgcagaatgggcgcagcttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcacccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtatgcgcgctctgcggtgctgccttcagccagggctcctcgctctttttgcaccagcgcgtgcacacaggcgagaagcccttcgcctgcgcccagtgcggccgctcctttagccgcagctccaacctcacccagcaccagctcctgcacacgggcgagcggcccttccgctgcgtggactgtggcaagggtttcgccaagggcgccgtgctgctcagccaccggcgcattcacacgggcgagaagcccttcgtgtgcacgcagtgtggccgcgccttccgtgagcgccctgccctcttgcaccaccagaggatccacaccacagagaagaccaatgccgcagcaccagactgcaccccggggccaggtttccttcagggacatcatcggaaggtgcgccggggagggaagccaagcccagtcctgaagccagcgaaggtctgaggtcacaggtcgcagcccaaccctttcttggccttctgtgaatcccttccacagctaaagggtccgagtgctcttcagatccacgatggggaaaagctctgtgcctgagagtcagggacgagggagaccctttggctgtggttccatttgcaggtggggacaggatttgccagtttagtcatagctcacacctccatcctcaaagaggtaacactgcagaaacatcagagggaggacatgtcagctggaactctggtggggctgaggctgtagttggggccataggacgccgacaaaggcagcgctgcatggtggtgctacttcatgtgttatgagagtggatgctgaggtgagggggatgcggacatggggtaggatgacctagagaaacttatgatgtctgcacacaaactggccgctagacggacgctgaggacattttccccctgaggcctctattcaaggcttcctgggggccatctcagcaaacaggagactacaggggactggggatcagggtgtggcctgtgagtgtcagcctcctcctcggaaaaagaaaagctttgggtcaactcagcatcatgtttgcagatgctgacagacgggatcctaatgagagtcaatgtgtgctcactgccagctcctgggctgtgctctggtcagccaggtgtgagggcctggcctggggtcacacagctgactcaggagaggaatgcccatggttctcagcattggaaggacaaacctaggatgatggctttccagtggcactcgttcaggttttcgtccaagtctcagcttggccaaggcctgtcgctcactcatttacaaaagtcgatgtgaggaggagcctttacacctgtggagacagtgatagctttggagcagataaggtggagctgctcatttttgctggatttggtggccgatccccgcccccacccccaccccctccatctcacctttcccttgttatgcctcctcaattggaggctggacagagagctgaataggaaggacttgccattacctaaggccatgtgtgacagcctcctgaggacctccccaacccagtgtgatgggcctgcatggcagagacaaaagggtagactgggggtcatttgcttcctgtggccttaagcctactaggccccatccttacctgagacctcacctccaagaaattaatggtcttttcaatggagaaaaaaaaagactagtatttgcaacttcaaatagatgtagtttccttt

SEQ ID NO: 1811 - DNA, 67082 bp, Homo sapiens
tcggctttgtttaaacctgcaatttaaaaaactgagcaagatccagcccaaaatggcaaaaaggttttatgaatacacactttttgctaacagtcaactagaaaccaaatagaatagcaacgttactatcagagcagatcatgggtatattattgaaagcaagtgtaatgatgccagccttcagattccctaggatattttaaaactctcaagcacttctattacatagtttagggtcactggagaaaattacttttatgcagacaaaggaacacacgtctggaaaaggaactaaagaaaaatgtggcagttcttatctattttattccctgaagaaatgtgctgaccattaactttataacttgaatattataaatggaaaaaaaaaggaagaaatagaaatccatccagttctggaatcatggatggagttctggaagatggtttggtcttgtaatcttttttactggtcctctcttggcactcactgtcttctgcttagctggattatatcttccactgaaataaataagtgttaatcataatttttcagtcaccattatgtacaacaaaaacattataggccacacaggaagaaatgtatattgcaccttgttccccccaacagaccttcacacggaaaccttcctgtgaatagtttctgcttacagtgcaaatcttaggcagccttctgttatagcacatcatctccaccgctacagaggcatacagcttaagggcaggtaattcaaaggctggaagcagcatgtcaggtgccctaatgtggaaagttctgtctaatgaggataagacagatccgtgaattccttttcttagatttccatgagatcctttttccattaatgacttatgtggcactaaaaagccaaccttccttacactctgacttgagagagttaaaggccacttcaatttcctaaaaactttcttagggggtgatggcagcaaaatgacagagtcatttaaagtctttctctattaagtctaacatctggacttcctcagggaaagtgtttatttgttgctttttttcttgtataagagccatgttttcttgtctcttctcatatattgtaattttgttttgaaaactggatgttttaaaatatgtaacatgtaagaacttgtcattttctcctcattaaaatgaaggataaaattctctcctccataaaagtgatgacaaattggcaatatggttagaagcaactttatcaaaaccctggaaattaacgaaagtgttgcaacaatcctggagaatttataaaataacaacaacagcaacaaacggctgaaacttcgaacactgagctttgtagcattttaacttgccctatgcctatccactgttcccctgactttcatccccagctccatggtagccttgaaaaccaacagcgcacaattgcagtgaaaactcagtagcctggtggacaccataagaggtggaatagggttggagatcctttaacacctatttcattccaagaggaatttcattatttaaacagtctggtgattacttgaaagaccacttacaaagctatctttatttgacctgacatggagatggtccagtgtaaatagccttttccctaggggcatttgctggaacaataagaaaccactgtttaatttcagagctgccagaggtagtagataacaattgaggcaaaaaataggctaaccaggaagcttaaaaggaaaagctgagaggccaggctcagtggctctcacctgtaatcccagcactttgggaggctaagggaggcaggtggatcacttgaggccaggagtttgagaccagcctggccagtatgatgaaaccccacttgtactaagaatacaaaaaaagatgagccgagattgcgccactgcagtccgcagtccggcctgggcgacagagcgagactccgtctcaaaaaaaaaaaagaatacaaaaaaagaaaaaaaaattagccaggcatggtgctgcatgcctataatctcagctagttgggaggctgagacatgagaatcacttgagcctgaggcagaggttgcagtgagccgagatcagcctaggcaacagagtgagactctgtctctaaaaaaaaggaaaagctgagaaatgagtgttaataagctccattatatttcttggaatctagaagcccatacacatgtgtaactgtgggtatgcataggactgtgtgcatactcaggaaaggcctgaaaaggccctaagctcttgcctctggctgaccttgaggctctgcacaagcaggaagtaaagaataaggtagagttgtaatttgcctggccgactgttgaaggcatgctccaacacacacacacagagcccatcagcaaaggctaggagatttattgatgctaggcatttaaataaatctgttcaatcattagctgacccctaagctaactcagcagagacttcagtgtccaccccaacaaagaatacagattttacataattattttagaaaagtcactaaacaagcagcagcaaaaacagtgacaacaacaaaccctggggaggggaaagaaactaatatacagagtggccatgttacatattttaaaacatccagttttcaaaacaaaattacaatatatgagaagagacaagaaaacatggctcttatacaagaaaaaaagcaacaaataaacactttccctgaggaagtccagatgttagacttaatagagaaagactttaaatctactattttaaagaactaaaggaaatcatatctatagaggaaattatgagaatgatgtctcaccaaatcaagaatactaataagagatagaaattatttaaaaagaaccaaataggcattctggagttgaaaaagaatataaatgcaatgaagaattcactagaagagctcaacggcagattggagcagacacaagagtcaatgaagttaaagatttgtcaattaagatcgtctggtttgagcaagagataacaaagaataaagtgaaggaaattaaaatattttcccccaaaatatatttctttgacatattttaaaatgtcagtctcttggccagcaggcagaaatggccttacaaagctgtcttaagtgggaaagtttgcattaatgtggagaatctccactaatgcaactgtgccacctctcctttctatgcttttccccagatctaggagagactgaaagtctgacacatttaaaagtctgagaagaaacatttaccatctattctctctgagggtggcttcatctacataaaaagtccacctttgttcgccaaaccttttctccctgctcccaaaaccttttttaaaatcagaatctaagcccccactctttctgtaacctcaaaatggtatataagtttctataactcattgggaagttgggtcttcattctgaagactcccatgtatacatattaaataaatctgtgtgccttttctcctattaataaatatgattcatgtctgtgatttttagcaaacttcaggggcgaagagcctatggcggcccccactaaagaaaactgaacagtctcagagacctgtaaaacactatcaactataccaacatatgtataatgagtgtcccagaaggagaggggaaagaaaaggacagatagaatatttgaaaaataatagctaaaaatttcccaaatttcattaaaaatattgatctacaaatttaagaagcctaacaaattccaagatgaatatccagacacatcataataaaactatcaaaagccaatacaaacagggaatcttgaaagcagctagaatgaagcaactcactctgtaaaagggatcttcaataggagtaacaactgatttctcatcagaaactatgaaggcctgaagacagggagatgaaatatttaaagtgctataaggaaaaagactttcaactaagaattctatatgcaacaaaactatccttctaaaataaaagaaaaattaaacatttccagataagcaaaaacagaaggaattaatcatcagcaaacctgccctataaaaaaatagtagagacttttgtgttgaaataaaaggacatttgatagaagtgtaaattcacatgaagaaataaagaaaactggcaaagataactacataggtaaacataaaaataggataaatgtagtttttgtttgtaattcttctttttaaatctcctaactgattaagaaaataactgcatgagcaataattgtaaatctgttgatggaaacaaaatgtataaacttgtaatttgtatgacaataacagcacaaagaaggtgaagggaatggagctacataggaaagaacttttggtacactattgaaattaagttgttttgaacctaaagtagattgttataaattaatatcttaattgtaattcccaggcaaccactgagaccaagaccagatggcttcgctggtaaattctaccacatattaaatcatacatatataaaaccaatccttcacacgcacttcataaaaatgaaataggagagaacaccttccaacttattttatgaggcaaatattactcttattttcttctttctgcttatttggggtttagtttgctcctctttttcaagtttcttaaggtaaaagatttgattttttatttgaaatgatttatttaaaaatatatttacggccataaatttctctctaagcactaaacctgataaagaaaatctatgaacaaaatttacagctaacattatatttaatgtaaaaaccaaaagctttctctctaagataaggaacaagttaaggatgttcactattaccacttctattcaacattgtataggaggttccagccagggcaattaggcaagaaaaatagataaaaggcatccaaattagaagaaaaaaaaaagaagtaaaacaatctctatttaggtgacatgttcttatatatagaaaatactaaggcatacacattcacatacagacacagacacatacatgcatttatgagatctaataagttcctcagggtttctggatttaagatcaatatgcaaaaatcaactgtatttctagacaccagcaatatacagtcctaaaatgaaatttaaaacttaattctgtttcaaactgcatcaaaaagaatacagttttaggaataaatttagccaaagaattgcaagatttgtacactaaaatctataaaatatctatgaaagaaattaaagaagatctaaatgaatagaaagaaattcatgttcttggattagaagacttaatattgttaagatggcaacactacccaaagtgatctacagattcaacatactctctccatcaaaacaccagctatattttgtgaagaaattgacaagtggatcctaaatccacatggaaataaaagggactctgaataaccaaaacaatcttgaaaaagaacaataaaattggagtactcgcacttcttgattttaaactcactaaaaagttagtcatccagacagtatggtattggcataaggatagagttatagatcaatgaaacacaactgggagtctaagagtaaacccatatgttacggtcaattgtttttttacaagagtgccaagagcatttaattggcaaaggatagtgtcttcaacctatggtgttaggacaactgaataaatacaggcaaaagagtgaaactggacgcctacctcacatcatatacaaaaatgaactcaaaatgggtgaaaagggagctaaaactataaaactcttagaagaaaacataggttaggcaatgacttcttatgtatgacacctaacacacaagcaagcaagaaaaagtagatgatggtctttatcaaaattgagaacttttgtgtttctaaagatatcatcaagaaaataaaaataccatccatagaatgggaaaaaattataaatcttttatctgataaggtctcatactcagaatataaaatgctctcaatgcaatataatagagacaaacaaaccaatttaataataggcaaaggacttgaatagacatttctccaaagaagatacagttgtccctctacatccaagggtgattggttccaggacccccatggataccaaaattcacagatgctcaagtcccttacataaaacggtgtcatatttccacataatgtacacacataatccagtatactttaaatcatctctagattacttaacattagattacattaacacaaaagtaaatgctatataaatagatgttatactttgttgggtttttaaaaattatttattattattgtattattattattattattttccccaattttttttgatccacagttggttgaattcatggatgcagaatttgtggatatggaaggctatctgtatagaaatggccaacaagtacaagaaaagatttcaacatcattagtcattaggaaagtgcaaatcaaaaccacagtaagatatcacttcacatccactaggatggttaaatttttttaaataaaggacaacatgtgttgataaggatgtggagaaattggaaccctgatacacagctaatgggaatataaaatggtacagccactatagaaaatagcttggcagttcctcaaaaagataaacaaaatggaattaacccagcaattccacttctaggcatgcaccaaagagaattaaaaatatttgcacacaaaacttgtacagggatgttcatagtagcattattcataatagtgaagaggtgtaaacatgtaaatgttcatcagctgatgattcggtaaataaaatgtggcatatccaaaaactggaatattactctgtcacagaaaggaataaggaattcgtatatgttccaacatggatgaaccatgaaaatgttatattaagcagcagaaggtaaacacccaaattcacatattgtatgctcccatttacagttggaaatgtgccacataacatttcagtcagcaatggactgcatatatgacagtattcctgtaagattataatactgtatttgtactgtaccttttctatgtttagatacacaaatacttaccattgtgttacaattgtcagagtgttccctacagtaatatgctgtacaggtttgtaacttaggagcaagaggctataccatatagctaggtgtgaagtaggatctaccatctaggtttttgtaagcgcactctgatgtttgcacaatgacaaaattgccttatgacacacttctcacaacatgtccccatcattaagggacacatgactgactgtatatgaaataacaagaccagagaaaaccataaaaacagaaagcagattagtaattgccaggagtttagtggaagggggtttgggaactaactgctcattcatacaggctttctttttggggtgatgaaaatgttctggaatcagttagtggtgatgcttgcatgaccccatgaatatacgaaaaatcactgagttgtacactttattatttttattttaaaaaagtttttaaatggggtctggctctgttgcccaagctgcaatgcagtggcacgaacatagctcacggcagccttcaactcctgggctcaagtgattgtcctgccttggccttccaaagtgctaaggatacagagctgtaggctaaaaggataatttttttggtatgtgaataatatctcaattaaaaaatttttttaaatgtgctttgggaataatccatttcctgttaaaattttctttagtttattaatcatgtttaaaaatgatttcttctggtgaaatatggaattaaccacaatcattcaattattatgtctaattaatatagctcattatagatatttattatttatagtactaaatgattttctattacactaaggatgttttgagtagcttccaaaatatggcccatttctaaaagatctaactaacatgatgacacaagtgtctgaataataactaactaatgacactaatgatgaagctgaggtacttcactggtaaaagatatttaatcactgtcttttagagcagtgttttccaaactgcagaatgcaactcattagtggattgatttactgaattacaatagcaatataaaaataacagaaaaggaaacagaacagaagaggaaaaagaacatatattaataaaaagaacagaaaaggggccaggtgcagtgattcatgcctgtaatcccagcactttaggaggccaaggtgggagattgcttgagcccaggagattaataccagcctgaaaaaacatggcaagaccctgtccatattctctacagaaaatcaaaaaatgagctggacatggtggctcatgcctatagtcctagctactcaggaggctgaggcagggggatctcttgagcctgggagtttagggttaaagtgagcaatcattgtaccactgcactgtagctggggcaacagcacaagacctgtctctttaaaaaaaagaaaaaaaaaaaaacagaaaaagaagtatcaatatgcatcacacatagtaagagaaaatattctttcataaactgtaaaatatgtgaatatatatgtgggtatagggatcacaatatggtgtcagtcatggtcaacacagtttggaaaccattctatgctcctgagtattatgatttttaaataaataatagtggttaagcctccagcaagtttatgttattaatagcaaaacagacacttgcagttccaaattattgtcatatgtatttttctgtcctcacaaatcaatacattgttactctgctgattctttatattcagtaaagcactatagtaatgataatagttagtgtttgttgaattagggatttttaaaaataatctctaattctcataccaatcattcattttgggtttcatctcttcatcttatgggggagaaaatggaatctgagagtggttacttatataaagtcacattaaataataagaaatggaggcaaaaattgattggtctatctgctccaaagtcagtgccgattttcatttacacttgtcccccctttatccatggttttactttccagtttcagtttcctgtggtcagccatggtcccaaaataggtgattatggtacaataagctattttgagagagagagagacaccacattcatataacttttattacagtatgctgttataattaagttgtattattagttactgctaatctcttcctatgcctaaattgtaaatttaattttatcatagatatctatgtatgtaaaaaaacttagcatacacagggtgcagtactatccatggttttggtatccactggtggtctttggaatgtatctctcttgggtaagagaggactactgtaccaccttgcttctcactatttttttaaacactgtactgtattagttacacagtatttatactgctattatgacttaagaatttccatagtctatctggactatctcttgacttttctcttttaatataaaattatttaaaataattataaagtatacatattcttatataaaacctaagaggcataaatataaatcatccacaattttactaacctattttgtactataatttttgtttactattataggtaagcgtttttctatgtcagctatgtactctcctagaatgtaatttttgcaacttcctaatatcaacagagttattgacttactcttttaatgttggatattttggttgtgttatctctactgtagctgctttttaaaaaaatcagaatcagaaggatacgcccctaacaatctgtctcttaccaagtcctagtatcaatttccctcaggttcttttgctccagggtaccaatggctccttagttattttcttcctttagggcttttagtcactttaaaactgttcataagcagaaaaaaatgaggtttcacactaaagaaaaaaataaactttagttttctatttttaggaactattcctgtggtatcagttttgagctccttgctttcgggaatatgatttttcatagttaatacacaccatgggcgacagtcaataaagttacctattgacttgtctagacttttttggcaacttacaaaacttatactaaaaagactgtttctcctatttaatcttaaagagacttttgtccaattgatatatgtaaagatctctagaatacatccttcaacagcagtatagatatcttgttcatttgtggtcataatacatagtattatgtctacacagtaggactataatagctaatattaaatctacatagtctatatagtaggactataatagttaatattatatcaggcactatccctttctgctagatttttaaaagagaatttcacattcatatgggtattttctaatgttctgatttgttctgaatgttaggaaaaatgggtaagtcaatattttaatattagtacatatgagaatatcaaccaaagcaaacattaaaagccatggagacttgattaaaagttcacaaatcataaatgtaccaatccataaattataataaagcaaatactgatgtaaccacaacttaggtcaagcactagaatattatcatcatactggaagatgccatcatgtcacaattattattcacttcttcctttccattggtattaataattactagcctgtgttctgacatcacagtttacttttgtctgtctttgaactttaaatgaatgggatcacattgtacatattcttttatttctgacctacttcactcaatactgagaattatccataatgttgtatgagttatagtttgtttttattgctgttattttcatatatgtatatataattttcatccattccattactgatggacatttaagctgtattcagttttgaactgtcaagaataaagctgctatgaacattcttgttcttttggtgtaaatgtatgcaccattctatttgatatattactggaattgttgggttatagagaaggtatatgatcagctaaatatagaaaataatgctaaaatgtatttgatatggtttggccctttgtccccaacccaaatctcatgttgaattgtaatccctggtgctgggggagtgacccagtgggagataatttgatcctgggggcggacctcccccttagtgtcctggtgatagtgggttctcacgaaatctggttgtttgaaaatgtgtagcacttccccattcactctctcttctgctctgccatgtgaagaaggcacttgcttccccttcgcccttccaccatggttgtaagtttcctgaggcctccccaaacatgtttcctacacagcttgcgggactgtgattcaattaaacttcttttcttcataaattatccagtctcaggtagttctttatagcagtgtgaaaacaaactaatacaatattccaaagtggttatataaatgtatactcctactagcaatgtatgagaatcccctattcctccacatccttgacaacacttggaatcatcaatcttcaaaatttgtggctgtatcttgtaattttaatttgcattctgctgatgagtaatggtgttgagtctctcttcacatgtcctttggccatttggatatcccattctgtgaggtgcctaataccgtgacttcctttaaagactcaaatttgagtcatcaacaaaaggaggatactaacttccagagttaagccagtaagaaaaacaatattttgaggtagtaccaattatatatacctaatttggatgattagagagatatttctatgtttctattagatgagtgatttgcattgtttatagtttcagagagtgaacgggttttttttttccatttgaccatttatttagtcataaattcattcaaaaattattaaacaccaatttatgccaggcactctattcaacattaagtttcatcagagatggaagtgattgatctgggatcaagcacaagcagtgctggagggcacaaagcagctgaatgggcaggtataccagaccatgccacctacctcgatgcaccagcaccttaagctcagttcagacctgtggtgtggagggcctcacagacaacctgatctcagcctgattcatagctgctgctacataagggggtggggaggaatgagtttggcacccaggtgatctacttggttgtcctttggtagtaacttgcccaattctgacagtaagtggacaagtatcttagccatgacttggaaaggacatgataaacagaagttcagattccccagggataagagtctgggtcatcctgccagaggaagaaaaggcccatacttgagtcatggataaatcagcttggtacatgggactgcagctgcgctatagccctactccctctgcccaaacctggttcctagccttcccccacaggtgttgatcctaagaactctcgctaataaacttcctggccaggtgcagtggctcatgcctgtaatctcagcactttgggaggccaaggcgggaggatcttttgaggtcaggagttcgagaccagcctggccaacatggcgaaaccctgtctctactaaaagtacaaaaattagccaggaatggtggcacacacctgtaatctcagctatttgggaggctgaggcagaataataatttgaatccaggaggcagaatttgcagtgagcagagagattgcaccactgcacttcaacctgggtgacagagcaagactccatctcaaaataaatacataaatacataaggccaggcacggtggctcatgcctgtaatcccagcaccttggaaggccaaggcaggcggatcacctgaggtcggaagttcgagaccagcctgatcaacatgaagaaaccctgtctctactaaaaatacaaaattagccaagcacagtggcatgtgtctgtaatcccagctactcgggaggctgagacaggagaatcacttgaacccaggaggcagaggttgcagtgagccaagatcgcgccatggcactacagcctgggcaacaagagctaaactccatctcaataaataaataaataagtaaaataaacttcctacatgctgattcctatttcagagtctactccctgagagatccaactcccagtaatattcaatggaaaaccaaactgccctcgtagacctacattctggtgacacacatatgtgtatgtgctaacatatgattagaataaagaagtttaactttcattttcgaaatattcccctcttcactatttaagcaaatttgaataacagaggtaatatatttttagaacagatatgaattggaaaataaacctgaactgcaagatattaataaaaatatttagggtggttgtgcagaaaagtcaacatagcaggctttaggctactgtctttggaaaagcccacttgcgaggttggcccttggctggtatctggaaacttactggtaaacagttccctacacagatataaaccttttcccaaatgaaaagaatgattcactgtgcctatgctgtttgtacaaacaatgtggtttatattgaacacctgttttccttctgggagtctggaattttggtgcatgccaggcagaagaagcctatgtgatctgctcccaatagaaacattagatgctaagtatctaacgagcttctctggtaggtaaaacttcatgtactgtcatacctgttgttgcaattttttgctggaggaattaagtatttcttatgtgaccctaacttggagaaaactttcggaagcttgagcctagttttctgagaattcatcccatgtgccttatgcctttgttgattttgctttgtattccttagctataaattccctgtgaggtacatggattagagaaagaaagaaaaaaagaaagaaagagaggaaggaaagaaggaaggaaggaaggaaggaagggaggaaggaaatatatattagccataagtacaaatatatgccaatccttatgaattcttctagtgcatcattgaatatggcagtggtcttggggactctgacagtatagaattcttctagtgaaccactgaatatggatgggagtggtcttggggactctgacacagtggcgtaatagtttttccagggaagtcctttgtcagaatttattttaatacttaaactacattatatttccaataatgaaaatgtataaagataataaataataatttaaagaatttgactattcaagaaagaatatactttatctagccaaatattggacaaaatgttgctacctcattaatctccaccaaggaaatttgctatacttgagtggctcttaccttgacctatatataaaaaggatgctgacttatagctgattcacatgttggcttaattttttatagggttaagttatatattaatgtttttccctacatgggataaagttactcagacaaggattacctgagtaattcttctgtatttagtacaggaccagggaaaattgtgtgtagacataaccttgtaaactcacaaaacattcctgtgtttttgttttttttttcttaagagacagtgtcttgctctgctgaccaggctggattgcagtggtgcaatcgtggctcactgcagccttgaactcctgggctcaggtgatcctcctgtctcagcctcccaagcagctgggactacagtgcacaccatcacacccagtcaatttttctaattttttgtagagacagtcttgccatgtttcccaagttggtcttgaacttgaggcctcaagcaatcctcccgcctcagcctcccaaaatgttgtatgataggcatgagccactgcaccaagccctctgttctttatctatcttaaattggttttatttacatagaaaaaacagtttaaactgcactgtcacctacgtttattttggtgtccactccagtgaacatatttcctgactaaaaagggtagggctgatgctgtaattattcaggcataccttgtcttattatgcttcactttattgtgcttcaaagatactgcattttttacaaattgaagatttgtggcacccctgtgttaagcaagtctatcagcactatttttccaatggcatatgttcatttcctatctgcatcatattttggtaattctcacaatatttcaaacttttaaattattactatatccgttaatggtgatcagtgatctttgatgttactactgtaattgttttggggagccataaaccaagcccatataaaacagcaaactgtttaataaaggtatgtatgttctgactgctctaccaaccagccattcctgggtctctctccctctctttgggcttctctattcattgagacacaacactattgaaattaggccaattaataaccctactatggtgttgaagtagaaggaagagttgcacatctctcactttaatttggctagaaatgataagcttagtcatttagtgaggaaggtatgttgaaagctgagacaggctgaaagctaggcctcttgtgccaaacagttaagccaaggcataaatgcaaagggaagattcttaaaagaaattaaaagcaccactctagtgaacacacaaatgataaggaagcaaaacagctttcttgctgatatggaaaaagtgtgagtggtctggatagaagaccaaagaaaccacaatattctcttaagccaaaacctaatcaagagtaagaccctaaatcctttcaattctatgaaggctgagagaagtgagaaagctgcagaagaaaagctggaagccagcagaggatggttcatgaggtttaaggaaagaagcccccttcataacataaaaatgccaagtgaagcagtaagtgctgatgtcacacctgttgctgcaattttttgctggaggaattaaatatgtcttatgtgttgcagcaagttacccagaactagctaagatcactgatgaaggtgattacactaaccaacagattttcaatgtacacaaaacagccttctgttggaaaaagatgcaagctgagaaaagtgggaaattctggccttctccattattatcaagcctctaaagattctggagatacccctatctcagccccacagtccatgtgacttttaaaaaaatatatatggaggaaactgtgaaagccatatcacccagacattcctagctagagaggagaagacaatgcctcgcttcaaagcatcaaaaaacaggttgacttgtctaatgcagccagtgagtttatgttgaagctaatgctcaattaccattctgaaaatcctaggaattatgctaaacctactcttcctgtactctatacatgaaacaacaaagcccagatgacagcacaagagtttagagtttacagcatggtttattgaatattttaagcccagtgttgagacctactgctcagaaaataagattcctttcaaaatattactactttttgagaatgtacctggttacatccaagaactctgtgggagatacacaagaagataaatgctgtttaaatgcctgctaacataacatctattctgctgcccatggatcaaggagtaattttagctttcaagtcttattatttaagaaatacatttcataagtttatacctgccatagatagtgattcctctgatgggtctggaagaaaaccttctggaaaggattcatcattctagatgccactaagaacatttgtgatttatgggaggaggtagaaaaatgtcaacattaaaagaagtttggaagaagttgattccaaccctcacagatgactatgaggggtgcaagacttcagtggaggaagtactgtagatgttttggaaacagcaagagaactagaattagaagtagagcctgaagaggtgactgacttgctgcaatctcatgataaaatttgaatggatgaggagttgcttcttacagatgagcaaagaaagtggtctcttagatgaaatctgctcctggtaaagatgctgtgatgtcatttttgaaatgacagcaaaggatttagaatattctatggacttggttgataaatcagcagcagagtttgaaaggactatgccaattttgaaagaatttctactgtgggtaaaatgctatcaaaccacaacacatatgacagagacatctttcataaaagagtcaatcggtgcagcaaacttcgttgttgccctattttcaaaatttgccacaggcacttcagctttcagcaaccaccaccctgatccatcaggagccatcaacattgaggcaagaccctccaccagcaaaaagattataactcactgaaggctcaaatgatcaatagcatttttcagcataaaatcttttaaaagtaaggtatttacattgtttttagacataatgctattgcatacttaatagactacagtaatggtataaaaaaaacttttatatatactaagaaaccccaaaatttgtgtaactcacttcatcgtgatacttgcttcattacagtgatccggaaccaaacccataatatctccaaggtatgcctgtgtttatgttgttgttaatggtgtagttttaagttctcctaggtacatattattttagtttaaaaaataatataataatatattatcgtgcttgaggaccaaaaatgtatctgggatctaaaaaaaatgtgtataaatagtggaacagatcacaacttctttaagttctcttaccatatgcaattttatattgttgctataaaacctagaagttcagcttccaaaatatagtggacacctgttttgtcagtggcatttatgtgcaaatgtaacgaattagaaagaaaatatatagctagacttacgttttcactagattctcttgcatcctaggcagttgatccacctgttgccttttagaaacttgatgtaaaccagaaccctgaaatacaaaaatttgagtgtttatccccttggttcataattgatttcagaaataagagagacagtcaattctcaattaactctcccataaccaggttcttttgcagcatgtgtaagagaagctgagaaaaatgggaaattctggccttctccattattatcaagcctctaaagattctggaaatccccctatctcagccccacagtccatgtgacttaaaaaaaaaatacagaggaaactgtgaaaaccatatcacctatgtggtatagatcattaaaacttcttgtagtagacactaaatatagataatgcaggcaccctgccattacagtagataagacaatagaagctgtagtattttgaggcagaaatagaaagacaagataatattttcatttttgcctatcttgaaattcctccaggatataaaagtggaaatttctagtggtcagtgtaaatgtaatctgcaattcagaaacaattgagaatgatgatcttagagatggcaaatgaagccaagagtgaatgagatcattcattgagggtacacagagaagtaagagaatcaataatacaaactgagaaagcaacttttaaaggataggacaattaccaaagatagacaggccatcatttaaacaataagaaaacccaggaaaaactactatcatagaagtcaagtcagggagggtggggagtattcaaagaagtgagcatggttggcagtgtaaaatgcctcacagatgcttcgccaaatttgaagaggagttgctgtatttggctattaagagataaactaggcgaaagcatgatggcggggtcacaagagaaatgaaaagagatagaggactaaaaagcaatggcaatgagtatattcatttattcatgaagtttggctgagaaaaagaaagctaaggtggtagttttatgaggacagttaatcgtaaagtaaaagtttgtttttattttgttttggtggaagagttgagcatgtcacaagcaaaggataagccaaaggcagtaaaagagagattaaaaatatgcgaagggatattattaagtaagtcctagagacagcagataagactggggaagaggtttgggatcattttcctttaagacaggaagaacaggatagtaaatctgaaaataaaaaggaggaaaattgggtttcacacctgatagattctctttttgggtgtgagctaagatattagatcatttgatatgagtgacaggtttgggtatattggaacagaaaatagaattcattcattcattcagctaatgttactgagcatctactatatgctgccactacattaagcactcaggtacaaagacaaacgggttatggttctatcggggaaacagcaaaataaataggtgattacaattaagtgccttgatggagatgtgcacaggtgctttgcaagcatacaggagatgtagctaattgagggtatgggggactccacatggaagagcagccaattaagaactaaggaaagaatattctaggtaaaagtaacagtaaggaccttaggtataaagcagcagatatatccaggaatagcacatagcatttggtctaacggcagtctaggatattagcagggatatggctgcagagacaggaacagccaagttgaagaggaccctgcagagaccacaccaaaagagctttgctgtgatcctctgggtaatgcaaactgaaggtttttaacaggaaagaacactattgtatctgtatttcagaatgataggcagcagagaagaaaaatgggtgtggcagagttagttaagactttggtaactatgctgttgacattatatctaaagtactaaatttaaacctaagtactacatttaaacctaggcagccacatttttaaatgaacaataacagaattgtccaaaaaggcagctgaaatacctgggcagtctggaacctatgttatgaggaatggctaatgtaacttaatattttagcttagaaaacaaaacaaaacaaaaacctatgggaagactgagagtcatttacaaatctttgaaaaactatcttgcaggagtgtagacttgttcttattcttcagaggatgtaactaaaaccagtggattttaaggaagtttcaggaaaagagaataagaggcatcatatgatgttttaacaattttaacaattagaacttcccgataatgaaacagaaaagcctcagattccttatctgtgagctaaaagcattatattcctcaatctctcagagccattgctaaaatcctatgtttacaaagatagaagctaaaacttaagtttattatgtgctgcaaaaagctctaatcggtctttctgcctgacttttaagtaatgcaacgtacctatgtgttaaaaagcaatgtccgtattgtacttatgttgtgcatatcagaagactcccaagagggggaaactcagtttcattcaaaacagtgaatcaagagtgagacaaagctacagagaggacagcagcagaaggataaacagcacactcagcaaatagctctagttatctaccaatgaatcaattatttatgtattcagcatgggaagaactgcaaatcatccattaacctttccaatcaccgtagtatccacatggttagaactgtccttcactataaagattaacaattcactctagagtgaaaatctttaacatttatactggggacagtattaacatcttcctgggaagctgttaaaataggcttttatcatatgttcagtgatcctgcggagtcagagtaggattatttcacataagtgaatttttcatataaactaaggtaaatgaatgctttggggacaaaagactttacttttaaccttaaaaaaaatcctccaacaatgttttatatatcacctttttcttaataacttgggcttatgattatgagcatacatttctattttatgttcagttcagtaaataattttgcatatttgctttttgccactctttgtgaaagggaatagaaagcatgagtcaccctgactgacctcagggaggaacctacagctgagtgaagcaaacagatatatcagcaataagggaccaagaggaaggctaaggcaagtagaaattctggtgcccctgtcacagagaggggctaggaaaatcagaaaagaaacacaggaaagtgatattcaccatttactggaatttaaaacctattatgtgtcagaaacttcaaccagcacttcgcacatattatttctctacatactcacaaaacccctgcaagatactgatatttccttttcacaggtgaggaaggaaattaaggcccagaaaggtcacatggtagtaagtgcagagctgggattcaaattcagatttgcaatgccattacagtctggtcttttcatcatgtcatggccccataaagaggtagtgtttgtgctagaccttgaaggatgtggaattggcatgtatgagaaggagcacattccaagcacatagtctgaggaaaggcataaagatgcctgtgatctaggaggaaccagtgccttcagcccagtatcaaggaacatgaagtttgagctaatcatccatttacagacaagagaatgcaagaacttatcctatcttgtctcaatttcttacttaccttagtcaacactacaacacatacttccctttaccaacaatagaactgactttctcaaaattttctaaatgtcccccattagctctaatccccaaacctaatgcccttcctctcaatcctttcattatccctctagatattctggatcagtgactagcagattattctgcatgccactcccatcctcaaaatcctctacctccttgtctgacctagctatgtcttcaggactccaaccctcttttcggctcttcctcccttgactgtcactgttgaacttcttcagagcaatatcccagactatttcttcttttcccactgtatattctccccaaagcatttcattcattcaatgacttcactttttatataataattttgaaattttatataataatttgaaattaataattttcaaatctttatttgtttcctgagagtcatatatccaactgctctttggacacttccatttggataacacacattgaaaactgagtttacatcctaatcttaaaacatatgccaaaataagattaatattgattaaatatttaaacgtcagatattatgctatacaaatactaaaatatgtggtgaatgctatgaaacattgagatggtctttttaactgtaacattagaaatcataaataaaagatagctctgacaacctcaaaacaaaaactctacaataccaacgatatcataaataaaactgaaaggcaaatggatagcttgaaaatagatgcaacacctttcataatttactgatcacctctttgtcctgtatttataagtacgcacttctactaacaaaagttccatctctcgagatcttaccatgcataattataaagtgaagtgccttgaatttcatgatagcccagagatagcagctacctgtttgaattctagtgattagtggtgaaactaaaaggataattaaggaagcaaatacaaaaaataacctcttaatttggaaaactgttatgtcctttttacttttttttttttttctgagatggagtcttgctctatcagccaggctggagtgcagtggtgtgatcttggctcactgcaacctctgccttctgggttcaagctattctcctgcctcacctctgagtagctgggactacaggcgcccaccaccacgcccaactaatttttgtatttctagtagagacagggtttcgctatgttgaccaggctggtctcaaatgcctgacctcgtgatccgaccacctcagcctcccaaagtgctgggattacaggcttaagccacagtgcccagccctttttattttttatacaagttgtatattttcctgtctaccctccatatttagaaacttaactccaaaatctgcttctctcccaaaccaaaaacaaaacctagaaaagtgaaaaacataatttacagtaagaagaaacacttagaatttggaaataaaaaagagttacctgagacatttcagctaggtatgtacggcgttcattgttgatcttctggtaagcctgtgtgaagatacaaaagcaaagggtccaacatatgagaagattagcaatactagcaagactaagttaaggtgtatgtctctatagtgtaggaaatagttttgtgttaattatagagtaggtttgtagataacattagaaataatggcagtttcaaaggaattgctaagtatagagtaaaaacaaacctttgattcttgttccagtttaagtgcatagtatttcacttgactttcaagagtcttcttttcttcttctagctgtttaagtaatgtgtttaaggattcctaaaaatataaatagtaaaattttatatgtactcatgttctaaacaaaataagaaatgaccatcaatttcttcactagtaaatgccttgtatacctaatattttgtgatttcataattctatgatatgtactttttttttttttttttttagacagagtctcactctgtcacccaggctggagtgcaatggcatgatcttggctcactgcaacctccgcctcccaggtctatgcgattcccctgcctcaggctcccaagtagctgggattacaggcacctgcaaccatgccaggctaattttttgtgtttttagtagagacgtggtttcactatgttggccaggctggtctcaaactcctgacctcaggtgatccacccacctcagcctcccaaagtgctgggattacagtcgtgagccactgcaccgggctaatgtgtactttttaagtaatagtaataatcacaatatttattgaaccctaacaatatgtcatgtattgtactaagtgtttttctttttttcatattaaactatctttatttgaaaaacggtatcgtacaaacctaacactctctatcaaacttcaataagggcaatttccacatcgactaatgaatagtagctaaactaacaagagatcaatcaaaagtgctttcaaaggagcagcactggctgatgttctgctgaggctgtgggcattcaggacctggctacagggaaaacagaatcaaaccagctggtgctttggacccaagccctcacatcgtgacctgcctccctcctgggggccctggcacttccaggttcctttggcacttcctggcccctgtgggggcaggaacttggcctcacagttagctggcttctgcctgttgtggtcatttttttttccagagtgcccagagtgctctctcagtggacatggcggtcatccagctttcctgaggtgttttctcaaggaagagggtcttgctgtgaaaactggaagtgtctttcttcaattcttgggccagttctaggaacaacttgtagcagtctgatacaagcagttcaagttttcatgcaccttgtgaagtctctggtcggggtccaggcagtaggtgtcctcctccatggactgctgctgagaccccatcatgcgttctccatgcagttcagatagagtggggagggtcagctacagcttcgggaactctcccacaggctgtgcccttgcaccctgcagaaagccctgctccctggtgtggtggctcacacctgtaatcccagcactttgagaggccgaggcgggtagatcacttgagctaaggagttcgacaccagcctggccaacatggcgaaccctgtctgcactaaaaatacaaaaattagctggcatggtggcgcatgcctgtaatcccagctactcggcaggctgaggaaggagaatcgcttggaacccaggaggcagaggttgcagtgagctgagattgtgccactgcactccaagctgagtgacagagcaaggctccataaaaaaaaaaaaaaaaaagaggcctgcttgccgatcagactttggacttgtcctgtgagttctttccttctttggatttcttcccataattgcattctgcttctccaacatcccctcaggaaataagaaggatgcacctaagctaccattgtcatccacagtcttcagaggaacttgtggccaggacgctgaagaggacccactatgtcctgcttccccaatccccattcactgccaagtcctcgtcctccacgtagtctcttaccacccttgaccagatgcagggcgctcagcacggtgtgggccagggaggtcagttgtcccactccaatattcatgtgggctgtttcattcctgtcttggcctgctccagcctttccttctccttctttgcctgcaagcgttgcttccatcttgcaatttcttggctgggcagctgtgcaggttgctgatggtcagtgctgtcattcagatcatctgcagtttgcccttgaagatctccagcatgctgtgaagtgtgagggacgtgatttgcatcagtcacttagggaagttcaggaggcctgttttttcacgcttttctcagctcactgttttagttcgttctcatgctgctatgaagaaatacccgacactaggtaatttataaagaaaagaggtttaactgactcatggttctgcatggctggggaggcctcaggaaacttataatcatggtggaaggcacctcttcacaggacagcaggagagaaaatgagagcaagcaggtgaaatgccagacacttataaagccatcagatcttgtgagaactcactatcacaagaacagcatggaggaaacagcccccataatcaatgacctccatctggtcttgcccttgacatgtgggaatattacaattcaagatgacatttgggtgggaacacagagccaaaccatatcactcagtcacgtctgaagggaaggcctactcatttcatttagaacccctcaagcagaggtttttgagtgatcaaggactgacctccagcatgggtgatatgaggcccccaccggcctggggtgctggccacatcttggccctggcctctctgtggacctcaccctgggctgaacccctctgggctgtctcttcccttcttctcactgcatgtcatctcctgatcataaaggccaccacagcagcacatgtctgatcacccagagtgtccataggttccctggcactagtcccaggattctgcacatcactaattactactgcccacaggtgggccagcagcagctgggtaggcactgtgtggcaggcagaggtgctctctggctcctgagggctctgcagctctgcttccatttgctagtggcctgtgggccacagctgaccactagtgttctgtctttaacacaaacaagggcctaacgaccaggtagaccacctattgagctggggataggggaggtacccggtgttatagaaaactgtgttcttgatttggctgtacaaatagaaagtgacattacttatgcaatgccttgggggagtggaaagagctcatggcagcccctagctcaggccatttcaggccccatctagccctacagcacagctagaaggtcaaagcagggctatctcatagccctgtgtccacacaatcctctcagggcactgtggtggcccatccctggtgaggttcattaccctaatttcaagtttccttctgcttcagggaagcctggtcctgcctacaaagagtctgtctaccggctgggcgtggtggctcatgcctgtaatcccagcactttgggaggccgaggcaggcagatcacgaggtcaagagatcgagacatcctggccaatatggtgaaaccccgtctgtactaaaaacacaaaaattagctgggtgtggtggcaaacgcctgtagtcccagctactcgagagactgaggcaagtgagtcgcttgaacgcgggaggcgggggttgtagtgagccaagatcacaccactgtactccaccctggcaacacagcaagactccaactaaaaaaaaagaaaaaaagaaaaaatctttctaccttactagattgagctccttgtaaaagggactatgttttcttcatctccatatccccagtagctagccagtgcccagtatacactaagggctcagtcattgtcttattttgttgtctactctgacttaggacatgtcacttcccctcttgacctccatattcagatctgtgaatgagtaagtgggtaaagtccctctagctttaaaagccctccaatatagacagaactcagaaaccagaaccagaagctgaggaatggcgaatggaacattttccctggtgtgatggatgagaccgcagatctggctactagggtgatttttttgccacttgaaagcctctgcagaatttgaccctagttttcaaatcagactctagaatgatcttcagtgttggtggttttgcttttgagactgttattgacacaacagtttctggaaatctttttcaaggagagtatgggggcttctttggccaaattgggtgggtgcaggctccatcagctcagcagctgctgtctgggccacagcctgtctgctgagtcctgctcccctacagaggtttttgtcagaggcatttgaaacagagcaactccatcttgaatagaggctaggtaaaataaggctgagacccactgggctgcattcccaggaagttagacaatcttaatcacaggatgaaataggaggttggcacaaggtacaggtcaataaaaggatgcagtaaagaaatggggcaaaacccaccaaaaccctagatggcaacaaaagtaacctctggttatcctcactgctcattatatgctaattataatgtattagcatactaaaagacacttctatcagcaccatgacagtttacaaatgccatggcaacatcaggaatttacctgtctaaaaagggaaggaaccctcatttccaggagctgcccacccctttcacggaaaactcatgaataatccactcctttagcatataatcaagaaataagcacaaaaatagccaaccagcaccccgggggctgctctgctgatggagtggccattcttttattcctttactgtcttaataaacttgctttcactttacactacggatttgcctctaattcttttttgtgcaagatccaagaaccctctcttgcagtctggatcgggacccctttccattaacagtttctccagacattacagtgtgactggccatgtcatctgtcacaggtgtgaaaacaatcaaaaccaagagcctgaagctgccgggatgagtgcctgcagaggaatcctgctccctgcaggcacatctagaatgtgttcctgtgctggggccctgctctttccaagaaggcaggctccagggactcccaggatcctgctccctcggataccacagtctatgtaggcagcaggactaaagtgatgagagccgccatgatagtgagggccgagagcaggatggcggaattagaaggcagcgtcctgacccctggcgatgagctgagtcaattggtccctgtctccccctcagagccaccatcttgtcgtggcttccctcaggaacattatgagctctcccccaggaagcgcttcttggtttcccattgttaccggatggaaagtcttgactgccagttgtccaagttcttggtgtattgaacaaagacttgaacaaaatgctcaaacaaagcaatggacgacagcgacatacatttgttgaagcaaaaggacactccacagagtgaagcaggcttaagtaagtggctcaagaggtctgagtatgttccctggggttattaactaaaagaacttgataacaccctttagaggtttccaattggttacacactatgcaaatgaagacagcccacgaccaaccagaggctgaagacatggcctgcaatcaatcagaggctgaagtggagttacactctatgcaaatgaaggataggctcacgaccaatcagaggctgaagtgaagacttggcccacgaccaatcagaggctgaagtgaagacttggctcgtgaccaaaggttgaagttttcctttaggtttaattccaagaagtcagaggcaggttggccttaggctccctgtctccagaccctattctcctgcctcatcttctccagactcccaccaggtggtggcctctctggccctgccagggactgggcgcagggaggggaggggtggctgacaggcctgcctgaggcaggtgggcagtttgtggccttcgggcatggcctgctccaatggaggtgcctccttggcctgccccagctcagtccctctccatgcctctgggagccctgggcctaaatgcttttcatagattatttcatttaatccttattacagttgaaatggctaatatatttctatctaactgttgagaagattgcagcttatagagattacataactggctcaaagacacgcagctaataatggtagagctggaacgtgaacccaggtaaaatgactccaaaggcaacagagggtaaacaattattatatgtgtgttcattttattgttaccattgtaacaaaagaggtacaggcaaagacatttaaagaggatgtcctactgttaactgtatactctcagtcgatttttacttcctggtgaaaactaacttagaaatctacaaaaacaggatcaaacaggcatccaaatataggaaaaagtgtatggcactttttttataaaaagatggaatgtagtgaattatcttgatccacatcagtaataccatatatatacatgattataaattgttagagaaatatacaattaaaatgtataattgttatcttccaatctgagttacactagtttcctggtattagtaaaacaaatgtatggaaacccttatgtaaaaaactccagctacttgtgatgaggagtatctaggttaaggtcttacaactggtctactctgtaatatcctcacaattctcctttagtgcctattctaccactctacttcttccacttctttggcttgataaataatctccttttcgtgatcatattgtttttcattttttgtgttagtgcatccctcacaaactctagaactttcttttctgaatgctacttttcataagagcctcctacccccatctgttttagcttttcagagaggacctagaagtacacggtttcctgggtatcacatatagaaatgtagaaaagctttcaagaatctaataatccttctacctggccaacattcactgagggcagaaatctgtactgacttgataactggggatgaggaaatctgggaaagaggtatgtggatggtcctataaaagtgggaacaaagggtgaaatccctgtattgcgcagtaattttcaccagagagcacccactgtgtaagaggcattaaaccaagtggaccaaaggcttaaccaggagatagcatctggtttctgttcttggtcaccccagtgggtggacaatgagctcatgaacagtaaccacagtggctgagatggcgactttgcattggctcaacagcatgggtcccttcccaccaagactaatctagtactgctgctgctcaatgtctagcctgccaataagagacgacaacataagcccctgttactgtgccatccttcaagatcaatcagctgcttggtggcaagctgattatacaagatgccttccaacctcaaaagagcaacaattcatcctgacaagtgttcctgatagttttacctttcctaccacagtgcctcagccagcaacataatttggcaatctatcagttctgagaaggaagtttgtttgttttttcactcaaaagggctcctttaggccaaaaaaacaatcttactatccttttcaggtgggactggctggacactcaactggttgatatccaagactggcagcctagcataattaggggctcaaagcatatgagttgaaggcagaatgctaggcatagagctaattcatagcaaagaaaacccacactaccactagaagataacatgtgcctgttccgtaggaaagctgtattctttatgattagacttgcctccagagcctgccctgtgatcacagaactgaacattagaaacatgccactgggaacttgctggttggaatttactgcagtgcatttgtgagttcaggtaaattcgtcagttgattttagcccagtagacccagatgccaatttactctaaatctgcttaggtctgggttgtttaatcatcccacactttttagttttctcttatactctgggaaaaccattaagaggtgcccctgttgagagactgtcacatgtcagaaactttttcaggaagttcatatagaggaataactgtctacccctctagtgctgcccagaaatgcttggccccacccaacttgaatctaccacccagaaatgacttatgttaacaattaaacctcctctgccaacacttcagcacatagtgttcagattaccaaatacacagcccttggggaggtatgtgatctcatccttagacaaaaaggagatgggtggaaataattttctaaggccagcctgaccaatctcacataatgctatttgaactgtaccagcatgactgtgccagtacctgatcaatgatgaacacctccatctccttctgggtgtgaaagtacattatatattgatttactgctagatctagtctcctactggccctgtcctggtagtcttggactcctctaacatgtgccacaaagattagttctaatacctaaataaatagaagtactactagctttgaactatacctaggaattcaagtcatgcttcaaatatgcttttaattgtggctcaagccttcaatcatgaaaacctgaagatcccctgccccaactgaaaggataaaggtggctggaggggtgaagattggtatatactggatagcccagcatagcatctttaaagaatgatttttacctaggaagtatgttctgggctctgctctgtgcataaaagggccatctaactataggtccagagctagtggccttgctttcttgaactatgtctctgtgcccagctctggatcagtgatgggggtatctcttttctaagagatactgtggttggccagtctatgtaaggtctccacctctagactaatgagctctggggacatataaagcagtgaaaactcttttggtataaagcatatgactgaaagaaggagaaaatacaatttgcagaaggaggtgagttctgtcctagaagaagccaaagggaatgctggtcaaaccaaaccaaaatgccctctacaaaggagatgttaaagcccagggtttggccatggtatctgggttgctgaaaaggagtaggagagggagggattaatagaattaagcagttcgaggaatttcaaggctatagtatgtgttgaatttacaatcaagttccccaaaacattggtacgaaagtagaggaaaaaaagggttagaggtcagagcaataacatactcatttggtttaaaatttaatccccaactgataactgatcattttcagtaactccaattagttctcacattcttgcaaattaaagggaaaaaatcttcaagtcaaattctctcaattatattggtcatgatctaggtcactaaatctattaaaagaatcattcaaagaaaaatggaagcagctgatttatatctccacaaagcaaaactgcaaaatattttagagctcataccttcctgaaacacagctacttctctaaacactttattctctcttagatacttcttaacaattattagaattttaaaaattatattaagagaataattaggtgaaacaggacaagttccagtctctgaaaataattctagtgataaaacaagtccctcagaaatgacacatcctcactatatatgtttgactaacatccctgttaaaacataattgggtgatatttctcaggtaggtattattgttcttcaaaaattaattacacactagtatcatgaatggtttccagttcccttcccccaaatacaaatttgctccagaagaaaatcaataaaaggtaaacatatgcaagaagctaaactgaatcattttatagaaaattaaagccctatgaaataaactgctcaatatgaagagcttttgaagggataatcagggggtgagggaggtagttcaaaattctgccacatggacgcttgctccaagaattccaagtttaggctaccatagtaacatagatcagttacataatttgttaaatacatttatagatgtaaaatgaatccaaccctttttagtatagttttaatggaaaatgtattctaagttctaaaagaagttagcttacaaataactttctgaaacacaaattattttggcattaaagataacctgaattagatgggattcaaaactttagaaattcatacccaaaaaaagtacattcaaaatagcagttaaaaatacaggcaatatatgattaaaagccaaaatctgaaacatacacaataaatacttcagaagtttttaaaagaagttgatcaacatgggctacagagtccctaaaatgagaaggatttagatggaaaaagtgagatgaaagagctatatactggtcacaggcttgaatcagaaatgattatttaatgagagtgatacagctgaagcaaaatatttgagcaataaataaaaaaaaaagtaggatacctagggaaggacctggataaagaaagcttaacatgttaggctcaggagtctaagaactgggagctattccaagttattaaagaagagatatgatgaaaatagggacttaggaatattagtcaagtggcagtctctctgacagaggatgttttctgttactttcaggtgtgaatttgcaattctaactctcgaggcttaaaaatttttaatatacctgtacttcctttgtgacttagactatatcttgctgctattcccaacctgactagattccttgtctcgtagcctaattttacaattcattcatttattcaaaaactagctatgaagcacctcttatgtgtcaggcattgtgctagggatagcacactaaaaattacaaacccagaccctgtcctcatgaagctgagaatctaataggggattcagaatgtggtctgtcttgatgaatgttacatgtgagcttgagaagaatctgtgttctggtggtgttggatggaatattcaataaatgtcagttagatcaagttgattggtagcactgttcaggtcaactgcctgcttgatttatcaatcactgacagtgggatgttgaagtctccaactttcataatggatttgtctattcttcctccagtaatttatcaaaattaccatttaggtgcacctaccagtttacaattctagcagctctcattttaggtaaacagatctcagttgtgaccgtccacttttgtctgtttatccagatttcagggtaggagtttgccctgcaaattcaattttctaatgggtccaagaaaagtcattgattttcagtttgatcaccattttcttgttgtgacgacaagattgacaactttcaagatatatacacgttctagttgaaacaaggagtcacaaactgatcaccttttctaactgaaatgaaaagaatgtattctccaaatcaatggctgcacagcctgtaactgaaaccttattaatctactctggcagtgatatcacatcgggcaaagtagctgcaaatgaggctactaattgtttaagtctgcagtagcctacagtttttccccataagacacccagtttctgcagccattaggctggcaaattaaagagagctatgttaggcagcagtatatttgcgtcttttaggtctttaattatggcactaatcgctactgtcttccctgggataagagatgtttttgatttacaattttgatctgatgaagggagcagtttcagaagtttttatttggtcttttccctaccatgatagcttttacttcagaaattagagacccataagggggtaactttcaactgtcaagtatatctatttcaattatgtacttggtgatggagatagttatcactgcaggggtaggggagtctgtgggcacattgagcccactgtgatttggaatttggtcatagatttccactctaggaatcaacgttaactcagaccctgtgctcaatcatccttgagagatctagttatttccgtttcctcagtgtacagtcacctgtgtaaatggccagaggtccgttttgggaggactgtggatactgtcataatataaactttgactagtattgcagggcccttcttaggaatccagccacttctttggtcagtagtttctggttctggaaattagttcaggtctgggaaatgagtaaagaattatgctttccactgggctgactgtcttcagcctcctgctcctctgttcttgcttttctttctttaattagagatgctgaacagcaccattcttaattggcttggcaagcaggggaggaggtgggtgcagctcctgagggggaaaccagttgtcttgttgggaagaggcctccgcagcatcttccaggacagtgggtactcttctagcccttattagggaagggtgggccacctctgcacacccagagggttcaggtagacttgtagactccagatccttaggggcacctatccagatgtcctgtcagagttttcaggatccctggtcatccctatcagggccctgtccttcacataacagacctacctgggctgagcattcagatgcctctggagctctgcaactctcacaattaggtctttagcctgttgttttaccctgtccacccttccactactggtatagagggcctcttatgaggctaccaccaaggctttctcgtttcacatacttgttaacagttctcagcctctcattatccttatgtagggtgtcaatacaacttagcagcaaatgcttgcatcatggcttcttccacagtattctactccaacaggacattttccaagatcatcatcagtgcaatctttatgaagtgaactgccacattgggccaggatctattgctgtcacacctaccaatcagaacagatcctgctacatggtgagtgagccagttacaaattacctcctattttctcgtatcactatccatactcctagttttagaactggtcttctgagaagcagacactaagatgggattacatgtacaaggatcatgttatcagatatgcccatgtaaaaggaaatagagagggagcaggaggaggccaggagagcagtctgacagtaatgcaagtcttagccctagtaaaggacagtgagagaaggttggctgaaagcaaaagcatcctaggctgtaatgtagtctaggaaaagtttggcaaagccaaccaagagtactcacttctgcagcacatatactaaaattagaatgatacagagaagattagcatagtccctgtgcaagaatgacacacaaattcatgaagaatttcatatttttacaagccagaaaagataagagtcctatcttcagcctccttaaacagaataactctcagccaataattttgtatccagcaaaactaagtttcataaatgaaggagaaataaagtcattttcagacaaacaaatgctgagggaatttgtcactaccaaaccagcactataagaaatgctaaaaggagttctagaccttgaaacaaaagcccaatatgtaccaaaacagaacctcttgaaaccttaaaactcacagggactataaaacaataacacaatgaaaaaaaactatctaggtaacaattaatatgatgaagagaacagtgcctcgtatctcaatattaacactgaatgtaaatggtctaaatgctctgcttaaaaaatacagaatgaatttaaaaaatcacaaaccaaatatctgctgtcttcaagagactcacctaacatggaaggattcatataaactcaaggtaaaagggtgcaaaaagatattccacgcaaatagaaaccaaaagtgagaagtagtagctattcttatatcagacaaaacagacttcaaagcaataacacattaaaaaaaagcaaagatggtcactatataatgacaaaaggatcaattcaacaagaagatatttcaattctaaatttatatgcacctaacactggagatcccagatttataaaacattttaaaatgtttaaattttaaaaattactactagatctaagaaatgagacagcaacacaataatggtgaaagacttcaatacaccactgacagcactagacagatctttcagacagaaagtcaacaaacaatgaacttaaatgacactccagaacaaatgcacttaacagatatttacagaacattcttcccaacaactgcagagtatacattcttctcatgagcgcatggaacattctccaagacagaccatatgataggccacaaaataaatctcaataaattttttaaaattgaaatcatatcaagtatattctcagacaacagaggaataaaactagaaatcaactccaaaaggaaccctcagaactatacaaatacatgcaaattaaataatctgctcctgaatgatatctgggttaacaatgaaataaagatggaaatttagaaattctttgaattgaatgataataatgacacaagctatcaaaacctctagtatacagcaaaagcagtgctaagaggaaagttaatagcactaaaggcctgtatcaaaaaaggtgaaagagtacaaattgacaacctaacgtcatacctcaaggagctagagaaacaacaacaaaccaaacccaaagctacaagaagaaaagaaataacaagatcagagtagaactaaatgaaattcaaacaaaaaaaccccaaaagatcaatgatacaaaaatctggctctttgaaaaaataaacaaaatagaacattagttagattaaccaagaaaagaagagagaagatccaaataagctcaattagaaatgatcctggaaacattacaaccaacaccacagaaataacaaaagatcattcaagccaggcatggtggctcatgcctgtaatcccagcactttgggaggctgaagtgggcagatcatttgaggtcaggagttcaagatcagcccggccagtatggtgaaaccccatctctactaaaaatacaaaaattagctgggtgtggtggtgaatgcctataatcccagctactcgggaggctgaggcaggagaatcacttgaaccatcaggtggaggttgcagtaaactgagattgtgccactgcactccagccggggtgagagagcaagactccaactcaaataaaaaaaaaaaaatcatttgaggctgctatgaatacctttatgtgcagaaactagaaaacctagaggaaatggataagttcttggaaacatacaaccctcctaggttaaatcaggaagaaatggaaaccctcaacagatcaataataagcaatgagattgaatcagtaatttaaaagttgccaacaacaataagaacacccaggaccagatggattcacagctaaattctaccaggcattcaaagaattggtatcaatcctactgaaactatttcaaaagactgagaaagagggaatcctccctaaatcattctatgaagccagtatcaccctgatactaatatctggaaaggatacaacaaaaaaagaaaactacagaccaatttccctgatgaacatagaggcagaaatcctcaacaaaatactagctaactgaatccaacagcacatcaaaaagataaggtaccttgatcaagtgggattcattccagggatgcaaggatgatttaatatatgcaagttaataaatgtgatatatcacaaaaaacagaattaaaaacaaaaaccacatgatcatctcaacagatgcagaaaaagcactggacaaaatccagcatcactttgtgataaaaactctcaacaaactagacatagaagggacttacttcaaaataataaaaaccacacatgacagacccacagccaacatcatactgaacggggagaagttgaaagcattctccctgagaacaggaacaagacaaggctgccgacatgcaccactcctattgaatatagttctggaagtcctagccagagcattcgggcaagagagaaataaagggcatccaaattggaaaagaggaatccgaactattgctgttttcagacgacatgatcgtatacctagaaaatcctaaagactcctcccaaaagactcctagatttgataaacaaattgagtaaagtctcaggttacaaaatcaatgtacacaaatcagtagcactgttgcacaacaaaatgaccaagctgagaatcaaatcaagaactcaatctcttttacaatagctgcaaaaacaaaacaacaactaggaatatacttaaagcaggtgaaagatctctacaaggagaactacaaaccactgctgaaagaaatcaccgatgaaacacacaaaaaaggaaacaacatcccatgctcatgaattggaataatcattgtgaaaaggaccatattgcccaaagcaatgcatacattcaatgcaattcccatcaaaataccaacatcatttttcacggaattagaaaaaaaaatcctaaaattcatattgaaccaaaaaagagcccaaatagccaaagcaatcctaatcaaaaagaacaactctggaggcatcatattaccagacttcaaattatactacaaggatatagttaccaaaacagcatggtactggtataaaaaacaggcacatagattaatggaacagaatagagaacccagaaataaaaccaaatacttacagccagctgatcttcgacaaagcatacaaaaacataacttagggaatggaccctctttttaataaatggtgcagggaaaactagcaatccacatgtagaagaataaaactggatccctatctcttaccttctataaaaatcaactcaagatggatcaaagacttacatataagatctgaaagtataaaaattctagaagacaaggttggaaaaattctcatagacattggcctaggcaaagaattcatgactaagatgcaaaaagcaaatgcaacaaaaacaaaaataaatacataagacctaattaaactaaaaagcttctgcacagcaaaagacataataatcacagcaagcacacaacccacagaacgggaggaattatttgcaaaccacacatctgataaagaatctagaatctacaaggaactcaaacaaatcagcaagaaataaacaatctcatcaaaaagtgggcaaaggacatgaatagatatttctcaaatgaagatatacaaatggccaacaaacatggaaaaatgctcaacatcactaatcctcagggaaatgtaaactaaaaccacaaagatgctaccttacttctgcaagaatggctattaaaaagtcaaaaaaaaatagatgttggcatggatgtggggaaaagggaatgcttatacactgctgatgggaatgtaaattagtacaacctctatagaaaacagtacggagattccttaaacagctaaaagtagatctaccatgtgatccagcaatcacactgctggatatctacccaaagaaaaagaagtcattatacaaaaaagacacttgcacacatatgtttataggagcacaattcataattgcaaagatgtggaaccaacctaagtgcccttcagctaacaagtagataaagaaaatgtggttatatatacaccatggaatactactcaggcattaaaaggaatgaaataatgtcttttgcagtaacttggatggaatagaagggtaatattctaagtgaagtaacacaggagtagaaaaccaaacaccgtatgttctgacttataagtgggagctttactgagtatgcagaagcatacagagtgatataatgaactttagagatgcagaagggggtggctgggagggaaggaagggataaaaaaactacacattagtggccgggcatggtggctcatacctataatcccagcactttgggaggccaaagcgggcggatcacgagttcaggagttcgagaccaacctgaccaacatggtgaaaccctatctctactaaaaatacaaaaaaattagcctggagtggcagtgcatgtctgtcatcccagctactcaggaggctgaggcagaagaatcgcttgaactcaggaggcggaggttgcagtgagccgagattgcaccactgcactcgcgcccgggtgacagagtgaggctccgtctcaaaaaaaaaaaaaactaaaaaaataaataaataaataaaataaaataaaactacacattagggacaatgtacactacttgggtgatgggtgcactaaaatctgagaattcaccactgtataattcatccatgtgacaaaaaaaaaaaaccatttgtaccccaaaatgtattgaaataaaaaatttttgaaaaaagacatcagggaactttaagttgaagtcagctaacaatggagtcccatgtttcgcagtaatgggtctgctttagtagctccactgcacttaatcataggcagagaatagcccttaggaagtataaacctgatacaaaagtagtaacacatgtaaaaattttttgaagcccagcacctagggtcctcaattaaccttcctgtcctgggaagtctgtgaggttcattgttgggtcaccacactaacttttctatttttttaaattattttttctctcattttttcttcctatttcttcccaatcaacacactaacttttctaaagggcatttcaggttttttgctgaagaatcctccaatctcctaccccataaggtttaatcctagctgctggtttatggagtagggcaggagaagagagctgagagttccattattcaaacggcatattttcatttgatcccatcattcttagacctctatctcactcacatgtctctgtgtctgaaactccaaagtacaagagctattgcagtttaatttctccagaaaatagactcctaactgaaggagagtatcccagctgcgtgggatggcagaggggtcccagtgaccaactgttccatgtgttcatcttcaactgtctcccagttttcagctcctttctcacccccaccttcttccatacctgccaagttctaaagcactaagcaggtcagaagagtgaatgcattattttcactgatattcttctctgcaggcactctgttgttgtttcctcaacttctatcaagtcaatttgtattcttccagctatgagccttccaaaatttgtttaaatcactcacctgctgagatttcttcttatccattaatttcaatgatcagctatcatgtcttgtctaataaatatcatatccaaatgtaaaagtaggcccctgggtgcctattcttaacattttcttcacaattcaaactcaacttcacctattttggtgatttatgataaaaaattatgattttacttacaccaattatacccacagttttccaattttacatttgttattggattttgtcaggtgggagtactttaggagttttatacatgggaagaatatgggtttgtgagataggagcatgtaagagtgaacacaccaaatgatgtaatagttataaaaaaaatatcctgaggccccacacacatactgccttacttactagcttcacaagcaaaaaatgttttgactaaaatggggaacattctaattatgcacatttgcattttttaaagcacaataatactacgcttcaataatatttctactattctacaagatttaaaaataataattttatactcaaaaactgtgaattctaaaatagatcacatttgagattgctaacaacccaccctggtatttgagttagaaattccatcaatgtttttatttaaaatttttttgtaatgtactaatttctaaagctttataagcaccatgtggaaaatgtattaagaagcagcttcatagcagttgtggtcttcgtgccttgtccttcgttctttcttcactattatctttaagctttaacaccttggtttcttcctccagcctctaacacatgactttgtctcccagctctgtgcgtgttcattctctccaggctcaacagagagacacaaagtattttctcttctgcagttagcctcagcattgcccccacacacagttacagctggtgtggcccagaattcccagaataacccacttcattctccttctctatacctgcttcctatgagttgtgttttaggcatactatgctttgaaattatactataactcaggaagttaggatgtttcattgtggcaatctcatgggaataaggccagcataaaaataaattatcctggggagacgacaaaaacacattatagattttgcaaaaacgacagcaatcatgaagtaacctggaccattaacaagaagatatttgtaattatccacttataaatatacataccagagatccttgaaaagtataaaattgtactacaataactttaaggttccctcttattttactgactccaaaatgaactagatatctttaaaacagaagaacagactctctcattccatcacttccaattcactggactgttcataacttaatgttcttgatcttcccaaggagctgcttttatctgattatataaatcaatggtaatatactagaaaactgcagcctggaaagacaaagcaacgccacagttaaactgaaaattctactagatattaacaacaacgaaaatcatatacataaagctaattctattatcataaaagagctgttttgttttgtttctgacactaataacttcttagcattccaagcaataacatatttcacctacgatcttgttttaatttgctttttaaaggtcattttccaagagtagattgaaacaacagggtaagaataagaaatttcaagatactgtttacacacctgaaataaagtatacttaggtttttaaaaaagtccctcacctctatccaaagcagagagaaaattccattagctgcattttttttttttttttttttgagacaaagtctccctgtcgcccaggctggagtgcagtggcgcgatctctgctcactgcaggctccgcctgccaggttcacaccattctcctgcctcagcctcccgagcagctgggactacaggcgcccaccatcacgcccggctaattttttgtatttttagtagagacggggtttcaccgtgttagccaggatggtctcgatctatgacctcgtgatccgcccgcctcggcctcccaaagtgctgggattacaggcgtgagccaccgcgctcggcctgcatattatttttaaaccaatgattgctaacaaacacacaaaaaaaaagtaaaaaaaaaatcactccactgaacgcttacaaaagaaaaaacaggagaatacaatgtagttaagcacagctcctatatatatagtacttttcaatataggcaactgcaacaatgaaagaacacagccttctacattcttaaataccaaatgcccccttgtggacagcactgttactagatttgcatataaaatctgtttaaactaacttttctgtctgtgatttgaagctatgtacctatcaattgaccattctgatcttggagagaacacaaacccagtgagggctgtccacagaacacctcaggaggcagtctcagagattatagcattttaataacctcaatactttaaaaatatatacttacacgtgtcaatagtgctctagtgtcactaattttaatgactggttatcaggcattaaaaacaacatttctaagaattttcaaaaggcataaactaccacagtgagcccagtgggagcatgactaattgggtgtacagtgaggtaatgggtcccaggaagacccaaatagggctggatgtccatcaggcagcacagctaaaagaagaatctgaatcatggtaaagaaattagtatcacagtcaggaaaatggtgtggggcaacaggatgaagaaaagataagtaggtcaatgagtaataagactggaagtcagagagtgggacatgacatggaccacaacagagaataatagaggggagagtcttgcttctctgaagagccaggtgtgtgataaaaacaatggcccgatggtttaaaagaactaagacttaaaaccatctctttcttcaggcttctcttgcttttgtaatatgttcttctcctgtttgtcctatggcaagctgaaacatatgtctgaagggaatatagacaaacaggcaaagattaatatttcaaaaagccaattcatcaaaggattaatttgcagggagaccaatctacctacgattccaaatttactaaaaattcgctttaaggaaaatcattcatatatgtgaacttataacctgaaatatactctttttctaagaatattttcaataataatactaaatgctaaatgatttccgtaagttttgggttttcaacaaacatttattaaaatgttactaaataaaattatattcattagaacatattcaaggatttggatttcggcaaattggcttcctgtgaattggttttctacaaattgatcaagagtcttccagagaatgtttgagatgagattaagtattttcctaaataatgtttctctgtttctacaccttctcccccattcttttcaccaccagctagtcttgttagctttaggaacaggatccatctgactgactaagcatatgcactggtgagagatttccctgaaggatccaagctgcctgggtgtagtggaggacaagggggagggtactgataggaaaactagagaaagagaaaaataggggtcatcacttttatgactctgaatgagtcaaggaataggacttccactttgcaatacaattgactacagggatatggtggggcttgttgataagagccattacagtaacttatcacaagcaaggctgtattccacatctttctctgagggatatacatcccctatatctgttgatcttaagttgtgctctgtaatagagcctattgtgaggtctgccaaaaaaatacaaatgtccaggccttactccagacctaccaaatttctggggaaatcctcagaacgtatacttttaatatacattagtatacatacataatgtatataaaagtatacattaagcagcactattcacaatagcaaagacatggaatcaacccaaatgcccatcaatgatagattggataaaggaaatgtggtacatatacaccatggaataatatgcagccacaaaaaggaaagagatcatatcctttgcagggatatggatggagctgaaagccatttccctcagtaaactaatgcaggaacagaaaaccaaacaccccatgttctcacttataagtggggcctgaacattgagaacacatggacacagagaggggaacaacacacactggggcctgtcagggggtagggtgggggagtggagagcattaggaaaaatagctaatgcatgctggacttaatacctaggtgatgggttgataggtgcagcaaaccaccatggcacatgtttacctatgtaacaaacctgcacatcctgcacatgtaccccagaacttaaacattaaaattaaaaaagaatatacctttaatatatattaatatggctacaggtctttgctgaacatacctggaaattcttggaaggaatttcaggtaggcactaagtcccgttttggtgaatgcacatgttagagactagaaaatgtacacccaactagctcaagggaagtaaaggttctgcactttttattaagagggttaaatatcagctgggtgaggtggctcacgcctgtaatgggaggctgaggcaggcggatcacctgaggtcaggagttcagcctggccaacatggcaaaaccccatctccactaaaaatacaaaaattggctgagcgtggtggcaggcacctgtaatcccagctactcgggaggctgaggcaggagaatcgcttgaacccgggaagctgacgttgcagtgacccgagatcgtgccattgcactccagcctgggcaacagagcaagactccgtctcaaaaaaaaaaaaaaaaagatgttaaatatctaatgaattctattatagttttgagaaggtaccaaaagattcagaagattcacaacttatataacagcacagcttaataagtgaaaacagattgcacatctttgggccttatgcttatcccttccaagttgattggggttaatttcacaacagacttgttttaataaaatagtacttttcctttatcaagggaaaacagaacaggaactaacagagcttactatgtcaggcactatgttatttgttttatctatctctaataatcttcacagtaaccctgcatgagagtttaattaactcaatttcacagatgaggaaattaagcctcagagagatgaaataacttcctcagtgtcccatagtctgaatttgagccatgatggtctgattccaaaacctacgtttcgagggaaaataggttatactcagtacattttctcacccctactcttccactacacaccacatcacattttctcctatgtcctagcctctaattggcacttctttcttcgcttttgaataatttgcctgaactctggacaacgtgttttatcctctcctacagcagaattttctagaacattcttttcctgaacattcataaagccttccccttcttgacttctgtgataccattcttccagttgtccccccatcctttctcaatatttttccttctcaataatattccctaaattgcctcctaacactttaaatgtcagcattccccagggtttcaacctcaattctatttttcagactgcatatttttcctgagcaatcccttgtagtttcatgactgcatgtgacacttatgacttggtgatctctgttttcagagaagcaactttccataatccaaaactattttcagttgcttccaaaccactatcacctgtgtaatacacacaaacaaaactaaacttaccatttcctaacatcctaatttcaatttctattatcctgttcattgtaatccatgaagttattcaagccaaaactctcaattgtcattaaattctcttgcagtcttacccaatatctaagtattcatgaaatcctcattcctaaatagatctttaatctgtctcctctgctccatccccatataatactgcccaagctaaaaaaaaacccaccttcccttacctagactacgacaaaagcatcctagctggtttctctgattcaattctaacccaccctgaggaatcctttcttcatggtggttggggtgggggtgggaggatctttcaacctctatataaaatatttcaatagcttcttatcatatacaaaaaaaattcacactccctaccatgaataccaaaccctttattatttagcccctgcatattatttccagcttcatcgctcatcatccctcttatttattccagacatactgaactaactgtagagctggggtgtctttagacagactgacccagaaatactttataataatttgaaaatctacctatcttatgattttaaaattccacttctaagaacatgtatacttgaagcagtggttctcaaacttttttattagaattacctgaagagttaataaaaatatagaggtggcaagtaggttgaaggacaggacttggcctttgtatttttatgaagtgccctaggtgattccataacctaccaaagtttatggatcactgccttaaagcagaggctggcaaactataacctaaagatcaaattcagcttctgcctgtttttgtaaaccaagattttttagaatacagcccaccaattaggtgttgtctatggctccctttatactacagcagcagggttgaatagctacaacaaagatcagagatcatacaactgcaatgctgaaaatatttactatttatccatctacagaaaagtttgctaagcctagaggaacactttgcactgaaagacacatataaagatattcactgtggcaatgcttgtcatagtgagattttgaaaaattcatgatgtacgtaaataggctaatttacgtaattcatgatgtacgtaaatatactaaggatatacacatataatgaaatactatacaactgataaaatttactagatctttattaacatgaatggaattaaataatgagtaaaagaatgatatgcacagtatgatactttttatatgcatttttatacatacaacatgtagagagatattaaaaataaactgaaataatatataccaaattcatggtagtccttgcctataaaaaggaaacaaaaagaagacagggaggagaataaaagggatctcaactctataaattgttttcattaaaacatttaaagtcaaaaagggacaaagatctgaagatttataaatactagaatatggagttgtttgccataatacactctgtgggtttcaactcaaaattaaaaccagaaacaacctaaaatacccagttatagggaaaagtaattgaacattcacattccaacacaatggaacataatatatcattgaaaaatgcacatgaagagaacataacatatgaaataattgacttaattaccccaattagcataggattcaaaactgtccatgcggtaaggttataattatattttaaacaacaataaaaactagctgtaatcctttttcactttgtttgttggctgacttatttatttggttgttctttttaatcaatatgtatgcatacaaaaattactaaaaacagaactgtctacagtggatatgtttgattttatgatattctttttctataccttttattttccaaataatatcagctgaatacatgttgaacgaatatgtatgaatgaattgaatgaatacataaaatgaaatgccttcactttaaatgactttgtgtgtggcagatacagccaactgtacgctcacaatccactcttctcttcttcctgtatattcagtaaaacactatatttcctagcctgtcatgcacacgaaggtgcccatatgatacagttctaactcccaatgaaatgtcaaggggaattactgggtgcagcatcttagaaagctctttgaaggggagtagacgtgaccggctttcacctttaccatttctccttcacctatgtctttttttgaatgataacgtgaagcagctgagaaggcgaagcagccatctttaaacacgaggacaaaagccactcacaaatggatggcagagtagaaacttaggggaagcctggattcctgaaggcattatacagccactgcaccacccctggactgcaaacctcatactttctgtcacatgaggaaaaaaaagaaaagagaaaaaaaaaactttacttgtttaaacctttctcttacattctgccaaatgcaacccttgatacatcatgctaaaataaaattttaataaattaccccactgaaagacacttagaagataatataacgtatcttaccttcagaggagaaaagtgaacctcaagaaaaaaaaaagttggaggcaccaacctattatcagaacaaagactaaagcttcactctcacttatgtgaataattttttctaaaatattaaaatcacactgaactttacatttcaaaatggctgaaacaggcggggtgtggtgacttatacctgtcatcccagcactttgggaggcgaggcaggtggattgcttgagctcaggagttcgagaccagcctgggacacacggtgaaacctcgtctctactaaaaatacaataattagccaggcatggtggcatgagcctgtagtcccagctattcaggaggctgaggtgagaggactgcttgagctcagcaggcaaaggctgtagtgagccaagattgaaccactacactccagcctgggtgacagagtgagaccctccctcaaaaaaaaaagaaatgctgaatggtaaattttaagttatgtatatttaccacaataaaagagagataaaattatattaaaatgaagtccactttaatgatatagtttaaagataacattttatacatttttgtcaaataacatataaaatattacacatatactagtcaacaacgagtgcccatccttttgctactcataagcaaatctgtagtttgaaattattcaaaattagtattcaaactaacacatcaatttcataagtatgtctgtacagattactcctaaacactaaacaatccacaacaaggataaagaatcgggaaatttacagatggtatttgaattcatactctatcccacaaaagcaactaatttaagcccttttccctaattgtcaatttaacaggaagccaaaaatatgtctgcattacacaattatatgtctgaatttcacaaatattattctttatatcaaagaataagacttagttttgtccttagctaagagggtctcttgactggatataggattgttggatcccaatgctttttgcttagtaattggacacttctatcgctgactccttgattagatttctaatctctgctgctcagacacacccctcttggattcatgagtaccaaacactcatgaaagcacctgtccagagaatagagaggaccagttctgtttatactgaactttcattctctttcctttctgcttggtctgtggtcccactcttcgttgtgctaatatttcttcagtcctttactgtggagaaatataattctctgtctctggatctaaattattaaatctcttagagaaccacattttcttcaaaaataacacaaatacatcaaggaaaataaatgtattttttccaacatgaatatgttccagagtctcaggtagtagttagaaaaccaattaaacgctccttagatatgccctaaggtattttactaagtcataccagcacttgttgctactctccacaagggtggtgatacccactctgttgagctaggactgagcctcagttatcaagaagcaggtagacagaatattttatatccagtaggtagtaataaaattctacctgcaattaagaaaaggcactaagcttaacatagccctagcaactatttctaaatgccacaagagggcgatataactctatgacagcacatgggaaaacaatttttcgagttagaaaaattcctgactttccaagatatggaaataaaggcatgtctgggttgaaagtaacaagcgtgcaaaaggacttatttctcctcaattcattattagcaaaaacacagtatttgtctatatctttctctgaaggttggcggtgattcaaaaagcaatatctatacatgctctgctcttcaggacacctgtgaatatagctggcaacttagtgctccacctatagctactcaaaaattatttgttgtccttcaaacagatcccttgaacaaaacagtttatttggaccttgcgctagtcttcaaacttctctttgaaatacgtctggaaaaaatagacataatttccttcaattattctttgtgtttaatcacatttctactcaccactggcattcgttcatagacacgaatagaagatagtctatctacaataaatcaaatatgagcacttaatgttttatcagttttaactcaaattataaaatgtacatatgattggttttgtacctgaagagtttccatggattttttccactttctccttgagataaacaatttgcttttctagttcatcatttaattcaagttgtgtctcataacgggttttccattcactacctgagtaaaaacagggagaaacaatcaagatcaccccaccacctctcatttattcattaaaataacattatgagcttgatcttactctattactatatttgactttattggcaatacagatcaactagaaggaaatagttattaagtctgtatttctgttagtaagattttccagactgcaagaattagactcacactcaggctaccaaacagccaaaccttatcacaactactgcaattcctcttcttccctacttcccacctgcttttttcttttacttcttgtgcatccttacaatgaattcaattagagggaatatcaggacatgtttctttccttggaacttgaaatacccatatatataatatccatatatttcatatatgatatttcatatacatatccataaatatatatatttcaagttccaaggaaacttgaaatacatatttatatatttatacattttatatatgtttatgtgtatataaaatatcctaaacattactaacctatccaatgtcatgttcattttttttcctttgaaagcaattctgaagtctgctgaataactatcacttacgtgtctgccgtgtgtaaagcacacaatgcttcacatacattaagtaatttaatcctcattttagaaatgtagtcacctattttacaaagatgaggaaaccaaggctcaaagatgtcaatgtcaaataacattcttaagatgacagagctaataaataagggaaccgggtttttaatccagttttatctgcctttgaaatcatatcctcttaactcctaagctgaaggaacaatgtacatttagctatcttctcaggcattttctcttaaccttaagcagttttctttcactaaacccttttagctattaaagtcaaagcattttccttatgtctggggaaaaagaagaatacagcctaaaattaaaaggtctttgttcagattcaaagcccaaagctaactttttcgagtctttaaagtcaggctttgtagagggcaaaaagatggcttctttttcaactttaaatgctcttcacaggtctgaaataactgctgctacataacagttagtggaagagttaaggagaaagagtattagcacataccactaccaacctcctcagccctgacacaggtctcccttacaccctcatctctatgcaaatgcggtctaccaaaggggatggaaccccctcccatactgaaactgaaagtcattaacccaaaagctttggaaaggtacaagaagaaaggagaagccctgaaagactaaacatttacccaaaagatacagtagagctcaactgtatggaatcatctttataacttgctacctaaagtctccctttgtcatggtatcccctttcctaacatggtaacggattcttcagagcaagatgagaatggttaccaaaaaattaaaaatgcaatttatttttggcacatctgagtacagtttataaattttgacaccattttatttaaaaatattattgacttttaagtcaatcatcaaatttaattatcaaatatagacaagccagccaggcacggtggctcacacctgtaatcccaccattttgggaggctgaggctggtggatcacttgaggtcaggagttcaagactagcctggccaatgtggtgaaaccccgtctctactaaagaatacaaaaattagccaggcatggtggcaggtgcctgtaatcccagctactcaggaggctgaggcagaagaattgcttgaacccgggaggcagaggttgcagtgagctgagattgtgccactgcactctaacctgggtgacatagctagtctgcatctcaaaaaaataaaaatttttctcaaaaaaataaaataagatagatagatagatagatagatagatagatagatacatagatacatagatacatagatacatagatagatagaccgacctattagtatacagtcgtaaccaaatggaatccggctgcttgccacttacagagtccaattaataagagcaaggtctggcataaagtggctttattaaccccaacatcaacatgggacaacacaaaagacccaagatagacaccaaaacaagacacacagaccttgtaaccagcacaactcctgcatgcctcccatattaagtttccctttgaaagccccctgccttttccctagaaattggacatggttattttggatgggaatctggccacttgtccattattagttttggtcaatgaagtcactttctctctactggacctcgcttttgttaattgaactatgcaatcagcacttacaattgctggttacaattttagtgtcccgtatggtgagtgctgtatgctccagggcctgagcctgccagtctggtttctatcagatggggcatagggccacctgtgaatactagttgctgatggctagctgacccatggctaggatattagggaatttcccagcagctgccaagactcttttgtcttagggatcctctcttttcttcctgctatggtgtctgctaccttcaatgcttcactggtgcaaagaaagtgacctctggagaagctgagaaactatggaactaggtgcattagtcagagtgtacccaaccaccttctgcctcttttggggtgtcgctggggctctgctttatttagacttggctgccagtgaaactatatgagcattttatgcattggttttgtttgtatttgctgcacccttgggcctttgctcagttctgactcagttgcctgggggagccatttgaaactgaaatgagggatttcggagtctacacagccccttaaccagggatttgtttggatgcacaccacctgtttgtccgtgtgtgagatctttgtgcaccctgatctctttgtctctctttctctctctctttccccttttttccaacttcatcatcctgattatctcagaagccatctacagccctactcttctcagccaaaaccacccttcgctccctctggctggaaacagtttaccttgactggtgacttgaggaaatgggagggattcatcccacacccttcagttctagggtgctgaggctctccctaagaggagataaacaagagaggtaggggtactgtgcagtggctggaaggctcataaacctcccttccttcttttctctttcctcttcctgcccataaaacctgacctcctttctcctctccactcctttctttttctcttttcctgttcaaaccaggaaaccagtactgaagagaaaaaacaattttcaacatcctggcccctgattttgtcatcctctttgggactgcagctgattacatatggtgcatttttgtgtacattttaaactgacgggcaaattacagcaagaaaaatttagagctcaaatagttaacctgaagctatagagttaagtagagtcttctaaagctatcttccctcttcccctcttttctgcctgctttaaatctgctgttactaagctgctggtgctaggactcatttatgatctaactagaatgtaaacactggaaagttgtttgaaactgaaaataaaaaataacaagggtaaaagcggtttaaaaaaactgccatagagactcctttacccaaaattttggttcacaaatttccttggattacctattagggcaaatgaagtttggccatatgaacaggttccaattttgtcagaaaaagaacttgaagccagctatcttttgtaggtctgtgagtttgtaatgctgtctcatggctggagttccaaggtaaaagctattggttatttctttgtgcatgtatgtatacatgtttagatatatttatgtaatattcatgtattatgttctgcgttgtgtctagcatgttatcaaactggcttataagtaaatgagtactcaaaaattaagtccaaatgcttttcaagtgcatgtgaatttttaataaataaaagtggttttaaaattattgataaaaatagaaaggtcttcagaattgtccccatacatttttgtctaagtggttttatatttgtatcagtgtgtatacaaaggtgtcaagggttgacataaaggttctaagactttaaactcaaccaaaaacagaataatctttgtgtatttttttttgacaaataagactaacttgttagttcaatgaaacagctaaatcttcagagtcatcagcaaatacatttaattttaaggttcttaattaggtgctcaccatttagtgttcagattttaaaaatggttaatagggaaataactttattatttatttttaatttttttttttgagatggagtctcgctctgtcacccaggctagagtgcagtggcgcaatcttggctcactgcaagctccacctccctgattcacgccattcttctgcctcagcctcccgagtagctgggactacaggcgcccatcaccatgcctggctaatttttctgtatttttttagtagagacagggtttcaccatgttagccaccaggatggtctcgatcttctgacctcattatccgcccgccgcagcctcccaaagtgctgggattacaggcgtgagccaccgtgcccgacccggaaataactttaaataatgattagttttgtgtaatatctcagttttcagaagtaatctagataaactattaagaaatggaaaaggtgaatacatgtaaatgagataaatgcttgtaagtggactttttgtgtaagttaaaatcttaaaattattttgaattaaataatagatgctccaatccaatagataataatttgatttctgggacatttccaattaagaaaagattatgatatgggaaaacatatttctaaaattgtagaatggtttcatccagaaaatcctaacatctgataaacagttcaggatttcttgcttcctaagttttcactaaaatttaaggttactaagaattctaatatataattctgcaagttgtgttctcattttttaaaaaagagtaatttaagtaattcaaaggttatttaaaagttatttctaaaagaaggtaaaaaagaatcagtgagtaggggagagagatataaagaaagttgtggatacaaaaatgtatttataataaaaaagttataaaacaagcaaataattttacatgagaaagattttatatagtaaattcttatcctaaaataaaatggctagttattcagaaaacagaaaattttaggacaagtcagaaagtccaagcatgtaataaatggtctatgtaagttatgataaggttcataaaaggaaaattacaaaagctattttatatattaagttggctataattagaagggaattatttttaatagtctttctaagattgatcccctatcttaaaacaaggttttcttaaggtattacttttctcttaataaaattacaagagatttttaaaattttagaaactgtttcttttaaaagcttctcagaatcatatctcagaagttcaactattgctgtctcactgctttcagctttttctccccctgagaaggtctgagatgacagctctctccttcagcttctaaattagcttctgtaacttttttcctctggttccactgttgtggcctgatgctaaaatgttttatcttaaaggtctagaaaagcaatattttccttcagtataatttgattctgtactcttggctttcttgatagatgtaaatttttcaatgtaatcaagaaacttctcatgcagttactaagaactatgtattcctctgctatactcataaccctgaacacattcttcctatgtctgattaaattcaagaatatttttcatcaggtttaacttccaggttgtctaaataggcttcctataaggaaaagtagtcacactgcaggtttttctttgcctttctggtaactggcgtaagaaacaacattttactttttatcaaaataattcatatgttgtcttcattagatttttaactgcttagaaaaactgagacctaaaaggctgaaagttgttatatgcatgtaaccttctgtattgcctttaagtctttcaataatcattttggttaaattagtaactattggtttacaatgacctgtggatctgttttaatcaaatgttttgagccctttaacatttttaagaaacatcttcaaaattgaaacaaaaattaagtctctggcttattgctggtgtttatcaaagctataaaagttaatcactgcaaggttatagaatctttttacagcttccagtcaagtcatagactccagtgtcaccacctccagccccttaaaaaaaaggtccttatcaggtgttattaactaatccttgtgctatgaagttacagggctttgactcctgggtacacatatctcatctaaagaaggcagtgactcctgccagtatctgacagcaaatctaagttaaccgaagccccatttttagatctgggcaaagatgacaatcatagtaaactactttcatgagacacagggacacgcctgtaccacaaaaaaattaagattctcttaataattttgcctctatctaaaataatataatttattctgtgcctaaataaatagatactaaataatttaaatgtttaaatttagtgcctaaattgacactaaataatttaaatgtttagctacctataagtttcctttcctgtaactgtcagaactaggcagggcttattacctttttgtttgaaacactgctaatactttacatttttttttacctccagaatttgaaactattgaatccctccaggcccaggggctatcgcagaagtgtatcattgtaagggccagattttgagggataaaattaattaagaccctccaaatcaaggacagacacacagatgcctaaacagctgaacaatatgcttgtgttttgtacagctaattgctataagtcaagattacagtatctcaatgcagagaatttatagataactcaactttataatcttattttttgagttttggtttttggctcttatgttgcctaaaaggggttttaaagattactgaatacctgctcacctccactcccatctggcctaaaacgtttaattggatttaagtctttgactctaagttccttggcaataggggtcccactgagaggcacgatggaccaggggcaagtagccacaccatcccagaacttaagttaataaaagcttagctatggataccacctctgcataccttgaccaaaaaagggggaatataaactaaaaaaaaaaaaaatcctaagccccctcaacagactgaatgtatccacctcttggccaaagggaatcccaaagaaacctgacaaactagttcaggccattatgagaagtggagggttggacatgccacactataccttcccccaatttggagtttaggcacaaatgaccagcattaacattaaaatagagatcacataagactgacaagacagactctgtagcaataagatacacactgttatgtttcacttactaacaaagtctctcagaagctcagcaaacatgtgttaatgctgcaaagctttcccaaatttattttattctagagtttcctgtatgaaatctcttatgttaaataagtaagaatttggactaaacagttatgcctttatagttatagtcttctgttatctcttcatacaggtcctcatatttctggtcaggaatattgtcagatcttttatggtttcggttggaattgtgggtgggatcatttaaaaaccctattttctaactggttattgctggcatttgtttttttaaataaatatttatttcatgattgtatccaactattttctaattctttattaatatactaatctttataactgtatcacttcctctctaatagctataactcatttctatttcatattttattgcttaattagaactttcaaaaactatattgcattttaataatggcagcaggcagctttggtattttttcccccaagaatggaaatgcctctactatttcattgttaagtattatgctagtttgagataaatagaagtattcttttccttgttttgaaaaacaaatggaattttatttttaaaattttagcatttactgaggtgatttaaaaaaatatattggatttattaatatattacctactagccaaaggtatttgggcatagaaaccagcctataaaagactcaaaggagaaatccaggatgaagatgtaaacttgtgtgttgtcaataagtcttctttttttttttttttttggatggagtctcgttcttgtcatccaggctggagtgcaatggtgcaatctttgctcactgcaacctctacctcccggttcaatcgattctcctgcctcagcctccagagtagctgggattacaggcacccaccaccacacctgactaatttttcttttgttatttttagtacagacacagtttcaccatgttggccaggctggtctcgaacttctgacctcaggtgatctgcctgccttggcctcccaaagtgctgggattacaggtgtgaactgccgcacctggcctccatttttcaatctataaaacggaggtaatgatattattttcaaagggtagttgtgaggtttcaatttttttaaaaaacgtacttaaagccctacacaaatactaattcttcttgcttaaaaaaaaagtcacctgaacattttctttaccattttcttattactaaactttgttgtgaaattcaaattaaaacataaaaccaaattttctacatacagtttcctatgaatcctaaaaggcttcaagaggtgactttgagaatataaagctctttggagttggctgtgtttaccacctgcctaaaaactaatccagtgacaagcaagatcaaacaataagcagatgagaaagtagaaataaaaactactcttttgaaggcttttgctgtaaatggggcagggacaggggatgctagctgaaggggaaaagtggggccaaaagaagcctgtcatttgttgtttagataaaataaattcagcatgttggtctgctgttgggaatgatccagtagagcagggaaaacagacagtgtagggaagagagggccatcactacagtgatatccttgagtaggtgcaagtaggtaggatctactccacaaagggaggagataacctgagacaagaataaggacagatcattcatagaaacaagagggaagaggatgtgcaagggtgcaggtagatgggtagctctgttggtagaaacaggtagaagtcctcttctgattgcttctcttttttctttgaaagaagagggtaagctcattacctgagagtgtgattgagtggagaggtggtagaggtttgagaagaaagcagaaagggtgaaaaaattatctgaacagtgaatgtacccctatttgtcacatgtgcgcatatttccagtaataaattccttttaaaacacctttaatattgccccactgccttcaggataaacgtaaattcattagcatcatgcaatcttcttgatttatctccttcataaactttaacctcatctcctaatgcattctcattatgacctatgttccatttttatcaattacttagcatattccccaaatggctttatgtttaatgctcctgtggcagactgtattttccaaagatgactgccaataatatatcccatcccatgtgttgctctgtaatgtgaccttaaaagcagtctacctctccagtcccttgaatctgtgactactatgaccaacagaatacagtggatatacccctgtgccagttctgggagtagcccttgactggcctggcagtctctacttatgtcttttggaatgcttgctcttgggatacatcctcttggaacctaaccaccatgctgtgagaagaaaaaggtacaagaggcatttctgacaggcagccctagctgagcttccagtcaaaagccagtgtcagatgttagccatgtgaatgagtcatcacggaatgaccagctcacttgaatcttcagtatacctgattgcaaccagagaccccaatcaagaaccatccaggtgaaccaacccagttaatccacagaattataagagtttgttgttttaagctcctaaattatagggtgatttgctatgcagcaaaagacaagcagaagtgttttgagtgtgatgtggtagatggaagttgtattatcatttactgaaggcatggtaaatagatgatctaggatcaagtcatggctctgccactacctggctatattaccttagaagttatttgaattcctgaatttcattcttccatatatggggataataataactacctcacctgacacagtccctggctttaaaggagtaaatgtttctgcccttcaccttaggccttacttttggcccactaaggaaagaactttctctcctatcattctgacgttttctctttatacccacatactagctccttcttttgagaactgctacaacttgttgagccacattttactactgggcatagttattgcatgtgtacctgtgagcatgccttctgtttttcctgtaactgggtacatgaggacgttccagttaccctgccaacgcagctacttgataagtacactgagagcctgcccccagagactgaggttatatctaagatatagatatggagatagaggaagctacttcagccttgggacaaagtagtattctgcaaccaagctttaacaaagcactgggtacttatagaaagtggcattttatttcccatatggccactattcctttttgttcatggctccccaattgaggaagagtataaatgtagcaggacgagccacagacaaaacccctcagacaccaagttaaagaaggtaaggctttattcggccgggagcatcagcaagactcacatctcaaaaaaatgagctccccgagtaagcaattcctgtccctcttaagggtttagaactctaagggggtctgcatgagagggttgagattgattgagcaagcagggggtacgtgactgggggctccatgcaccagtaattagaacagaacagaacaggacagggattttcacagtgcttttccatacaatgtctgtaatctatagataacataaccgattaggttgggggtcaatctttaactaccaggcccagggtgtggtgctgggctgtctgcctgtggatttcatttctgccttttagtttttatttcttctttctctggaggcagaaattgggcataagacaatatgaggggtggtctcctcccttataaatgcccaccctgataatcctaataaagtcctcctgttctttagcattcagttcaaacaatgcctgttctggaaagcctgtctttattaactcacccgaattctgttaggtttcccttccctaagttttcatttatccttacatagaacttatatgacttctcatatccataatctgatttgatactttctcccaatagtcaatgaacctctttagaacagggaaaacaaaggtcttccatttaaagtgttgacatatggcagggtcatatcttgcatacattacaaattttaaggatatatgagtgtgtaggtacacagcatcctccacaccaaacacacattcttccaacaacaatagctaaaacctagatacggattttaaacatatcccaaacctagaagttaagatataaagagtgtaacttgaggtgaatagaaaactggtgatatttatttaataaagaaataatatattgatgtcatgtaacaaagtttttgctaattaatgaacattttgaacttgaaaggtagaaaaataattaaatagtaataggtttgatattctgaagtatcagttttaaagcctctatcataaactatcattaatgtggccaaaaagcaatactgaaatgttggtactattattcaatatatggaatttaatgcaccatagatatcctggtaaaatgaacaataattatacaggagtcacaaatataagtatttacttatataccttcattgtcagtattgagtttggcttccagttccgtaatcttgtgtcttagttcaaatattgagagttgcactgcatccctgttatttaaaatatttttgttgattataattcaattaaaaataacatcagaaaaataatacatagtaacccactactacttcaggaacaatttactatgacacattatttactgaaggactggttaagaaataagactcaggcaaaggaaggcttccaattagtcagttctaggactcaaatatgcactaaagctcaaagacccccaggcaaccattagaaatcttttatttatttttatttatttttttgagacagaatctcgctctgtcgcccaggctggagtgcagtggtgcaaactcggctcactgcaacctccgcctcccgggttcaagcaattctcctgcctcagcctcctgaatagctgggattacaggcatgcgccaccaagccctgctaatttttttgtatttttagaagagacagggtttcaccatattggccaggctggtctcgaactcctaaccttgtgatccgcccagcctcggcctcccaaagtgctgggattacaggcgtgagccaccaggcccggcccttggaaatcctttatttttaacttaaatatcatcctaaagaagttagttacctggtttttcagaaccaagcaaattaggcactgcacattattacagaaaggcatacctagggcaatacataacagctgacaaactgaaacaaagagaaaaaaacaaacactaatttaaaaggttagctatttagggcatcagtaaatagaacattatcatatgacagggccatttattcaataaatatttttgagtgcctattatgttcaaggcattgtattaaatacggaagaattcagtgaacagtgaacagaaaaatagcaatagcggcagcaaagttccactggatgcgtatcacaagccaatgctaagttctttatagtgcatttcattccaacctgggaacaacagcaggaggtatgagatgactatttgtataccagtcttagagctgagaaaactgaggattaaagaggttaattaacttgtctaagattgcatagttactgagtgacaagagatggagtttgtgtttttgcaggactgtcctcaagtacttgctcttattctctacttcctcagaatacacagaacctgtcctcagaacgcgtgtagtttggtagcaaaacaagaaatagacaggcaattaaaatactgtgactggagctacaatagaggaaaacccagaaccctatctaggcacaaaggagagtccaattctcacgggacttgtggatggagttgggagtatgtccaaaaaatactttaaatgtttcaaaaatttaacacgaagtacgaatactgtttttaaaaagcataaaggaggagtaacagttttactaaatgtcattttatgaagttccccttaaagggatgaaagaaaaaaaaaaccccgtataactaaataaaatctttggaattttaagcagaaaacctggatttatggagacatcaaaaccaaacacaacttttggcattacagtatatgggcaaaatacacgccatatgattggatccttaagggcagcacatcctacccggaaagctgcctacttaacaataccaaaggcttactcaaagaggcacgtgaatctttcgcatggaatacttttggaacccagaccgaagtgcccaggggttaatcacggcgccggtcttacagcaccctcagcggcttcagccctgagactctgcaggtgaaggctcggggggtgtggacgggaccccacaccgcgccgcccgccgactcacttcttgcggacttcttccagcaactgctgtttcaggcggttggtgctcacaccgtcgaagttgtagtttctctcttccttcatagtgtcaggccagagacctcccgcgtctttcccctcagcaccttagagcacaagacattaagggccacccagaagccagtacggcacgaggcggtgaaccccaaccgccccccggtcgcacctcccgcgcctgccc

SEQ ID NO: 1812 - DNA, 67082 bp, Homo sapiens; identical to SEQ ID NO: 1811

SEQ ID NO: 1813 - DNA, 67082 bp, Homo sapiens; identical to SEQ ID NO: 1811

SEQ ID NO: 1814 - DNA, 4460 bp, Homo sapiens
acacagtctgggggcccccgaagccccctcatctttattccagttcctcagatgtggcagttcccccagcttccctggaaacaagtatcagacaaaggtggtggcagacacaggacagggccctgggtggggcttgctggcgctaaaaggatttctcagcaggctcagggtctcccgccccgaatgacccttctggccacttcaagctactcctctgctgcccggcttccctctgcctctggttcccctggctgagcagggccttcctgggcttgaccctggcccccttcagcagttgtctcagactgttcccgaatgtccctggggctggctttgaccccagcatccccatctccctggcacccttgctcctcccctctgcttcttgcctctgactgcccactgccctcctcctctgtcacagccccctgggtctcaggccactccgcccggcggtagacgaggtagccagtggtgggcagcctgtgggccagggccccagggggcaggcggtggtagccctgctccttgtacaggaagaggccaaaagtgttgggctgggtcactcggaacttggtggcacagagctggttcagggtggcaatcgaggcttctgggggcacggccagggtcttggaggtgcagccactgctgggatcctgataggctactcggaggaggtgctatgcaggaggagaagcaaaaacaagtactcagccccggctggcatgcatctggctccaaagctgagacatcagctttctgggctgtgcagggacagggtgggtaggtggagatccagtgggagaaccaagcggcaaaagctctatgtgctccaggggtcggcttgtgggccacagccgcaggtgcaaggacagcccagtggggcgctcacaagcctgagatgaagatttgatagtgagtaatttgtgccccaagcactctcctgcattaactcatttaatcttcacctcaaccccaggaggtaggtcctattaccccattttactgatgagaaaactgaggcacgaagtagttaagtaactcgcccaagtccccacaacccagtggcagagccaggattagaacccaggatctgtctacagagtctggactcttcaccaaggacaggaaggtgaaaggcggggatggcgtctggctctgaggacacggtggagggcctgttacctggaagcagtgggtggcaggcaggcggcgctgctcccagaggctgagggagcgccgtagctcctgcacggggctcagtgggagggtgtgggcctgacccaggccactcagcagggccaggctggcagagaggctggtcaggtagtagccacctgggacacagggtggaagaacacggctcaggctgggtgtggggcaccccatcccctctccccttccctgcttattcagggcccacccagacagggaggtgggtgggggtccctcaccctctccagtaagcaggctgggctccagcagctccgacatgtactcggcctccagcagcagctcaggaaggtcacagtgggccaagacgaggctcagcagaggcaggaactcgtcggcacccgcgccctcccctgtggggacatggtgagaggaagaagcttcaggtacagtccttgctttaggcagtgacccctccccatgccctagcaaccattgaggggcttcagaaaggatgcgctcctctctaggcctcagtttcgccatctgcaagaggggagggtgggctcattctctcctgcagggctgttctagggtcctggggacctgccgctggggggcccgcctctgactcaaaggggcagggcagggtgaggtggtggcagggacataccttcctgggtcctcagggccatgtagagcagcttgcaggcctgcaggagccgcttgacctgggcgctgggtgagtaggtgcggagcagctgcagcagcttctggcgcacttgctccaactctactggggagggcaggctcaggtgggacccgaaggctccggggccctgggcccgggccaggcggaggccctcagctaggcggcccagggagccgtctgcggcaagccggcgccgcaggcgggctgccaggatgggccggagaggcttgagcacagagcaatgcaatgacttctccaggacatgttctgccggagggacagggaggggtcaggggaagactgggggtatggggggcagaggcaaggggagaagggagcaggggtagaatcggggaggagaggcaaggaaagcaggaggaggtagcctgggtgagacggaagagttgggggagagaggggatggaactctctcgaacagtggtaagacaagatggatttgtaaagcagcagaacagaatcagacaggctggcgctgtggaggggagcagagggtcggatggggcagtgctggagctatggagagacggagcctcacccagcctcttaggcgacagcagcttctcagggcccagctccgcactcagcatggcccgggcccggctcagcgcctgacggatgccctgcagctcctggggctcgggcccagcccgcacctgggtcagtaggtcctgcaccagctggcccgcggctgtgtgtcggtcctgcatcagtgctgccgcagcccggcccacctgccgctccggtgccagtagggagcagaaggcggcgctcatggaccgaagcagaggtcgtcggcggcccaggtggggtgaggtcgctgggctcccccgggaccctggcaccccctcctcctcggagctgctgggggagccgcagtccacctcttggagggagggcataggcggaaggctagggccactgcctgctggcacgcggtaccccactgagctctccctccgtagcagctggcaagggggcagccgctctgtctggctggggactgcccctggcagcacggggacggggggaggtggcacggcaggtggagacagggggctggaggtctctgtggacacgcgcactttgaagcttctcttgaatttctcccgcttggtgggccctaggtcccccgggaacagggggttgaagaagcacaaggcggctccggtgccctggtccagctcttgaggggaccgggccttcagctggggcaacactgggcctccagccgggccccgctgagccttgatgttgagggaggagctccagaactctagggaacaagaaaccgactggggcctccgggactggttaggggaagtttcccaaccaaggcaaggcaggggcttcgggcggtgtgctgcgagccttgccttcccctcggcctcagcttgttcatctgtgcaatgggtggcaggaagcccttaccaatgcccagatgggagatggcctccagctctttgtgagtggctgcgtggtggatggctctggggagctgcagcgggaggagaaggatgtccctgaggccagagaggggagcagaagggagtgagggccgaagagggcgggaaggatgggctgtcccaaggagcagggcccgtggacaccaggcaccctgcgggcagactcaccgggtgtggcagtaggcacagatgagctggactaggtctgggaacatgagctccgagccctccaaggagacgcctgagagaggagggaagtgaggtgcttctctggggaacctccctgcttccagccccttcccgccaggccagcccctcaccgccagggctctccaggatgtagtggctggagacgaaggaggggccactggcttcaggcaaccgcatgcacagggcctggcactggcgggtgttagatttccgcacgaggaacgtctgcaagtggatagggctcaggcagctcaggaccttggcgtcccatccctctccctcccacccctggctggccagtccctggagtgtggggcaagactcacccccgggggctcggtcctcagcatgtgcagtgcggccgctgcgttggcttgcagctgcagccacacgggccgggtgagcagcaggcgctcccgcaggctcacaacgcgccccggccgctgcggcccgcctgcctgcccgccgctggcattgggcacgtcatacagtgggtcctgggctggcctgggggcaggcacccagatctgagcagggagccaggggctgggacccttgctctcctcttccccactcccgggtttcccactttctctatccccggataggccctcctctcgcagcccctccctgccccacctggctgccctgccaacttcactaacttttctctcgccaggtgcccagtagtgaagctggacgggctgggggctccaggagagcccgcgcctgactctccagggctttccatggctgggagctccttcgcttcaggaagagaatccagtcccaaggcaaggcacgcacatccccagtgagtaacacttcctgagggcggtccgcctgtcacacccgccagttaactcttgtgtgtccac

SEQ ID NO: 1815 - DNA, 28396 bp, Homo sapiens
cggagattaacgcaaacccggaagcggatcgggtggagtgaaggtcacgtcgccatggtgagttttgctctgtgttgcattaagtctccgcttcccaggtccccgccgcttctgtccctgggacgtggggtccccacagacctggaaattctcgcccgtcttccttcgcccagagcaaattgagacagcccagtgagaggccgggtgtcgcttcctttcgggtttaaagtcgtctggaggctggtcccgtcccgggtctgtctgctatagggcaatgtatacactttctattgcgtagtttttctgctcaaaaccttcttctgactcttccctcctcgcgctatttaaagtcttcacccacgaggtggattcttgcccggggcgcacctcccagccacccctcgtcggcccctggagcgtcgcgccgcagccccagtcccagggaggccgcgtcctctgcctggtcctgggatcttgcagaccccatccttctcccaaggcgccgtcccccctcctcccacctccctactcgtgccagagcctgcggctccccaggtctctcctccgcagtcaccgcttccattgaacccacactgggaaggacgcagggccctgtcctgtgacatggggtcttcttgcctgccgagctccagcccttggaaaacgcgctcctccgggatgcaggcgtcttactccaaaccctcctgcgattgtgtgggccgaagggatcaggagacagacagcagtagaaaacctgagacagagaaagaataagaaaggcccataacagatggcaaaatagaggattggtgagggatatgccaagatatggtgaaagtggaaaaagaaagcaacaaaatacctagaaaagcaggtggagaaaagcaactggagaaatgtagagaaaagctagatgtacacagagatgaaggacggcaaggtagggagagtggcagcaaagagggaggctcatcagagtgagggagagagggagggatttggagccagggcagacagagcagagtggtgctggtgtcaaggagaaccgagggagaaacacagcagggaggacacctggggatctggggtgacacagagtggggacaggggagtatatcagggaagagagaatttaacagggagagcagaggaggcgcagagatgggtgaagaggcagaaatagatggagattgaggacgattgaaagattggggagaaggagcaataagaggttaaataagttgcgaggatggagcagaagagatggaagagaaggaatagagggaagaagggggataaacagcagaagagaagaggggtacaaaatgaagagcagaatcccagggagaaagaaaagaaaacaagagctagagagagaagggggagaatgagagatatgtacagaattagggagggaagcgcagtaatgaagaaaggggggctaggcacagtggctcacgcctgtagtctccacactttaggagactgaagcaagagaattgcttgagtctaggagttcgagaccagcctgggcaacatagtgagacccctatctctgccaaaaaaaaaaaaaaggaaataacggggcataatcgtgtgcacctgtactcccagctgctctggaggtggaggtaggaggatgacttgagctcaggaggtccaggctgcagtgaactgagatcatgccactacactgcagcctggtcaacagagcgagatcttgtctcaaaagaaaaaatggggcgagagactgggtttagatcagtggatgagttcattggatatgattagttgtgacatgttgacttccctgtatataatctaataactaaaaacttgtttaaattatacagattgagaattttaaaattggtgtctataaaacatgtacattctataaatcttggcatcagaggttatgttccacttggaatccctattcaaccagagggaagtgacttattcagttgtgaatcactgtcttcccttttcctaggattgggaggatgtggggtagagaagtgggaaaaaagtcgctgtctgttattacataatacttttaatttaattaattaaatgatattttgagtcagggtctggctgtatcacacaggctggagtgcagtggcgtgatcctctaactgtagcctctacctcttggactcaagtgatcctcctacctcagccttctgagtagctgggaccagaggcatgagccaccaagcccagctagtttacatatatatatatatatatattttttttttttgtagaaacgtggtttcactatgtttcccaggctgttctcaaaaccctggggtcaaagggtcctcctgccttggcctcccaaattactgggattacaggtgggattacagggatggcccaccgcgtctggcctacatagccccccccttttttttgagagggagttttgttctttttgcccaggctagcgtgcgatggcatgatctcagctcaccacaacctccgctccctggcttcaaacaattctactgcctcactctccagagtagttgggagtacaggcatgcaccaccatgcctggctaattttgtgtttttagtagagacgaggtttcttcatgttggtccaggctggtctttaactccctacctcaagtgacccgctgcctcggcctcccaaagtgctgggattcctggcgtgagccaccactctcaacccatagtagtttttaaaagggacatcaaggcatggtggctcacgcctgtaatcccagcacgttgggagacagaggtgggtggatcatgaggtcaggagttcaagaccagcctggctgacacagtgaaactcaatctctactaaaaaatacaaaaattagccaggcatggtggcagatgcctgtaatcccagctactcaggaggctgaggcaggagaattacttgaacccgggaagcagaggttgcagtgagccgagattgcatcactgcatgccaggctgggcaacggagctagactccatctgacaaaaaaaaagagagaaagaaaaagtaaggaacatcaaagttgggcctggtggctcattcctgtaatcccagcactttgggagcaaatcactgaaggccaggagctcgagaccaacctggcctacatggtgaaaccccgtctctaccaaaaatacaaaaattagctggccatgtagacatacgcctctaatttcacctactccggaggctgaggcaggagaattacttggacccggctgggaggcagaggttgcagtgagccatgatcacactactgcactccagcctgggtgacagagtgagactccgtctccccgccccccaaaaaaagaaaaattagccaagggtggtggcatgcgtctgtagtcccatctactcaggaggctgaagcaggagaatctctttaggcaggagaatcatgccactacactgcaagctgagtgacagagtgtgacttggtctcaaaaaaacaaaaaaagaaatagcaatcagctctttaatgtctccctttatataagcagtagtcctggccatgttcggtggctcacacttgtaattccagcactttggaaggctgatgtgggcgaatcacctgaggtcaggggttcgagaccagcctgaccaatatagagaaacccggtctctataaaactacaaaattagtgtgtaggtgtggtggcgcgtggctgtaatctcagctactcgggaggctgaggcaggagaattgcttgaacctgggaggcaaaggttgtggtgagccaagatcgcgccattgcactccagcctgggcagcaagagggaaactccatctcaataaataaataaattaattaattaattaataataaaaataaaagcagacgtattcacgtgtagtcaacacgcatgaccaaattctctcacaggcaccatctgcaggaacatcctattggacaataagaactctgaacatcgcttttggccaatataaacattcagaccaggaagtctgcatcatatttttgatgtttttattgtgcaatttgttttatacaatgttttctgtgatctcagtttataaattttcccagtacacattctatgttttatattttacacacagtaactagataactaagggcaatgaatatatataaaattgctgtattgcctggtgttatgtaactgtacttgtgacattgtaattgcaccctctgacactgttagtcagttcttattccttttaatgctgtgtatttacttgaactcatacatcagaaggtagtgatcttaacatgtatttcagtcttatagtgtgtgctggtggtaagtagaagttgtggcttttttcttgagagagaattgtttagaattctgcaggctgtataaatgtacttattatttgcttgctggttttatcatgggttagaatagtttactgattaatatttaagatttcacatatggcttttcagtatatgatatgtaatggaactgacacactgcacttgttaatttcaataagtgcctgttctgcgtggatttaggtaattttatgacaggtattcagaaaaaggttgtattaacatttttttttttttgagatggaatctcgctctgtcactcaggctggagtgcagtggcacaatcttggctcattgcaatctctgcctcccaggttcaagtgattcttgtgcctctgcctcctgagtagctgggactacaggtgaccgccaccacgcctggctgatttttggaatcttttcttatcttctctgtgctacgattatttgataatacagaatttcaattgattttggttacccttacataagcttctggtggattatttaccaatataatatattgtgtggtcttttaggatttatttgtgtacagtagatattgtgtaaatatgaaggatctatacttttcattgatgtgacagtgatatgttttttgcaaactgtgatacattttagggtcacagtggaaaaatactccttactttaggcttacacatgtttgtgccctgtcagcgttttgtcatattggaaataggcttccatagaaatgatttgaagtacacgtaaagtatttattaagtatttattaaagaatcttactccttttgtgttcctaaactttgaagatcatgtttgggaagttcaaaataagtattgttttttgtgtcatatttacacatttcagtatgttttaccttctggacttaattggaaacgtattggtgtttatattttgtagatatctcttccaaatgcttgatgaaaaaggtggaagggtcacttgacccagggagttgaaggctgcagtgagccctgtttttgccaccacactccagcctgggtgagtgagctacaccctatctcaaacaaacaagccaataaatgagaggtataattcctcctttgaaattaaagaaggagattttctttcctttcatctcttttcttaggacatttattagaaaatttgcaagtgcattttctgttttctgaggtagtatgttttctttcttttcttttgtttaattttcttttatttccttttctgttgttttcttttctttcctttccaacggagacacagtttcgctcttgttgcccaggctggagttaaatggtgcgatctcggctcactgcaatttccatctcccaggtacatgagattctactgcttcaacttccagagtagctgggactacaggcacccgctataatgcctggctaatttttatagttttgtagagacggggtttcaccatgttggccaggctggtcttgaacttctgatatcagatgattctccagccttggccttccaaagtactgggattacaggtgtgagccactgcgcccggcccagggatgtatttctgaagaacttgggagctccttgaaaggcaaacaacagccacgcgcagtggctcacgcctgtaatcccagcactttgggaggccaaggcgggtcaatcccgaggtcaggagttcgacaccgcctgacaaacatgttgaaaccctgtctctactaaaaatacgaagaaattagccgggcatggtggcacatgcctgtagtcccagctactcaggaaaattgtttgaacctgagaggcagaggttgcagtgagccaagattgtgccactgcactgtagcctgggtgacaaagtgagactccgtctccaaaaaaaaaaaaaaaaaaaaaaaaggcaagcaacaagatagattgtacctgtgtctcagtaggaaattaagtaattcaaacatcaaatgattccaatttaaagctatggacatttaaataattctgagccttgagaggaatgtggtcatgcaaccagagtctagtggaatgcaggtgcaacttctaggagttttcctggctgactgtcatggctcaagcctgtaatcacaacactttgggaggccgaggcttccggatcacttgaggtcaggatttcaaaaccagcttggctagcgtggtgaaaccctgtctctactaaaaatagagagaaattacaggcgcctgccaccatgcccagctaatttttgtattaggcttagtgttagggtttctccccctccctcgggatgaagcttgttagctgacagagatggtcacctccattaccaagtagagccaggatgaactatgtgtgaccaagggcttttcaagtcctcttccctgaggactgattactgtttatcttgaaaacatgtccttaatgggttgtatagaacactgaagtttctttctctcttttcaacctcttagctgtttgcctctatttcccatcacattctggtctaaagcttatttattaatgaagtagtttttctttctttctctattatcgtcgtggagatgatttctcatttgggggaagactctttgtttttcaattatattttctcacatttaaaaagtgaagtaaagaatatttcctgggccaggcatggtgactcacgagtgtaatcccagcactttgggaggccgaggctggcggatcacttgaagtcagggttctagaccagcctggccaacatggtgaaaccccgtctctaccaaaaatatgaaagttagctgggcatggtcgtgtgcgcttgtaataccagctactcgaaaggctgaggcagaagaatagcttcaacccaggaggcagaggctgcagtgagccacgatctcgcaactgcaccccagcatgggccacagagaaatactctgtctcaaaaataaaaggaaagaaaaaagtaaaaaaagagaaagtaatagatctctttcacaaatgtgctgggacaactaactggatatttacatggaaaagaataatattggatctctatgtcacaccatgaaaaattttatttaaaaacgggttaaaaaaaaaaaggctgggcggggtggatcacatctgtaatcctagcagtttgggaggctgaggtgggcggatcacaaggtcaggagatcaagaccatcctggctaacatggtgaaaccccatctctactaaaaatacaaaaaattagccgagcgtcgtggtgggcgcctgtagtcccagttactccaaaggctgaggcaggagaattgcgtgaacccgggaggcggagcttgcagtgagccaaaatcgtgccactgcactccagcctgggtgacagagcgagactccgtctcaaaaaaaaaaaaaaaaaaaaaaaaagagagaaaaggaaaagagcgagggagagacgagggagggagccctgcgggagggggtgttactttgtcacccaggctggcctggacccccaggttcagcgattctcccgccgctgcttcctgagtagctgggacctcaggcttccgccccgtgcccgcatccctgctgtgtttaggcagcaggtggtgacctcactcctccctggcctgagcactccgtcccgcatcccaggcggaggccctagggaagtctctgaagctgagcacagggtggaccctccctcctgaatgaatggagaatagaaagggggaggatttctgttatgttctgtgggccatcagcatgaaatcgtatattccgccccggcagggctttgcatttcacattttagtttgcatgcccgttccagacaattccagggcttttgaatcatgcttcagccttcctggccgctctcacctccaaacaccgaaaaaaacaggcgctgggtgcgaggcggagggatgcacaggtcccgccccggccccgccctctgtcggttctaaagggcaaggtctctctgcctcgcgccccgcctctaccccgcccaggccccgccaaactgttcgccggccccgcccaggcctggcttcagtcctgggcgcgcaaaccccgaggcggatcgcgtggagtgaaggtcgtaccgcggcgcgtgagttttgctctgccttgtattaagtttgcgcttcccaggtccctggcgcgtctgtccctggaaagtggggtccccacggacctggaaattctcgcctgtcttccttcatccagagcaaattgagatgtccccgtaagagtccggaagttgcttgcttttgggtttgaactcgtccggaggctggtcccaaccccggtctttctgctatagggcagtgtatacacttcctgtcgcttagttttcctggtcaaaaccctgtgctgactccacccaccccgttctttttaaagtccccgacccgcgaggtggattcccgccctgggcgcctcccagcctctccgtcttcggcccctggagcgaagcgctgtgtccccagtcctggggaggctgcgtcttctgcctggtcctggaattctgcaggtgccacccttgtcttaaggcgccgtcgccccctacatcccccctcgtggtgggccctgctgctccccaattcttcccttcgcagtcaccgcttcccctgaaccagcgtagggcaggtcccagcggcttgtcctatgacaccgggtattcttgcctgcccagctccaccctccggaaaatgcgcttctccgcgatgcgggtgtcttaccccaaacccgcagagtggtgctggtggcaatgagaacagagggagaaacacagcagggaggacaccgggggatctggggtgctagagagtggggacaggggggcgtaacagggaagagagaatttaacagggagagcagaggagacgcagagataagaggcggtaatatgtagagattgaggacgatcaaaagattggggagaaggagcaacaagaggttaaataaggaccgggcgctttggctcatgcctgtaatcccagcagtttgggaagcttaggcgggcggatcacctgagatccggagttcgagaccagcctgaccaacatggagaaaccccatccctgctaaaaatacaaaactagctgggcgcggttgcatatgcctgtaatgtcagctattagggaggctgaggccagagaatcgcttgaacttgggaggcggaggttgcggtgagccgagatcgcaccattgcactccagcctgggcaacaagagtgaaactctttctcaaaaaaaaagcggttaaataagttgtgaggatggagcagaagaggtggaagaggagtaatagagggaagaaggggataaatagcaggagagtagaggggtacaaaatgaggagcacaatcccagggaaaaagaaaagaaaacaagagctagagagagaaggggagaatgagagatatgtacagaattagagagggaagcacagtaatgaagaaagaggggccaggtgcagtggctcatgcctgtaatcccagcactttaggagactgaggcagagggattgcttgagtccaggagttcaagaccagcctaggcaaaatagacaccccatctctttcaaaaagaaagaaaaaattaacggggcatgatagtgtgcagctgtaatttcagctactctgtaggcggaggctggaggatcacttgagcccaggagctccaggctgctgtgagcagagatcatgccactgtactccagcctggtcaaaagagcaagaccctgtctcaaaaaaaaaaaaaaaagggtgggggactttgggtacagatgagtgtgtgagttcattggatatgattagttgtgacatgttgacttctgtctataaaatctaataacttgtttaaattatacagatgagtttgagaattttaaatgtcctatctgtgagccatgtatgttctataaatattggtatcagaggttagcttccacttggaatccctattcagaccgagggcagtgacattcaattgtgggtcactcttcccttttcccatggtggggtaggaagtggtgggaaaaaaaaatcgctgttattacataatacttttaattaattaattaatattttgagatagggtctggctctgtcgctcagctggagtacaatggcgttatctactctaactgcagcctcgacctcttaggctcaagcgatcctccctcagtctcctgagtagctgagaccactggtgtgagacaccaagcccagctagtagttttttttttctttgtttgtttttttgtagaaacagggtttcagtatgtttcccggggtggtctcaaaatcctgggctcaaaggttcccccgtcttggccttgcaaagtactgggattacagggatgagccaccgcgcccggcctacatactaattattattattattattattagttttttgaggtggagtttcactcctgttgcccaggctggagtgcaatggcacaatcttggctaatgactctctgtgcctttagagttgaagcgattctcctgcgatactaccccctgagtatctgggattacaggcatgcgccaccatgccctgctaattttggattaggaggccgaggcaggagaatcacttgaacccaggaggcagaggttgtggtgagctgagatcgcaccattgtacttcagcgtgggcaataagagcgaaactctgtctcaaaaaaaccaaaaaagaatggagcaaaacaggagaggggcataaaatgagcagaagcccagggggaaatgcagaaaagaaacagatggagagagaaagtgagaaagggctatgcatagaatgatggagggaagcagtaatgaagacgaagagggaccctgggtgcagatgagtggtgagttgattggatgtgatgatgaagtgatgacatgttgttttctctgtttataaggtaacaaatttaaaattagtttaaattatacagatgagaatgagagttgccaaactcctgtgtctaagtgtggttcattttataatgatggcgtcagaggcagcttccctctgcaacccctcttcagccagaggacagtgacttgactcattcgttgtggatcaccctcttcccttttcatggctggggtcgggagtgggggagagaagtagggtaagaagtgactgactctgttactatatggaacgtgatgaaaggagtattaaaagtgcttttgttctctttttgtaattggtttccttttttctagttcctcttcatttcattttttttttttttttttttaatttttgagatggagtctctctgtgtcacgcaggctggagtggagtggagcagtcttgactcactgcaacctctgcctcctgggttcaaggaattctctgcctcagcctcccaagcagctgggattataggcacctgcagccacacctgtctgatttttgtatttttagtagagacagttttcaccatctaggcgggacttgtcttgcactcatgaccttgtgatccaccgccttggcctcccaaagtgctatgattacaggcgtgagccaccacacttggcctcagtaattgttttttattttttaattttagttttaatttacttatttttgttgtggtggtttttttttttttttttttttttttgacggagttttggtcttgttgcccagggtgaagtgcaatggtgcgatcttgctcactgcaacctttgcctctggggttcaagtgattctcctgcctcagcctcctgagtagttatgattacaggcacacaccaccatggccggctaattttgtattttcagtggagatggggtttctccatcttggtcaggctggtcttgaactcctgacctcaggtgatcctcccacctcagcctcccaaggtgctgggattacaggtatgagccgctgcgcccggcctttgttattgttttgagacacttttactgtttcccaggctggagtgcagtggcaggatcacagcactgtgcagcggcaacctcctgggctcaagtgattttcccacctcagcctccggagtagctggggccacagacacaccccaccaggtccggctaatgtttagatatatgtatttatttattgagactctctgtcacccactctggagtctagtggcacgacctcgtctcactgcaaactccgcctcctggggtcaagcgattttcctgcctcagcctcctgagtagctggagttacaggtgtgcaccactatgccctgctaatgtttgtatttttagtagagacatagtttctccatattggccaggctggtctcgaacccctaacattgtggtcttcctgccccggcctcccaaagtgctgggattataggcgtgagtcactatgcctgtcctcattgttttcaaagtatgatatattttcaaatatttctcctttggcccaagatttcattagatctgtattttttaaccattttaaaattgtttctctatgaaatttttttgagtttacattgaggtctgtgtgctttctagtctttatcatatatcgaaaacattttctactatgtgatatatgttgttaggttgtttcagtgtgtacttgataatgatatcaaggaccttttttctttaccctaacatgaaaattcagttgaagtagcctattccatttttttttcttatgtcatctgaaaaaatggtaatctgtgagcttctaagtaagtgtcccctcaattccctctggtccataatattctctacagatgttgaaggatgggctggattgacttggaaccttggtttagcagagcccatgtgttcttgagaaaagcatttgctcagatctcatttctacagctgcctctttttcagtgttttaaacatctattgctatgtgtgcacagttgtgtgtattttgaacatttttctgggagtgagtaatgatatgtttgggattgatgccatcagaaccttacaacttgaaagaagtttcgtttgctcaggtatataagatggtcctggaatttttgtttgtttgtttgtttttctttgagatggagtctcgctctgtcacccaggctggagtgcagtggcatgatctcagctcactgcaacctctacctcctgggttcaagcaattcttttgcctcagcctcctgagtagcagggactacaggcccccgccaccacgcctggctaatttgtgtatttttagtagagacgggatgtcaccatattggccaggatgatcttgaactcctgactttgtgatctgcccgcctcagcctcccaaactgctaggattacagatgtgatccaccccgcctggccttttttttttttttaaaccgtttttaaataaaatttttcatggtgtgacatagagatccaatattattcttttccatgtagatatctagttaggtattacaagggtgagtcaccgctcctgactggtctggaaattttctagaggaggaagaccaaggcagcctattggccctttcaggcaatcacatgggaatcagccacatgtccttcctcctcacctcagagcatctcagaataacttggtgaaatgtctcccactgtgagcctcagtgagcccacctgtaacatagaggtgaggaataagaccggaaaagctcagtcagagtgacactgacccctgaaatgactgacaaaatacagtgtgtgacttttcttctgggagaggtagtgctcagttttaactcgaattttaaagggattccagttctccaaatattaaaaaaaaaaaagcacaagatgattaaaatcaggggattagactcaaatcaccttgaaccttatcatctcacagctttaacccacttacacgactccatgtcccctgcaggcgtcgcccctgagctctacaatcctgtgtccagttgtctcagctgtctcctgggtcatcaaacaggcatccccaccttcaggtgtccacgagtggctttctaaacccccaaacacatttccttgcagtctgcacatctcagatgagagtgactgtgtacttctggaaacttagccaaacttgacagcatgtattttatatttgtgaaataaatcactttatttgtaagtgttgtaatttataatataaagagaaacttagatgtatacgtgaaaagagtgagaagatacatcacttccaatttttttttttttgagacgaattttcactcttgtggcccaggctggagtgcaatgccacgatctcagttcactgcaacttctgactcctgggatcaagggattctcctgcgtcagacacccgagtagctgggatcacagtcgactttcaaaatgcttttgggttgtgggagaaaaatgtttgaaaaccatgtccctatgggtctgtgcccccaggacctctctgacctcatctcctacctgtgccctcctctcttccactgctccagccccacgggtcgctttccttttcctggggctgaggttgctcctgtctcagggccctcacttgagctgtccctctctctaggatgctcttcccctcagctgcaagtgacaagcagcctttctttcctaggtccttgttctgatatcatcttctccgggtttcctttgtgatctcccacagcccccatttgacactgcagctgtgaaaccagaaaatcttacagagatctcagttatttagagagtttagtttgcccaaggtggtcggggcagagcttaattttatacattttatggagacatgagacatcaatcaatatatgtaagaagtacattggtttggtctgggaaggcgggacaactttaaacaaaggcaggaagacttgaagcagggaggcggcttttaggtcacagagaaatgaggcacaagtagttacaatcttttgagtttcctttttttttttgagatgaagtctcattttgtcgcccaggctggagtgcagtggcacgatctcgactcactgcaacctctgcctcctgggttcaagtgattctcctgcctcagcttcccaagtaggtgcccagatcttttttttggggggggggtggaggctttgatcagggatgagtctgtgccataaagggggcatcagtgcagcccaggtcccccctgctgcctcgtgtgtggcggcttctccatgaagggagtgagatctgaagaccggggtcaaacatacacttgtaggtcttcctgtgggactttcttacctctgcatgatctctggtgcagtgggcagtgggggacttctttctacagggtgacatctcccggttcatgtggttttgtcacaggaagggagtgagtcatttctaacatgaagtcttattttttttcacatacaggattgatttctaaagactcatgttacgtgaggaagcagctcagaagaggaaaggaaaggagtcaggcatggctcttcctcaggtgaagtgatattcctctgtggattaatctgtctctttcctttctgaaatgtagtagtattatattgtattgtagtaatgtattgtagcagccagtcttttctgagtctgaagcattttgcctgacacgttcacttgcactcacccatgcctgccctcagttcctctcaggtgctctgagattccatctcctgtgacccagtgacatgaacttgggaagaggctccactgggcatggtcttgggaagggctcacacccagacgtggataaacatggggtgtgggcccgttgatgtcagagctgctgggcagcctggattgttcaggggccacatctggatgtcagctcagagaaactacatatgaaatacgtatgttaatgtgcgcagatgtgtggtaaattctgggaaaggagacgaataagaggagatattttgtatctgatttggtaatgcatttgaagccacactagtagatcaagatgtctctgtgtccaaattttttttttttttttaagagacaagatgttggtcccagtgcagtggcttacacctgtaatcccagcattttgggaggccaaggcaggaagatcacttgaggtcaggacttagagaccagcctggctaacatggtgaaaccccatctctactaaaaatacaaaaattagctgcatgtggtggtgcatgcctgtaatctcagctactcaggaggctgaggtaggagaatcacttgagtccaggaggtggaggttactgtatgccgaaattgtgccactgcactccagcctgggagatggagcgagactctgtctcaaaagaaaaaagagagagagagaaggtgtcgctctgtggcttagttctggagtacaatggcacaattcagagtttacagcagcctcaaactcctgagctcaactaatcgctactgtagcctcccaaagagcctgaatgataggcatgggtcaccatatgtatgtgtgtatattatgtatgtatttatttattttaagatggagtctcagtcagcaaagctggagcgcagtggtacgatctcggctctctgcaacctccccctcccagtttcaagcaattcttctgcctcagcctaccaagttgctgggactacaggcatgcaccaccacacccagctaatttttgtatttttagttgagacggggtttcatcatgttcgttatgctgatctggaactcctgacctcatgatctgcctatctcggactccctaagtgctgaggttaaaggtgcacaccaccatgtcaggccttattttttatattgtatttttattttgttgtctaggctggagtgcagtggtgcaatcaaagcttgctttagccttgatatcctggcctcaagtgatcctcccctcttggtctcccaaattgctggcattccaaatgggagacagccagcttggctggactctgcacatttttgagatggagtgtcgctctgttgcccatgttggattgtagtggcggcatctcagctcactacaacctctgccttctggcttcaagcaattcttttgcctcagcctcctgagtatctgggattacaggcattcgctgtcacgcctggctaattattttgtatttttagtagagatggggtttcaccgtattggtcaggctggtcgaactactgaccttgtgatttgttcacctcggcctcccaaagttctgggatttacaggcctgagccactgcacttggctaaagtctgcacttttaatgactgtcaatgcaatggaaagtggagataggcatcagtggtacaggatgctttattacatcattgattttattttatttttaaatttgttttgagttgagtctctgttgtccaggcaggagtgcagtggggtgattttgtttcactgtagcctctgactcccagattacagtgattctgttgcctcagcctctccagtagcttggattagaggtgggccaccacgtgggtaacgccatgatgtgatgtgtgtgcatgaatacatgggtggataagcccatggtttatgtagaaaacacaacatttgcaataagttttattttttataataattgtaatgattttaagtatttttcattgttgtcaactatcacaataatgagttaatggtaagatggggccgggcccggttgctcacacctgtaatcccaccactatggaaggctgaggtgggtagctcatgacatcaggagttcaagaccatcctggctaagatggtgaaaccctgtcgctgctaaatatacaaaaattagatggatgtggtggcaggtgcctcaaatcctagctactggggaggctgaagcaagagaattgcttgaacctgggtggcacaggttgcagtgagctgagagattgtgccactgtattccagcctgtgcaatagagtgagactccatctggaaaaaaaaaaaaataagaagtattgggaaggattatatgtatgcctgtgtgtgtccattcagcgaccttgtaggatgctccgtgttcttaccctgggacctttgtcacattctctgcactagataaacccgtgtcagtttagtttaaagctgtatctgttacttcagcgtttatattcaaatgtgaatcccagacatctggattcagtgcttgtgttgacatttttagctatttgatttgtggtaattttcctagtatgtgtgatgcacttgtgtccaagtacagatctttcttcatgggacagtatgttattttatggcttaagacatgggaagcacttagaacagtgtatagcacatgggaagcattcaaaaatgttagtcatggctattgctgtcatcataacagttttttttttttttttggagacagagtattgctttgtcacccaggctgaagtgcagtggcatgatattgggtcattgcaacctctgcctcctgatttcaagcaattctccagcctcagcctcccaagtatcagggattacaggcacccaccaccacacccagctaatttttgtgtttttactagagaaggggtttcagcgtgttcccaggcgggtctcaaactcctgacctcatgatccacctgccttggcctcccaaagtgctgggattacaggcatgagccactgtgcctgaccgatcatgatagtttttagatttggacttttctttcaaagccaatggactctgtcctctctgaaacaccgcttgtatcttagttcatctagagactaaatatcgccttgtatgttgaacataatagctgacatgtctgtagagaaaaccctgtgtttgcttttttttttttttttttttgagatggaatcttgctctgttgccaagctaaagtgaagtggtgcgatctcggctcactgcaacctccgcctcctggattcaagcaattctcctgcctcagcctcttgagtagctgggagtacaggcctgcgccacaacacctagctaatttttgtattttcagtagagatgtggtttcgccatgttggccaggaaggtcttgatatcttgaccacattgtctacctgccttggtctcccaaaatgctaggattacaggcgagagccattgcctggaattgctttttttttttttttttttttttagatggagtgtcagtctgttgcccaggatggagggcagtggtgcgatcttggctcactgcagcctccatctcctgggttcaagtgattctcctgcctcagcctcctgtgtagctgggattacaggtgcctgccaccatgtccgtctaatttttatatttttagtagagacaggttttcaccacgttgaccaggctggtctcaaactcttgacctcaaataatctgcccaacttggcctcctgaagtgttgggattacaggcatgaaccacctcacccggccctgtgtttcctttttatttatatagtttttatattgtccataaaatcgagacttccatagtgacttatgggatcttaaaatctttcaaggaaaagtacaataaaatgcaactatacggaaaaaatagtcaaaaataccttaacatccttttgtcagaacacagtctttgatcaaataaatacttattttcccttttctcatttcctgtgaaggtgataactcaatcctccataatgttttgttgaaatgtatgtttcattttagggacgcttgactttcagggatgtggctatagaattctcattggcagagtggaaattcctgaaccctgcacagagggctttgtacagggaagtgatgttggagaactacaggaacctggaggctgtgggtgaggaaaatgtccctgcagacatgaggagtctgctcctgtctatcttggctcttcctggttttgtattctcttttgtgattttgccccatccatgctggttttttttttttttttttttgacatggagttttgctcttgtttcccaggctggagagcaatggtatatcggttcaccataacctccgccttccaggttcaagtgattctcctgcctgagcctcctgagtagctgggattacaggcatgcgccaccatgcccagctaattttgtatttttagtggacacagggtttctccatgttggtcaggctcgtctctaactccagacctcaggttatccgcccacctcaccctcccaaaatgctgggattacaggcgtgagccaccatgcccagctcattctggtttttgaggagcatcacagaagcgtctctcactggcactgtgacaacgttcatcccataaactaatgatcatcttctctaagcagcagtcagtggtgttgcaattcctcccagcgaggacatcattcgggctcacagcctcatatgtatgaggctcttgactgaactcttgttcatgtcacatttttcacaccaatatgtgtcactgttcatttttaacaagaaaacctatgttcagtttgttgtaggatcaaccctgtaagagatatggttttcatcaatcttattgagggagcttgtgaggttgaatgaggtttccatagtttagttctactgtcatttccttaagacacagtgcctttcaacttgttcatttctatgttgttgttgtttttttctcatagtcttgctctgttgcccaggcttgagtgcagtggcatgatcttggctcaccacaacctccaccttttgggttcaagtgattctcctgcctcagcctcttgagtggctgggattacaggcatgtgtcaccacacccgggtaatttttggtggttctattacagatggcagtttcaccatgttggccaggctggttttgatagcctggcctgatgtgattcagctgccttggattcccaaagtgctgggattacaggcatgagccacagcccctggcccatccgagttgtttttaaggctgaataatattccattgtatgtgtataccacattttcctcacatatttatctgtcgatgcacatctttactattataaataatactaccaggctgggtgcggtggctcacgcctgtaatcccagcaatttggaaggctgaggtgggtgaatcacctgaggtcaggagttcgagtccagcttggccaacttggtgaaaccacatttctattagaggtacagttttttttttgtttctgttttttttaagatggaatattgctctgtcacccaggctcaagtgcagtgcagtggtgtaatctcagctcactgtaacctccacatcccaggtcaagcaatctcatacctcacgcttctgagctgttgggattacacacatgcaccaccatgcccggctaatgttttgtattttttttagtagagacagtgtttcaccatgctggcctggccggtcttgaactcctgacctcctgatgcacccgctcatcctcccaatgtgctggtattacagacatgagccactgcactcagcctagctctgttttcacaaacacatctctacctactgtgccaggggatccttgttcacccccatggtctactgtactcttcatagagtttacttgtttgtttgtgtgtatgcctttctggtatctacacaggggatattgttgagtatattcttgaaactggaaatcagagtcacttaatttaaggatgtaaaactgctttcacctcaggccaccatactgctgcttttttggatctctttcattcttgtcccttgcccatattgtaatttgaatatttaaccttgggtcaatattttaacatttgctcaattagttccactttcgtccaagctcaagatttggtctatcctagtggaattatattcccacagaggtgcatgcacaaagtttactcctacatgcccattacttcctgctctccacccttgcccttcctttcctggccttgactcacatgatacattgatctggatgcaaatactgtttctttccagcctattgattttgtaatgctgaacaccccaatttccccgtgagcccctcccctccaacaccactctcactgagtaagtcaagaccttgttcatccactggacaaaattataggaggccgcttaaatcagtgtgtgcagggcatcatgactcagcacatgatccatgagggatggcttcagaaccactgtcagcagcgcagctcagcgcttgtgtcccagctcagcctttgtatcccccttgatgtacttctatctgttctccttgtattttctggtctggtcattttctgtactgcctgtgctgactattgtgcctaagaacatgtcgtgggatccttcatgcccaggattaagtcttgtccctcacttaccttatgtgcaaactggggtcatgtccatgaacactgtgggcctcctgtcattatttgagaaataatgataatttgcctccagggttggttttttttttttgtttttgagatggagttttgctcccgttgcccaggctgaagttcaattgcacaatctcagttcaccacaacctccacctcctggatttaagcgattctccttcctcagccttctgagtagctgggattagaggcatgcaccaccacacctgcctaattttgtatttttagtacagatggggtttccccatgttggctaggctggtctcaaactcctgacctcaagtgatctacctacctcagcctcccaaagtgctgggattacaggcatgaaccactgtgtccgggctatttttttttttttaatggagtttccctcttgttgcccaggctggagtgcaatggtgcaatcttggctcactgcaacctcgacttcctgggttcaagtgattgtcctgcctcaggctcccaagtagctgggattatgcctggcacaagcctggctaatttttgtatttttaggagagatggggtttctccatattggtcaggctggtcttgaactcccaacctcaggtgattcatccacctgctttttaaaacaagtgaatactattagatggcttcatataagttttatagtacattctcaacttcctttgtttaataagatttttcagccttcagtgatgttgatgatgagatgccccttttcctgcctcactcatctcactgttctgtcagaaatagcttagactggccagcttcagtggctttcacctctaattctagcactttgaaaggctgaggtgggtagatggcttgaggtcaggagtttgagaccagtcaggcaaacataatgaaaccttgaatctactaaattaaaaaaaattgggcatgatgactcatgcctataatcccaaacttttgggagggcgagacgggtggatcacctgaggtcagaagttcaagaccagcctggccaacgtggtgaaaccccgtctctagtaaaaatacaaaaattagctgggcgttttggtatgcacctgttatcccagcttcttgtgaggctgagacaggagagtcacttgaacctgggaggtggatggtgcagtgaaccatgatcatgccactgcacttcagccaaggtgacagagttagattccatttgccaccaaaaaaaaaaaaaaaagttagccaggcatggtggcatgtgtctgtactccctgcctagctgttagtccattcttagttcttaaaatgttgtatattttcttgacctcatacatcagaaggtagtgatcttaacatgtatttcagttcttatattgtgtgctggtggttaagtagaagttgtggcttttttcttcagaggaagttgtttagaattctgcgggctgtataaatgtacttatttgcttgctggttttatcatgggttacaatattttattaattaattttataattttacatatggcttttcggtatgtggtatgcaatataactgacacactgcactcgttaatgtcacaaagtgccaccaggtgcagtggctcacacctgtgatcccagaaatttgggaggtcaaggggggtggattacttaaggtcaggagtttgagaccagcctggccaacatggtgaaaccacatctctactaaaaacacaaaaattagccaggtgtagtggtgtgtgcctgtaatcccaggtactcaggaggttgaggaaggagaatcacttcaacccagcaggcagaggttgcagtgagctgagattacaccatgacgctccaagttggagtgcaagactccttctcaaaacaataaaaatggaaacaaatttttttttttttttgagatggagtctcactctgtcgcccaggctggagtgcagtggcatgatctcagatcactgcaaagtccacctcctgggttcataccattctcctgccacagcctcccgagtagctgggactgcaggcgcctgtcaccacgcctggctatttttttgtgtttttagtagaaacagagtttcaccgtgttatccaggatggtctcgatctcctgaccttgtgatccacccttctcggcctcccaaagtgctgggattacaggcatgagccaccgcacccggcccaaaaattttttcaaaagtcactaagtgcctgttctgtgtagatatatataattttatgacatttatttagaaaaatattgtactaacttttttcttttttttttttttctgtttgaggcagagtctactttgccaccctggcaggagtgcagtggtgtgatcttggctcactgcaacctctgcctcccgtgttgaagtgattcttgtgcctcagcctcctaagtagctgtgactacaggcacggaccatcacacctggctaatttttgtaatcttttcttatcttctcagtgctataattgtttgataatacagaatttccagtgcttttggttatccttacatgagcttgttgtggattatttaccaatatagtatgttgtgtggtttttttttttttttagcatttatttgtacacagtaaatatggtttaaatatgaagaatatatatttttctcttccttgatgtgacagtgatatgttttttgcaaattgtgatgcacttcaaggtcacagtggaaaaatactccttactttaggcttatacatatttgtgccctgtcagtgttttgtcatgatataggaaatagactttcatagaattgatttgaaggacatgtaattgccctttatttactaaagaatctcactctttttgtgttcctaaactttgaatatcatgtttgggaatttcaaaataagtattgttttttgtgtcatatttacacacttcagtatgatttaccatctgtacttaattggaaatgtattggtgtttatattttgtagatatctcttccaaacacatgatgaaggaggtcttgtcaacagggcaaggcaatagagaagtgatccacacagggacattgcaaagacatcaaagttatcacattggagacttttgcttccaggaaattgagaaagaaattcataacattgagtttcagtgtcaagaagatgaaagaaatggccatgaagcacccacgacaaaaataaaaaagttgactggtagcacagaccaacatgatcacaggcatgctggaaacaagcctattaaagatcagcttggatcaagcttttattcacatctgcctgaactccacatatttcagatcaaaggtgaaattgctaatcaacttgagaagtctaccagtgatgcttcctcagtttcaacatcccaaagaatttcctgtaggccccaaatccatatttctaataactatgggaataatcccctgaattcttcattactcccacaaaaacaggaagtacacatgagagaaaaatctttcccatgtaatgagagtggcaaagcctttaattgtagctcactcttaaggaaacaccagataccccatttaggagacaaacaatataaatgtgatgtatgtggcaagctctttaatcacaagcaataccttgcatgccatcgtagatgtcacactggagagaaaccttacaagtgtaaagagtgtggaaagtccttcagttacaagtcatcccttacatgccatcatagacttcatactggagtaaaaccttacaagtgtaatgagtgtggcaaggtctttcgtcaaaattcagcccttgtaattcataaggcaattcatactggagagaaaccttacaagtgtaatgaatgtggcaaggcttttaatcaacaatcacacctttcacgccatcaaagacttcatactggagtgaaaccttacaaatgtaagatttgtgagaaggcttttgcgtgtcattcctatctggcaaaccatactagaattcatagtggagagaaaacatacaagtgtaatgagtgtggtaaggcttttaatcatcaatcaagccttgcacgtcatcatatacttcatactggagagaaaccttacaaatgtgaagaatgtgacaaagttttcagtcagaaatcaacccttgagagacataagagaattcatactggagagaaaccatacaaatgtaaggtttgtgatacagctttcacgtgtaattcacagctggcacgacatagaagaattcacactggagagaaaacttacaagtgtaatgagtgtcgcaagaccttcagccgcaggtcatcccttctatgccatcgtagacttcatagtggtgaaaaaccttacaagtgtaatcagtgtggcaataccttccgtcaccgggcatcccttgtataccatcgtagacttcacactctagagaaatcttacaaatgtacggtttgtaacaaggttttcatgcgtaattcagtcctggctgtacatactagaattcacactgcaaagaaaccttacaagtgtaatgaatgtgggaaagcttttaatcaacaatcacatctttcacgtcatcgtagacttcatactggagagaaaccttacaaatgtgaagcatgtgacaaagtttttggtcagaaatcagctcttgagtcacataagagaattcatactggagagaaaccatacagatgtcaggtttgtgacacagctttcacgtggaattcacagctggcacgacatacaagaattcacactggagaaaaaacttacaagtgtaatgagtgtgggaagaccttcagttacaagtcatcacttgtatggcatcgtagacttcatggtggagagaaatcttacaaatgtaaggtttgtgacaaggctttcgtgtgtcgttcctatgtggcaaaacatactagaattcacagtggaatgaaaccttacaagtgtaatgagtgcagcaagaccttcagtaacaggtcatcccttgtatgccatcgtagaattcatagtggtgagaaaccttacaagtgtagtgagtgcagcaagacgttcagtcagaaggcaacccttctatgccatcgtagacttcatagtggtgagaaaccttacaagtgtaacgactgtggcaataccttccgtcactggtcatcccttgtataccatcgtagacttcatactggagagaaatcttacaaatgtacggtttgtgacaaggctttcgtgcgtaattcatacctggcaagacatattagaattcacactgcagagaaaccttacaagtgtaatgaatgtggaaaggcttttaatgaacaatcacacctttcacgtcatcatagaattcatactggagagaaaccttacaaatgtgaagcatgtgacaaagttttcagtcgcaaatcacaccttaaaagacataggataattcatactggagagaaaccttacaagtgtaatgagtgtggcaaagcctttagtgaccggtcaacacttattcaccatcaggcaattcatggtatagggaaatttgattaatataatgattgtcacaaagtcttcagtaacactacaacaattgcaaatcattggagaatccatgatgaagagaaatcttctgagtgtaataaatgtggcatgtttttcagacattgttcatacattgcagttcattggcaacctcatactggagagaaaccttacaaatgtcatgattgaggcaaggtcttcagtcaagcttcatcctatgcaaaacaggagaattcatacaggagagaaacctcacaagtgtgatgattgtggcaaagcctttacttcacattcacacctcgttggacatcagagaatccatactggacagaaatcttgcaaatgtcatcagtgtggcaaggtcttcagtccgaggtcactccttgcagaacatgagaaaattcatttttgagataactgttcccaatgca

SEQ ID NO: 1816 - DNA, 122754 bp, Homo sapiens
attccctagaaattggggcagagtacacccatttattggaaaatgagaagtcctgtgtgtgcagagaaattttaaagaaaagatcaggggataatccatccattaagaattctccattaagaatactcattataggtttaattaatcacaatgatggatatctttaacattaggcaataattgacagttttatagtggtgagactatcatcacccaaaatacaatttttaaaggtcatattcacttttcctttcaacatcataaaatcttgaatgaccacaagtagagctcaacagagaataatcaggcaaaaaatcaggaatgttcatcatcgaaggtttgactatgtcctcggttgatactcataaatttaaatatggtaggtagaaaagaaataacacacagatttgtcaaccatatgtaacagaatagttcagttcagcaaggggaattcagaattctttctctgctggctgagcctgtatgtcagccaacaacatccacttagtctcaggtgacaacagtgccagttaattagcttttgtttatgttttgactattgatagacttaaattatattcatattattatgcaaaacaaacacatagaaagtcttgcctttgatctaaatacaggcacttctttgttgcaatgatgtttgaactgtgtatcagaataaaaaacttacagtaagccaggcataaaaagtagatcatctaaatcagataattaaaacatatttgattaatggtaattttggcttgaaaacaaaatatcctatctcaacagaagtttaagttggtttataaaaatgcagaccttacctttgagattgatataaaatgccgtggacatctctgtaaacttctcaatcctcctttgacctttttgaaagatttaatctcatagttgttagattaatgcatattctttgtgtgcacttcttgaactagaataaattttattcttttctgaccattaaaattgttccctcttcctaattcttgtaaactcttttctaaccatgctcatgaaatgtagagaaaatggtttctctaggatccaaaataacatattacttataatttaaattgcagaagagttcatttctttggaatatgctgtatgtaacatggtttttgctgaagagctcggtaaattatctaggtgtgctgggactttctttctttcttttttttccttttttttttttttttttttgagacagagtcttgctgtgtcacccaggctggagtgcaatagtgccatctcagctcactgcaacctctgtcttctgggttcaagcgattcacgttcctcaggctccagagtagctgggactacaggcgtgcgccaccacaccaggctaatttttgtatttttagtagatatggggtttcaacatgttggccaggctagtctcaaactcagattttttttttttctgaagacaaatgctctctgattggcatgctccagtcactgtctcaccatttaaagacttctagattaaaattaagcatgggctcaacagttctaaagtgaaaacatacatagtggagatccctgccttcttctctcctctcttcctttcctttctttcttttttttttttctacttcccatccttctcaaagagacaccagtcagaaatatagatatgcttatgcttgcttggtgtccttgattataaatagtccaaacatcaggaaactaaaatcaaggtgattatataactcctaaagatggaagttgtcaaaatacatcaccacaaaacaaattttaaaaggctattttaaatacaagattccatcttcactaaactgccccttagatcactaagataatttagcatcaaaatcagcttagataatcatacgttacaaagctgccaccagcagcttattagttctaaagctttccaaaaaacctcagccaacttgacactttgatctcacatgtcaaaaaagtggtcaaggttgatcagttagcttttaacagaagaatttgctcctgatggagtggcagctataatcatatggtatttttagaacagtgatacaatgaaaaataatatcataattatgtatttataaagtgttgattttctacaaactagaggttagcaatgattgctagagcaaataattacatttctaaaagaaataaaaaatgcatggagataatatcaatcaaatgagttaatgaaaaatcatgatcctattatcttaatgaatgcagtatagtgttataaatgcccttgcacttacatcttcatcacatagtatgaatgacaaatagaaagaccaaagaactgataaattactctccccctaacagtctgatatgtgaatcgtatgtccctttctgacttattacaaatgcctttcattagtgagttcatgtattctaataatccatccaaaaatattcataattataggaagacaataacattgccattttcacagtcatgttatagtatttttagagtattgagtacagtagttatttattaaaagtaacacgaaagcaggaataaaatacttatatgtacaaagtagcatggtatgatttctacctaatatttaataatacacgtgcaacttttccctgcattaacatagtggtaaacaataaatactaacagtaggtaatataagaacactgagaaaagtaggaaagtcttcatggataaaaattcttggcccggaaaactttaaacattaaggaaagtcatgcctatcagcgagcccacctcctgggctgtcagattcactgctcacaaattctcctcctaaaattccttttcctaggaacgctcctgtaaatggagtaatggaatttttaaatgtgagagaacaggagagccccggggttctttttgattccatcaaattattgcatgtcagctggacatcactttactgggacagacgtctggtacagtccagcagcaggtatggaagtcgggattgattctgcaggactttctccttttccacgcttggtgcatagaagctgaagattaagcctgtgagcaacaacaacaacaacaacaacaacaacaaagttcagattccaagaaagcgaagaagaaatagagatgctgggggagtccatttcttagtaagaaatggttgtcactagctccattttttccacctagtagaatcacttgactgtctctcaagctcttcaaacttgacatatctgaaaagaaaagctcgttttctttcccaaacctgttcccctcacttcacaatctcaatctttggtatttcctccatgatgcattcaggcacccaggctgggagtgtgggtattgtctatagtcctattcttcctcactccccattggccacatccaatcaatcaccacatcatgaaatttttaacctccagacatttttctctattctattctgcctcttcatcttcctccatactgcagctccctagcttaagcctttatctttttccagtggaatattgcaatagcctctgacttctctgcttctgatcttgctcttcttgaatgagtcttccaaattaaacacacactggtgtatatcaagcacaaatctcatattccttttctgattaaagtccttaactgtaccctatcactgatgggatacagttcaagatctgttgcttggggtgacaatgtgagtaattaaaaaatttatgggcaactttaaagctttgctgctttctactcatcagggagaagaatgaataggcatcagaagaaagaatgaatgaataccatttgccacttcttcataggaaaggtagccaagcctttggtttagtattttgcatttttctctgcagtgtaggaacaactttcgatattggtctataaaagagcaagagatggagacttctatgtcccaagtacgaaaagggtagtggcccaaactggcagagattaggtggtgttgtgttgctgatggcagtgttggtggtttgctaggttctggggagagcatgatatggtgtgtgtggtggggtgtggggagtggtacaagtggcggagacctgtaaccagctctttcctggtttggttggtgaaggcaagttctttgatagggatggccgaactgttgctttacatgggggaaagcaggacattggcggctatggcctgcgggtagcagctacaggtatccatgtcaagtcttaggataaggaaaggattgtagaacaggatatccgtgacttcttcccagagcatctgtggctgctaggcagtcgagcacatgccagagcatggtatagcttaagtaccatgattagaaggatgattgcagacaaggcctctccttcaattactgaactagttttttaggcatattttatatccaaggtcaagtgaggggttcctcaaaatgataaatgacttatttttttatttttatcttcttttttttaaacttttattttaggttcatgggtatatgtatacaggtttgttatataggtaaactgcatgtcatgggttttttggtacagattattttacccatgtaataagcatagtatttttcagtccttaccctcctcccaaccctctaccctcaagaagtcccaggtgtctgttgttcccttctttgtggataaaggacttttgatgtcattagtgaatgaagaaagttagtacttcattctagcctcatgcaatccttcatgatttatcttgggaaacaaggcttcctgtgatctagtaccctctactacttgagccttgtttcccagccagaggtcaacgcttctcaagctgtttatagtgaaggacaatgttggtttctaacaatatctaatcagctacaaacagacattttaaaaaatacaataacatgaatgttgcagcagtatcagattgctataacagtttttaaagttttatgatttctttcatataccattcagtttcacaattcttttcctatttgtacatgctattccctgtgcctggaaaatctttcctctcttcacctaggccacattttttttttttgttttttgttttttttctcattctgtaagttttagctcaaataccatctctaagaaatttgccactaaacttcacgttatcatgtctgtctttacataacactatgttatcatttaccatattatactaaaattatttttcttatgtgtgtgtctttccacttctataagctccttgagaactgcaaccatgacaagccctccttatatctgggatagtacttgacaaggattaaggtctgccactttttgttcaactgagccatactcctccatagatgagttttcaagtgaagtcaagagtttgtagcatagttcaactggtaaacatctgaatttgtgctaataggataatgctcatgattgatactgtttcaattattttctcaaagatcagcaacctaaataagaacaaactctagtttcatcagcatgcatttcacattgacaatctttctcaaaaaataaatcttgcttcattaatgattctttacgtccataccaatatcagtctttgctttttttttacaacattataatccctctaaaattagtgtgttggcttcaataataatggtataggactgaatagtcactgaatctctcacaacctagattttcatatatttgtggtttttataatgaataaatggctattttataataagatttcataatatgtttctttaacactactgacaacaatttataaacaatcagaatggccataggagaaaagatcattttgtcttggttttatagatgtggaacccagtgtagagcattattaagaaattcattcaggattatagagtacgatcataatatacagttggccttccatatctgtgggttctatgtccacagattcaaccagctgtgaattaaaaatattcaaaaacagtaaaaatgaacaatacattaataaaaaataatacaaatcgaaatatagtataacaactatttatatagcatttaccttgtattaggtattacaagtaatctagagatagtttaaagtactacatgagagaattcgtgtaggttatattcaaatactatgcagttttatttacatcagggacttgagcaaccacagattttggtatctccaggccttttgaaatcaatcttccacctccatgaatacagagaggcaattgtaaatatcctttatttatgatgttttccttttagcttgtgttattttattttaaaatgaaagaaaaataattgaaaaacatgttaagctcttctggaagttcacaaagctactcccagattatcagggcaccattaagaaaattacagaagtatcagggaattgtatcttggagaaaaatggaaatagctaacaatccacattgctgagggtctgtgggaacggactttgatccaagctaccggactttctaacaccacagttcttcactggtctgaaacccccttcactcttcagccttcaaaggtgtcttggaacagaaggaagatgagacctactggtgagggagcaaccaggtagcagcagattcccccttgacaacagtgcagagttggtcatagaacagttaaatggctatctgttcaattctaaagttgttatttttcccttttaattttatatcttagacatgctttcatgttattaaaaattatttcgagaattatttttactcattatataatgtcactgtgcaaagtataatttattttataatttccatatcattaaacatttaagctgcttctacgtatttgctacccctcttgtatatgatttcatgctcccacgaagtaaagctttgcagaaggcaaggtttatagctcataaatgtttcaaaattcctgtctgccctgccgaatcacattaaacataatactgtgcactaaatagatgatcaatatatgaagcaacaagcattaaatatatctaaaatcttgttttgatatggaaatttttaacataggtgatgatttctgtattactgtttgctgtttcatgagggttcaagactttttaacttctttcctgaaatcttctaggtttgatgaattcatttctatatattctgaatctccaagttgatatctaatttcaagttgacaacctagatagtagttactctttggttattaaattcaaagtacagtgatagaaatatcttaaggaaaaaagtgagacagacaatagaattgaacagatgtcaaacttgtttcttcccattactttctgatctttactcttcagaacatcattatataattccaaaattacaaaaaggagcaataaaagttatttagcttttcaaatcaaaaggcttggaatctgaggctaggaatattttttaaagtacagaaatggaaaggaatgggagttgaacaaaaattacttttattaagctggttcgaagatcaacactgttccttgccttctatataccttttctttctttcttttttcttttttttccaactgcagaagacttgctttttccaagttggacaattagttactaatatttgagcattttggtaatttaaaaaacagccctttactagccactgggttgcaaagcaaccatagcaagtagaaaggaaggtttccatatatcagctagggctggacaacgtctctcatcctcatcttctcaaactttgcacctgaaagtgtccattgcataggatggaccaacttccaggttccttttttttcctttaaaacttttattttagtttcaaggggtacatctggaggttggttacatgggcattgcacgtcataggggtttggcgttcagaccattttatcatccatgtaattggcataataccaaataggtagtgtctcaatactcattctctggtgtctcttgttccccgctttgtgcctttagtgcttggcacccccttagaaatgcgaagataaagtatttggttttctgctctttggtaacttcacttagaataatggactccagattcatccatgttgttgcaaaagtaacaatctggctctcttatatggctgcatagtattccacagtgtatgcgtaccacattttctttatctagtccaccactgatgggcatctaggttggtgggcatctaggttggtgggcatctaggttcattccatgtctctcttattgtaaatagtgctgtgatgaacatacatgtcatgtgatttggtagtaaaacaatttgtatttctttggtctgtatctagtaatgggactgctgggttgaatggtagttctattttaagttctttgagaaatctccaggctgtttccacagtgattgaactcatttacattctcacctgcagtgtataagcattcccttttctctacaacctggccagcatctgtgacttcttgactttttaatggtcaccattctgactgatatgagacagcatctcattatggttttgatttgcatttcccaaatgattagtgatattaggcacttttgcatatgcttgttggccctgtgtatgtcttcttttgagaagtgtgcattcatgtcctttgcccattttttaatggggttgttttttactctttcatttgtttaagttccttatagattctggatattatacctttatcggatgcatagttcgtgaacattttctcccattttgtaagtcgtctgtttactctgttgatagtttcttaggctgtgcagaagctctttagtttagctaggtcttgttagtttttgtttttgttgcaattgcttttggagtcttcatcatgaagactgatgcacagaatggtatttcctaggtattcttctagggattttatagtttttgttttacattcaagtcttcaatccatcttagttgatttttgtatatgataaaaggtaaggatccagttttaatcttctgcctatggctagccatttatcccagcactattccttgaatagaaagtcctttccccactgcttgttattgtcagctttgttaaagatgagatggttatacgtgtgtggcattatttcagagttctctaacttgtttcattgatctatttgtctgtttttgtaccagtatcatactgtactagttactgtagagttgtagtatcatttgtcatactgtactagttactgtagccttgtagtatcatttgaagttgtaggtgtgtggcattatttcagggctctctaacttgtttcatttatctgtgtgtctgtttttgtatcagtatcatactgtactagttactgtagccttgtagtatcatttgaagttgggtaaggtaatgcctccagctttgttctttttgcttagcattgctttagctatttgggctctcttttggatccagatgaatttcagaatagcttttttctaattctgtgaaaaatgtcactggtagtttgatagagaataacattgattctgtagattgctttgaagagtatggccttttttaacaatattgattcttccaatccatgaacatgcaatgtttttccattggttcatgtcatttctgatttcttttgacagtgttttgtacttctcattatagagctcttttgtcttccaggttaactatattcctaggtattttattctttttgtggctcctgtgaatcagattgcattcttgatttgtctctcagcttggatgttgttggtgtatagaaatgctactgaattttgtacattgattttgtatcccaaaactttgctgaagttgtttatcagagctaggagcctttgggaagagactatggggttttctaggtatagaaacatataatctatgaagacagatcgtttaacttcttctcttcatatttgaatgccttttatttcttctcttgcctgactgctctggctatgactcccaataccatgtgaatatgagtggtgagactgggcatccatgttttgttacagttttcccaggaacaattccagatgctttttcccattcagtctgatgttggttgtgggtttgtcatagatggatcttattattttgaggtatatttcttcaatgcctggattgttgagggattttaacatgaaaagatgttaaattctttcacaagccttttctgactgcacttattaagatgatcatgcaatttttgttttgagttctgtttatgtaatgaattgcacttattgatttatgtatgttgaatcaaccttgcatctcagggatgaagctttcttgatcatggtggattagctttatgacattcttctgggttcagtttactttactagtattttgttgagaacttttgcatctaggttcatcagagatattggcctgaagttttctttgttcattgtgtttctgcaggtttcatgatatcagtgtgatgttagccacatagaaagagttagggaggagtttcttctcgtttttttggaattgattcagtaggattggtaccagctcttctttgtacacctggtagaattcagctgtgaatctgtctggtccagggctttttctggttggtagggtttttttattactgattcaattttggaatgcattattggtctgttcagggtttcaatttattcctggttcaatcttgggacgttgtatttttccaggaatttatctatttcttttaggttttctggtttgggtacataaagatgtttgtaatagtctctggattttttgtttgtttgtttgtttttgtatttctgtggagtcagtggtaatatccactatcatttctgatagtgtttatttggatcttctcttttttcatttttagtctagctaacagtctatcagtcttatttattcttccaaaaggcaaacttttggttttgttgatcttttgcatagttcttatcatctccatgtcactcaattcatctctgattttggttatttttcttttgctagctgtgggattagtttgttcttatttgtttagttcctctaggtgtgatgttagattgtcaatttgagatctttctgattttttgatgtgggcatttagtgctattaacttttgtcttaacactgttgaagctgtatctcagagattctggtatgttgtatatttgctttcattagttttaaagaatttcataatttctgctttaatttcattgtttacacaaaagtcattcaggagcagattatttaatatccacttagttgtagggtttttaaaaatcttcttggtattgatttctactcttattgtgctgtggtcggagaatgtggctggtatgattttggcttttttgaaattattgagaatttctggctgagcatgtagtcaattttagagtatgtgtcatgcatggatgagaaggatttatattctgcttttgttgagtggacttttctgtagatgcatgttagttctattttgtcaattgtcaaatgtaggtcccagatgtctttgttagtaatctgtcttgatgatctctccaatatcatcagtggggtgttgaaatctactattattgtgtggttacctatgtctctttgtaagactaaaagaatttgttttataaatccaggtgctgtagtattgggtgcatatatttaggatagttaagtcttcttgttgagttgaaccctttatcacttcctttctttgtcctttttgatcatttttggtttaaagtctgttttgtctgaaataagaatagcaacccctgctcttttttgtttgttttctatttgcttgataaatctttctccatccctttactctgagcctataggtgtccttgaatgtgagattggtctcttaaagacagcatacacttgggtctttcttctttaatcaatttgccactttatgccttttaagtggagtgtttagcccactaccattcaaggttaatattaatatgtgtggatttgatcctgtcattctgttgttacctggcgttacgtagacatgattgtgtttttgctttatagcatcaatggtgtatgaactttagtgtgtttttgtagtagccagtaatggtctttcatttccatattcagcactccctatgaacctcttgaaaagcaggtctggtggtaatgaattcccttagtatttgcttgtctgaaaaggattttatttctcctttgcttatgaggtctagtttggctggatatgaaattctttgttggaatttcttttctttaaggatgctgaatataggcccccagtctcttctggcttgtagagttttggctgaaaggtccagtgttatccactgctgtggttccctttgtaggttgacctgctcattctccctagctacctttaatagttttcttttcacattgaccttggaggatctgatgactatgtgtcttggggatggttgtattatatagtatcttgctggggttctctgaatttcctgaatttgaatatcaacctctctagctaagttggggacattttcatggacaatatcctcaaacatgttttccaaattgcttgctttctttccctgtctttcagggatgccaatgggtcataagttttgtctttttacataatctcatgtttcttggagatttgttcatttttgaaaattctattttctttatttttatctgactgttaatgtgaagaactagtctttgagttctgagattctttacttgacttggtctactctgctgttaatacttccaatgtgttatgaaattcttgtggtgagtttttcagctctgtcagatcagttttgttctttcttaaaatggctatttcatatttcattccttgtatggttttgttgaattcctcagattcctcggaatgggtttcaatcttctgattttcagtgatcttcattgccatccagattctgaattctatttctgtaatttcatccattttattctggttaagaatcactgcagagcagctagttcagtcatttggaggtaaggaggcaatctggcttttagagtttcaggagttcttgagctggttctttctcacctatgtggactgatgtttctttaattgcagtgtaatttgagtatagtcagtcggtttcatttctgtatgtgttcagagggctgaggctttgtgcagggtctttatttgcagttgagttcttgtccttggttttacagaggagtatattaccaaagtatttttggtgttgaagtttggtttgcaatttaatagatagtgcttaaacataatgactggtagataggctcttacccagccatgcagcccctctgtgtttcctcacatttgtagccatgcttcccctcagtgctctgagagtgtgtgatcctctcccactcaagtgctggtcatagatctcagcttagcactcccagactgtgcactgcaggcctgagacaagcttaggattttttctctctccccagcttggtggcagcaggggcagggaccttggcatgccactcagagccactgccaattagaataatcagctggggaaaggtggttgcattgcaggcccaagctaggggctcatgactggtgaagagcaggagggcaggggaaggcagtcttgcctcttttccatagggcactgcagcatgctggaggtgcacaaattccaagattcctaatccatccctaattactggctagagagggataaaattctgatactgacacatatgtttggatggcactcctctgtctctgtcttctgctactggtcagacaagcacagcaggtaccatttattctacaagaaatttctgagtgtctgtaacagaacagtgttagttaattagggattagacataggccatgaataacaatatttctcatcgtggacactttacctagagtgactatcattgtggtcaggccaattctggacacgtatttattttattttattttattttttattgttagttgccgaaaggtagattcttctgcaagttttataaaacctcaaaaactaagtgacagcacttaatcaatacttcttgtaacaattaaattaaagtcagaagagcatttccttacttagttctaggaaagtaaaagtcaatcccataccaactgggagacttaattccaaagcaggtttaacgttggcctgagctgtttactaaaataagaaacgtacctgccttgagcttactcctggtcatgacatggaacatacttttgagaaatttccattttttattgattcacaattattgtagtaagattgatcatttgtatctggttttgtcaagatacctggagggctctgttgcttggctggttacacagcaagactatgtctacatgaccagctgagtaaaaggaaacctggctgaaactgaattttagatcatcttgtttgaggtgtttttttccacacatccatggtttctggacccagagagaaaaatataaggaccatattctggtatggtccttatagagagagggcaattagacccttcaactagcttctctgaacccatttccctgagccagcctacggctgtgatacacatctttactttaatgcagtttctatattttatcattttcttgcaataaactgcaaatttgcaagcaccgtcacttggattctgccagtctttgtcagcaacagaagcctgtctaagtgccacagttagtgtgtgcttactgacctaggtaggcagactgaatttacaaggaaacattaacaacaggcagaaagagcaaattgtgtcattccttagacaggcaagagaattggacaaatcgtctacaaccaccaggtcattcattttttggcaatttttgttagagtttgtttttagacaaatagacaatgatcattgcattgacacaaaccattagctttccagcttttgaaattctttaaaaacaatctaagctgcaccaggctaacaaaacagatattaatgattgtctccgtgaatgaaattgggaaacttacgtaattattgcctaggtgtggagagaattcctcaagctgtcagttcttggtttttccttgtgcagagtgctcacctgagaacagaagatatgttttgatctgtaagctcagagactgagtaaggatgaaaataaagtttcctagcttttttctatttttcaaggaaagttcaactttcctgcaagaatgtcattaaagccaccatttgcctcttggtattgtctagaaattagtcaccaaaatatatgaacttttcccagacatcatctgttttcactttaaagtagcaatatgaagtcctgggtgggataggtcagggggcagtgggggcggggatgtgagttgggagatgataacattagagaaaccctggggaataagtattgatttttgcttgttacatgagctggctgtgcctaagcaagcccatgtcatgtgtttaaagtgccattttatcaggaagacattctagggtccttctgtttaaataattcagtgagggttttgtgaaaatgaatttataggccaatatgaacacttgggtgatatacagagcagcgcaggtgccattactcaaaatcccagtgctattccaccatccaatatacagagaaatattaacctaggatggtggcaagctgagaggccccaagtatttttcacatgccactggattcatgaccaatatatttcgcattacttgtgtccttcaggtagaatcgagtatcaacatcagtcaaacaatataaaagcaatataggtcaaatctccggcttttagaataattctcatcattttgctccagcttttatctgccacttgttaggaaatctgtcctttcgggactctgaggatgtcacctgttacttgtaccatcacggcaataataaatagtgccagagacctctgaggagaacaaattcaagactcctcttcaagagctccttcgattctatgctctgagaaatgttgggcatagttctgcagcacccccagcccctgctccaaggcaatcttttgctaactattgttcgttttgcagaagacacagcacctgcttggaacccacggctatgaagtactggaatgagaagtaaataaaataaatattgagtcatcccctagtatctgccagaagtcatgcaaagcaagtcattgaaaatctttacaattcgtaatattcttcctcaaggtctgtttaattgacagactagaaattttgagaaaaatttaataacaatatgatatcagtaacaagaataatgatatttatagtaaaagaaaacaacccacacacatatctagtgaaaaaaaaatccagagggaaatatatcaaataccagtagtggttgtatgaagattgtttcataggtagttttaaattcttttttattctctatttttttctatttttcattatgcataatctggtcaaatattaaaatggtagtttcagccatgaagaaatattataaggcagtaatatatgttaatttgccaaattaacaacatgttaagatgagggaaagactatttgtagttgaaacagtcaaggaagctttggtggaaatgcagagaatgagacaaatattgacgggctgcggacagaagaggattctatatatggctttataaatttgtgaatgttttgttcatttttactctgtggtttttttttgttgttaatgaacttttacttgtaaaaataaataagcaaacaaagatgactatgcacttaatgagtaattgccatagcataccaattagttagtttgctaatgacatattaattatatgtaattaccattagaggggtaagtgtacatgacaaaggagagcaagagactctctcttccttctagaaagctgggttcagagagagagacagtcaggggacagggaagggaatgaatgaagtcggagaaatatgcattattattgtatatcaagtgctttcaaaactgagctagagaaggcaggcacatcatggacggtgttgcagacatgctaaggtgtttgaacttaaccttaagttattacttatcagagtcttccaagtagaggaatattctaatgaattcagatctgatttttcttactctaaatggttcaaaatcaactgatgccttgaagctaagtttagtgatgcaatgtttttcttcttccatagagtcatatatttctaatttcaagatttttctttataatttatatgacttgacatattaaaagtgagataatgtgtattaactgtctgagatgatataaataagaatcatgtttaaaatgcatgtcacacatacattttttagtcaatcatggtgatgtttaacctgacaagatcgcttactaaagctgagaagtagcttatatgttcttatgaaggactccttgatctgcaacatttgatgcccattttttttcctgaaagcatcttcttgttataccctagtaagctttctcttttacatttaagagaattccaaatttaaacatgcatgagttacagtttcagcagaagaccttattcaacgaagaatatatttaaaggaagaagggagtatggatggatgaacatcaaccatattacttattccatgacctaactgaaaaagagggatttgggtcaaagaactctcttccctggagaaaatgaccagaactttaactgtggctcattgaggcttctagaaaaccagaagatttggcatcccttggcattttccctaaaagtgggtggctgcagagggctgtttccttggaaacattgtttattggtctgtaccatagtaaaatgtccagggtttctacactgaagcaatgacagattcaaataatttttatgaccactgaagctcaaatttcattgtgttacccttctatgctcattaattaacattgtatttcttaggtcttgaaacaaataaagtaaattgtaacagtcatcaattctgagtagctggtggtcagatatttgttctatcaattgttttctgtattttaaaaatttctaaaaatttttatataggcagcagtagaaaaattgagttaagcttgtgaactgacatcaaacctaaccatttaagttttttttttctacttattttttaggaaagatgtcagtattaggcaagagaagttacttaaataaaaataattttagtaacgtaacttctcttgagtgtagtgagcatagcattataaagaaaagatatttgaatacattttgaaatgcagtgggaagaaatttgtttgctagtgtttggggagccaccaagttctgttaatgatagacttgaataaaaattgtggtagtacaaggagcatttggatagcattatattttagatgataaattctgggctactgaagtctactctgaatcatcaatttcagtgttgccttatcaccaaatattttccatggtaatcatctgggttgccctttgagaggttattttggtaaaagcaatacaatttctaaattgaagttggcagaaataaaagtacccaagaatatatcttactatttccatggtaatatctccctcttagacctgtgacctgacaagttatttttgaagaaaaggaagttaggtgggccaacggtctatttaactagtctgccatcgtctattccacttactgctatggtcaccactagagtgggagagagcctacacggaattttccccaggccttagagtctgctattacatttgcaacgaagaaacacaaggttctctgaggctttccccctgctggaagtcatgattctagtgtcagttgtcccatttctttggcagaaatgggtggtagaaaactgatcccagcaccctcctcacaaggagagccaggagcttctacacagagcacttccaggtatgtttagcaccctgactcaccacttggagagccaacatgactgcagagggtttggagtatgtgtgatgcctgcttgcaagccacgggcagattctgaggtcttttcttgataaatcgtgtagtcacacttaggatctctcatgtgcttactcaggactggttcacattaggctgcttgagcactttttttttttttttttttttttttttttgcccttttccctgacctggtaaaataggcctggctacttagtaaaggctggtgaatagccaggagaaaactgtgagtggcttctaaccactctatgggtacactttgctcctttgcccccttcagatggttcctcctgagagaaagtatagtatgggaataaaggaaatatgtgtattgaagagtggaagagatacaagagcaaaggagatctctcctaaaataagatggctcatgtgagggatttcagcattcctgtgcaggcttcagctgttcctgctcttcaactcttctgtttgccttttgccgtttgttctagtttgaatttatacatgaaattgagaacactttcagcctttaatatcttgctcttgatttgggacaatatttatagttttctgttttacaaaattattttcagccaccagaaatatttataatatagcttattcaactggggaattggttattataaatgtattaatgtaacatgatatttaaattagacccacatggttttttatatctatatttttattttttttatgaagtctcgctcctttgtcacccaggctggagtgccgtggcacgatcttgcagcttccgccccccgggttccagcatttctcctgcctcagtctccagggtagctgggattacaggcatgcgccaccatgcccagctaatttttgtatttttcagtagtgacagagtttcaccattttggccacgctggtctcaaactcctgacctcaggtgatctgcccgcctcagcctcccaaagtgctgggattacaggcatgagccatagctcccggccagattattttataaaactaataatttgtttttaattgatctgtttcgtgatatcaatggtttaaatgtctaatctactcaaaagaaagaaaaatccatgattttaattttgaaaagctatctagcaccacattttttcattgttcttgacacaaatcatacctatattttgaaagacttttacaattccaatcaaatgaatatacctaagaaactggaaaaattcacattacatcaatagaatattatattttacctttatggagaggctcaattaaatgtatataaatgatataaaacatgatttacattttaactgatgaccagtttttttgcctttttgaccatatgcgactacatagccagcaccaaaatgaaacaaaacaacagcaataatttaaaaacttgttaacaaattttggtatctttctgccactcctgcagaataggaaatgcctccagccatctacacatccacacatctatagaaagcaacctctaaaggccacatagtccaataatcttatcaaattggtaagatttttctttccttcatgggagaattttacacttattgacagtaattggctatttctaaagaagttaggccttttgtttatgtttcacatgaacaaaatccaaggttatagttagattctaaaataactaattttcatctaatcaacttgtctggaaacttaccagactcatgagaaattgtcttaacggtaagaagcttcacgctctctttatcagactgaggtctatttgaaaaaaaaaacatgaaattaacaccacagtaatcagcattgtatgtttgtgaaagtattgtgacacaaacagaatgacgaagatacatatgcatatatatatataatgtgtgtgtatatatatacgtgtgtgtgtgtgtatacatacatatatatatatatatatctccatggcaagaactttgtcttttcacatacaaatacacatatactttttagcaatttttactttttctggaatcaagccaataaatccctgccactctcttatagtggtgattgtcagataaattaaaaattagtttgagttgtgtgaaacacttggcacaaggtccatatcgcacatgtctccaattctgaattatggagaggaagacatagaaatgtttacaagccttttgggcttaggctgaattctggagatattccttttcctgaagttctgagatactgtagtatagtatctgaactgcctattttaatcaagagttctcatctatccaaaagagtttcaaactctaattatttcctttggacatctgaggagtctctaagtcatatgaatagtaatttagcattatttctaaagtttacaaccttatgaaacataaaaacacttatataaaggtagaccacaaattcctgtcaacaaggaaaacagggtttgttttgacatgaaaatcaattcatcatgtctctttgcagcaccttggttgttacagttgcctggattactaaaatctgctttattttaatcaagtcaaagtaaaacagccatctaccttaaaggcactgagaactggctcaaggtagaagcacaaatttccctgtgataaacatattaaaaatttcactgggaaactattttaaaactctaggtattttttctatgatattttccctcataattatattcattcttctacttttccatttcatctttttatttcccattttaccattctaagattaaacatgatcttacatttggaatttctctgttaaatggagagagctctgacaaacagttaaagccaatatgtagattttctacactttagaaataatccaaaaaagtataagtagagtaacaataattttcactacgtaaatggtagggtctaaacaaaagatgatatgggcttacttactgatcatttccattttctggtgtgcctaggagaagagggagttgttattagagttgcaaagaagttggctaccataaatatgagcaagcccctctaaccccctcacctgctgtccactcttttctatgcagagatgtttctaagtcattttaaaatattttaattttccccttgccaagccatttcctcaggtatggttaatacttatcctggcactcatgggatagtcctaattaggtcaagtccactaaacttagttctggactaatcttgatcttgtagtttcatatcactatgtgaaattactgttcattattgcatatcccatggacaacagaaaatgtctgtttatttcagtatctctgaaaaaattctattaaaagtattgaaggttttatgccagagaattgaagttttgactttcctttatacattgttcttttttgggacagaaatcactgtgtttgtggtgagctacaatgtagatactatatctaattgtatcttaaacccactgattcagcctctcaaaagagccctgcaaaatgtcgcagaggctactagctgcaactaatcttttgttctctttgccaggctgcttcacagctgtctgatagaaaacacctggggtttagagtgagaactcagaatgattcattctgcacaaggacatggcctctctggagtgaatgttggtgatcaaatcttgcattaatctatggccaatcaggccagctgtttaatgtgattgcataaggttccccttgttgtgctcctttggtctggttttattccattgcagcttctgtttcttagatttccttttatatgtaatctaaatcttgtcattgagtatgccctttgaatataattctcctggctttgactatccttgttttataaagaccttaacttccactcatattttggctgcttctatttctgtcatcttggttaagatattgccatcgtaactcttaatacgtaggatttaacccatggcaccatatgctgctcaccaattagacttaacctcatctttgctccatcagtaaggttttaacagcattttttgattcctatgtgtcatatacaatatcacctgtgatgctaatagccctgttttaaaatgagtttttttcatttataatttttgggggtacatagtagatgtagatatttatggggtataagagagattttgatataggcatgcaatgcataacaatcacatcatggcagtggtgtatccatcccctcaagtatccttcgtgttacaaacagttcaattatattcattgagttatttcaaaatgtatcattaagtttattattgactatagtcgccctgttgtgctgtcaaatactaggttttacccatacttcatacatttttgtacccattaaccatctccacttcccctccactacccttcccagcttctggtagccatccttctactctctagctccatgagttcaattgttttgattttttagcttccagaaataaaaacatgggaagtttgtctttctgtgcctgacttatttcacttaacataatgacttccagttccatccatgttgttgcaaatgacaggatctcattcttttttgtgactgaatggacatcactgtgtataagcaccacattttcgttatctattcatctgctgatggacacttaggttgcttccaaatcttggctattgtgaacagtgctgcaacaaatgtgggactgcaggtatttctttgatatattgatttcctgtgttaagcgtatatacccagcagcgggattgctggatcatatagtagctgtatttttagtttttttgaggaacctccaagctgttctccatagtggttgtactaatttacatttccacccacagcgtacgaggtttcccttttctccgcattctctccagcaaaatgtattgagatttttatatgcctgttttaatattttttccctaggaaactatagcgatagtctcattagcagatagatgcaagccaacagactattttctgcgtatataccattcttatttggttaaagttcagtccactgtcaaccttgtccagataagcttcatttcttacggaaatctctgattcatgttgtcttccacagagcagaatgggtttactaatttcccaaactagataaagtctctcccacatacttgaagagtgattaactgcaggtatttaatggtgctaatttaatgataacagtgctgtaaattctgtctcagaaacaaagttaacaacaaccaaaaagatttggctaattgtacaattgccaaacttgactttaaaatactcatgtcttcagaatagctatccgtagtggtaggaactttatacatccatggaaaccgctttaatagaaaaggtcaacttttcaaataatacattcttaaatcttcctatgtaaagtaatttttagtatagcatatttttacaaataaatttagcacattaatttttacatatcctgcttactcaacactctcaggctgattttcagtaaaagacaggattggtaggtagttcagaaacttagagaaattaaactgacttataaaaatgctgtttctcctctgaaaactgaacaaggagacatgtttcagacattaagaagtttattcactgattcccaaaggaaaaggcattgatttgtttttacttttcaccaagagctaaaatgaactctgctgttttggtctcctagcttctcttggtactgtcgttatcatactacaactgtccatgcaatgcatggtgagcaggtggctttagggatagcattcactggtgtcctggggggcacactgtccatgaggtaaacaaagaataatgcagcttatatacattataaaaataattgctttttaccttctaacagtttatgagacttagatttttttgtgacatatttagaattaaagtggggaagaagaattctatttactgtacctttaaaaatgtaactcaataagtatatagtaagggcctgctatatattaggtagcatgcaatgtgaacaatatgtgatttgtgacttggaagggttgcctgactttcaagagaggtaggcacatggagaaataagtaactgtactatggtatgataaatgatataatccaaatctgtagtaatacaattaaaggtagaattcattctgcttgaagaagtggtatgttataaaaagatacagtaaatttgtgtttgagttgagtcctaatgggtaagttggagattaggtatgttatgaaaggtaagaggtgggctggatattccagaaggaatagtatggatgagggcatggatacatgctactacattatacgaccagggctgggctgtgaagtggaaagatagtttgcaattacggtaacatgacagctgagccatgggagttgaaggggtatttaggtgaaggttgagtaaagaagaggcaaatttcttggaacagaaaaaagactgagtaaagactaaaagaaatcagaatttagttaacaataatttatcagtattagttcactaattgtgacaaacataccatcagatcttaataagggaataagggaaactaggtatggtgactcactgtactatctttgcaacttccctgtaactctaagtctactctaaaatagaaagtttatttttaaaaaggataaaaaatataacatggtcttggaagatactttcgttgggtgtgtctcccaggagggaaattagtcacgggacattttttgagattatgggcccctgagctgaattcttagcaatctccctctttattttctgttacatagaaatggagttaatctttaccatagacaagttatgtcattgttatgccctctttactatcatattcccctgaccacccataaaatttgggctattttattaaaaagaatttccctatatttgataatatctactcatagtatttagttcccactctgcagttcactagcattcagtgggtgtctgtgcccttcgtcctttgtttctgtgatcaggaaatatgacatttcatttctttctataacttttctctccctttaagaatttaaaatcaagtttaaactgagcattcattcttctttcaggaaaacaaaacaaaacactgttacctacccggatctgccttccagcacattcggtacaaacccaccagaacaaatactgaaagtgttattacaatcaaagcaataaccaccggcaaaataatacctaaaaagaattggagacattgtcaattagagtggctactgaatttcacagcgatagtttggtaagtgagccaaagcatgagtacttcctttcttctttaaatatcattctattaaaaacatattttaggcaaagattcctctgattcatggggtttgctctagttgtcatctttgacataaccacttgatgtcagtcttgtaacctttctgaaacaaaattccaaccttaagagagagtgcccccatcttcctggagactgaagaagtggggagatgggagactggagaagcagaagatgtactctagattataattaaatcctcattcactcattacattttttagtactttataatgaagttaccaaaatatatataacccaacggggattgctttagtcctaatgctggctttctaaaacactcacaaatttctttctataataataccttaaaactagaaaaggcataaaataatgtaagtagataccacagtgaagatgattcttgaaaatgaacatgattcaagagagatgtgtatgtgtgtctgtttgggggagtgatgttgctgcagtaacttagggtgagtttttcatatttgtattaagaggaagagtattgcctgccttccttccttccttccttccttctttccttcttttctgatggttatttccaaggttaaaagtacagtgataaaagcaagagagctgtcatagacacacaactaaaggaaattaagatgactattagtttagcatatttgctttcatatgtactccttatatatttatcaggggtgagacttactctccaattcatctgtaggatggtttacacttccattgtcagagttaaatatttgttttaagtaagttctgctgatttcataatagaccttaggtgaaatcattattgcctcccaaatgaagatgccgtgaatcagcaggtcagtaatttctatgatgacttatttaatggaatgggtttaactaaacttaatagagccttttataataacagttttgaatattgtctttttattcttaattactaaggaagttatttaatattctgtattcagtcttagcacacacataaatgttatatgacatatataggttttagttaaaatggaacatttcttaaaggccgtttttaatgttctatgaaggcaaacaattcattttttgatataatttatttattattttaattatttacttgacaaaaataaaatatattcagggtatacaacctgataatttggaaataattcacttttatggggacctctacctgtgcattttgacttatctgaaactagtcccatcgagtcatccttggcccttgatcgtaattgttaaacactaaactaagaaaaaaattgccaaactgtgctttttttcctcttctgttttctttctttctttctttcttttctttttttttttttttgtcattaagactcacttgtgggaaattttcagagcaggcagcagttagatgggattgtaatgggattgcaggctcagtaaagttgagaaaaggctgcccataatctgattcctctcctttactggtcacattcaaacattctgcatatctactgccatgaatgaaggcattgctgttactcactggaataagaccggctggttgctgaagtgcttgcattttttccaccctcagtgcctattactttaagaaagaaaaaaacaagtcacttttggttaatgtgtgccaattcttgcagtcctccctccaccctcatttaaggaaacagccatgatttgtaggtatgatgctgcaagtgcaaaagattcagtctcattctgaaggagctctgttttgtgagtcaagattgttagggtttcagtcaagaaagggtcaggtagagcagatttccactcaggcacacagatatcataccttgagactgtgaggtgttttctggaattgtaactggtattgaggttaatgtaccagttttagaaggtgatgcatctggttgtagaacactacctgtatgaaaattacaaatgcagaatcaggctatggtattaagccttcatatgggatttctttgcagattcaaacagtttgcttttctgaagatctgtgaaaactatttattgtcaaatagtaggataaatgcaatcataacactaaaccataagttcatccattcctcctggaaagataattaaatttagaatcacaaagcctgagtatcagttttacatcttcaggaactcgccaagaaaacttcagtaagttttttagcgtagattacagcctgtataacctactgcataagattcttgtgggatgtaaatctatgcaaaagcatttttcaaatttcagatattataactttgggtgatagtgttttttttctatcacacatagttaaaatgatcataactgcacaggacgtcagattttatgtatttatcagtgattgaagagaaaaaaattgcagttgaggctttggttagaagaattgaggaaaaatcaaagaagactccttcattttcatccctaaagttcagcagctggttttattatgtgccttttctagagtaatgctacttgactgttttttttcactagcatccgtgctcttttttttccaaggaaaatataaattaaaaatttattgttatcgttatttgtttgtttagttaacatttgccatcttcaatcagaaggactgaagcaaaaattataagtaaaaatctactattcaaaatccatagctgtcaataagtttaaaggaaatataaataattaagtattgtataagttgaaaacatttattcttgtgaatttggaataaagtacaatttgtacttagaaaactttttgaaaatgtattctcttcctcgtgcagtatgaagtgctctatttaaatcatgcctgtttgccttgcctcttcactgaattgcaagttcctagagtgtgagggccatacttgtccacacacccaacatggagctctgggtacagggggtatgcagtcaaatgtagctgacactaagaggcacttcttatgattatggctccttgggcgtattgaggccatgtataattgcaccaaagaaattgatatttctatgactgccttggctcattccttcttcaccacccacatcccagcacgcactgcatgctcatgcatttttgacatctgtgggtgaagaataacgttcagagtctgtaccgttcttgccatgcaagagatctgtgggtggaagctagatatatgcccataagaacaaagaaaaatgtcaggctagtgcactaagcaggcagaaaaaggaatattaaatgaaagagtgggaactagctgaaaccttggtactttcagctgccttttccagtgtcaagtagtttagtgaggatgaatgctctttcagttttcttggtggaaaagaaggtggctgattaaataaccaatgatgttaatccttttgggatttctcaagggttaattgtcctaccatattaccttcctgtagacaggctaaatggcagactcaggactgattgtaatgtgtctgggtcagaacaaactcccaacttccctgcttaaaacgtgttgattgcccagtgccaatggttattgctaatgacccatggataggccaaaatgttaagacttcatagtggaaagatttggtggctgcttgaacaaatactttaaaaatttgttttgtttttctttaaactgcaaccttcagttaagaaattatttctgaatccagcacacacacacacacacacacacacacacacacacaattactgctcatgatccaataatgggaattaacctacagtttgagaagctctgtgttttagcatgatcatattgctgaaattatggtacttggctgaatccataaaacatgagcctaatgttattctttctgtgactaagatgcggaatccatgacatgctcagagcctgatgatctacacagtttttgttgagactgtattatcctacattactaacaaagtggcattgccagaggaagtataggagagctatagcagagtggctaagagcatgattctgaagacaggatagctgggtacaaatctgactctagcacttacccctgtggaatcttgggcaagttgcttaacctctatgtgcctgagtttccacatatatacatggagattataatagttctacatcatggtattgtgaaaattatatgagtaaaaataaatttaaactgtttagaagggaatgtgatattaatatgtatatattatatataataataatgttctattcttatattatgattattcccctagagagttgaacctcccaaccaaggtcagtttgtctaattttctcaaaaattctaagaatgaaaaatatatgaacttcagccacttctgtgttttcacatgcttctttgctctagtcaagaagtagaggaactggagaaactggagtagaatatggtactcttagatgacatagatttgttcttggaccctgacttttggtgattgttatgattattgaatttgtggctaggttgtttcaggatttaagtccagcctggaaacttcaggtcagaacttggagcaagctgatgagacagagaccctcagagtcaagtctgttgtaataatgtatgcccaaatttaccccatcagcatctgacaatggtacatatttggagacctcactgtagaccaattacttaataaatcattgagagttttaaagacagaagacctatcaatgtcccaaggcacctgtgattgctataataatgctcctcacagaactccaactatagaaagcataagtgaccaaatttacccacgtgtcctctgaaacccatctctctgtttgtgctggtgccatgtctctctaaggctgctcccagccaatgagtggacctgccaggaatattaaggccggcttgtcctgggaggaatgtggactggaggattccctgatggtcttgctgaacctcccctagaatgcatggcagcctagatgcttctgctcagcatccccgttctctctccctatcaccatgtcagatgtgcatttcagtctggtggctcttctagactttccttgtcccctcacaggcattttttctctcataggcattttcccctaataaaatccttgtacttttaactgaatcttgaactctgcttctctgaacattcagattaaagcagtctccctggcaagtatttaaaaggccacttcttattgggagtagaaatgaagcctcaggaattttaaactggacttggaagacttgggcactggttcataagggaaatatctgtttgtttaaaccttttattttccattttttttgggaagcctaactcttcctatggaaaatcaccccttccccacttcatgtggtcatgaggtgcccctttttaatccaacttcagagtcactgtatgactaaagttctctcctaagaatttgagtgtgtggtgattttgagttattctcagagtgaagctctaaagggactatctatgggtttacaaaatccctgaaattactacaatgctatccttctttattctgtgagtttccctccccaattttttttttagttaaaagaaatcttgggcagggcatggtggctcacgcctgtaatcccagcactttggaactggtctctaattgtaatttgatagattattcatgtcccatttaaaaaaataacttttcagcctttgacacaaatctttctcttcttcttatcacgttttctttatgtggctaccaatagaatagagcagactattgatattttttctttttcgtctccttggttggttcctcctcttatttctttttttaaaatctttttaatatttctttttatattgagaacaggatcttgctctgtcttccaggctgaattgcagtggggcagtcacagttccctgcagccttcatttactgggctcaagtgatcctcctgcttcagcctcctaagtagatagggccacaggtgtgcaccaccacacccagctaattttctctctctctctttttttttttttttgtagagatagaccttgctatgtttctgaggcttgtctcgaactcctgacctcaagtgatcttcccacctcagcctctcaaagagctgggattataggcatgagccaccacatctgtcccctcttttctttctaaattataatcttggagtgtcccctagggtttagtccttggtcctcatctccaatgaccctcatttatttggagatttcattcaatttcaaggtttaaatgcaccaatgtcactgattcctcaacttatacttccatcccagaccttttcctaagctctggatttataaatccggatacttacttagcaagtaatagacattttaaacccaacatgtccacattttaacttccactctatctgaagccttcctatccttgcttggagcagacattccttccaattgctcaggccaaagacctatttttggctcatctctttctattctattccacacgcaatcatcaggaatagttattggcttcatctccgaactaaatccagattttggagattttgtgccatctactctgtgatcaccctggtcaaagccaccatcttctctctcctatatcctttcttccttcagctgagttataaaacatgggtcagctaatgtaacactgctgctcaaatccctcagtgattcaccattccacttagagaaaaagccgaagtccatgcaatagcccacaaaaccctaggtaatctgcctggcaaatcccctgcctcaactccgcccacttgcttaatgctgtcctttaaacatgccaggcctctcctcaagttctagctctgcctggatgttcttcctccacatattgggtgactcacttccttcttgtatttactcaactcttttcagggagacttaccttggccacttttttcaatcttgcaaacccttccccacctctccagtgcttgtgatcccttcctcctctattgctgcacattttctctttctcagagcacttatgccttttaacttactatataatttagttagttattattttattgggtatagtttactttccctgctagaatataagaacctctagggcaaggatctttattgtgctcactcatatttcccaaatgttataacagtgtctggaagtagggcccatcactaatcactgaatgtataaacaaacttcttggcagcagaattgactactgtgaaagatgaagtgaatttatgagattaccttttaatcttaacatcgggattggcacatgtttaaaatcgtgatattattattttttctcattcattcgacaacaacaaaaatagagacctactctaggtccaccactaaatgttgaagaaaatacaacagagtatgagaggtagctgttgcgtttacggagctcacattttagtagggaaggtgagaagcatatcccaaaattgatagatgtgaaacatgcaataaagaataagtaaaacagcatggcaaagagcaaggatcaaaatagcagagactatgttattgtttattaaattttacttacaactcttaataaaaagaacttgaggagcttaagcaattatacagaccataagatgaatgaaattgaaataagaaatcagaacaaatgcaaatggaagaagtaaacaggccccttctaagagttaatatcggacataaacataatcgttggtgttggccacaagaatggactctgagcaccctgacactcagggaaaggagaacatgaggtctactctgggctgttattattggagaggaaaataatctattatataagtgaaacatgagtggtatagacaataagtgctatgactatagttgatgcaattctgtgttttggaaagggaacatgttgatataatcctggagtctcctctaactttagggttttagattcttttcaatctgtggctagtacgtattttcacacacaatggtgcctcctgtctacttcataggtaaaatatcacaggaggaattttctgccttcggatgatgcaaattaattcccgctctcatctgaccttacctttctgacctggttgcactcttatagcaatgcaaaaaaagccttaccttaaatttcctttgctttgctttgggccgtcaatgttagtaacctgaggtaataacatcttctaacccagaaataatggaataactgaatggagattaacgtactttaattctgtagaaatatttgttgtagaaaaaggatatatttttctttttgattaaaatagtttttacaaaattatatatgataagagtgaatgaggcactgtgctaattaattccatatgtgctaatttattttattcttaagcaaatatttttaatcctgtgttttaaagatgagagatactgtggctcagagagataaggtaatatatttaacagtaagtgcaaggctaaaccataagccaaatatgactcaaaaccctttctgttttctttctaatatgccatgtaatcaatagattttaaatgtttatcttagttacttatgacatcattatcaatggaatcaataaaatctattcttagcattctgaaagttttgagatattctcacctcttcctgcatcatgaatatagacatgaaaacattaaaaaggattttattttcaaacccttaaaagagactaggtgacagacattgttctaagtgtcttacaactattaacacacttaattattgtattattagtatttgcattttacaaagtagaaactgatgccttgagagattcatttgcccagggccccacagtaagtaggtggcagagccaggatttgaatgcacgctctagagtctgtggtatcaaccccaaaattatgctgcccaatctgctgcatttcagtaggaatgagttataaggacatgactcttatttttgttacataaaatataatctattttcaatttaggcctcaatcaaaaaggcattttttcttatcaaaacaagctaaacactttccttcaacaggtcaaaccagaccatgcagatagaaacaaggagacagggagaattattcctaatatagtaaataaagcgtgtcgtagagttcattggagaaccatacccatttagcaataccaggaaatgtgttgcttcctaaagtgattgctgggcagctcaccagtgaagactgtgagtttttatgacttttcagtgcagactagggtggtgcaagaacagtgcagagcactactttgagattcggtagatccctgaactagataagaaaccacttagccatacccagaatctgtacaatttcttaaggagaagtttgtaccagacacgatcacatatacgttgatatatttcttattccataattgaattcttttattctcaattaattttctaaacatcctaaaatcctatgttaaaaaaatctagatattactctgctagaggtatatttctagcttgagtggatcctaactaaacgacaatagcaggattctgtcattcaaagttagaaaacttaaataaactaccccctatagaatggttcatgtttcactttatataagttcctagagggtcagcagccaatgcccaaaaataagagtgtcaaacacagtgaatatgctcagacaggatggagcatcctcttttccaaaggcctttggtcagatttggtgggacttctaatacctgttctggctttgtttttctatcagatgtaatgaccacaatgcaactgagactctgaaacacagttaaggaaagtaaaaaagatatgtatgatgagatctttcaagttacgctagttgctgtaggaatattgtgatgattaattttatgtgtcatattgaatgggccacaggtgcccagatgtttggtcaagcattgttgtgagtgtgtctgttagggtgcttttggataaggctaacatttgaatcagtatactgagcaaagcagattgccctccctgactggttgcctctcgtccaaccagttgaaaccctgggtagaacaaagagggaacttcttctgcctgactctcttgaactgagacattggtctttccctgagttaggaggcaaactgaaacactggctcttcttggagcttgaggctgccaacttttagactggaacttatgccatcagtgaccctggttctcaggcctttggactcaggctggcattactccatcagctggcctgagtctttagacctctcagcctctattatcacatgagccaattcttacaatacatctctctctctctttctctccctttctgctctctctctctcacttgctctctctctcccccatccctctatctatttctctctctctctctctctgtctctcgctctcgctgtcaatgcacaacctattggttctgtttgtctggagaaccctaatacagttgttttccccagaaaattaagggttaatggcttattcctttctcaattcggtaaggcacaatggtccattttgctcagggctgagatctcttatcaatgaaatcaaaaggttcattttcaaggacaagttattagctctgcctgtctgtgtgaaaatgataaggctaaagaaaaatgaattccatgattgcttaaaattgttgtaatggctatgcaatgtttgcatttatctttagggaataaacagcccttcatcacttttcagagggtcttttaatctcctcattaggtctgaacttagagctagaaaaatgagtaggtagaataatctggctgccaaggggtcaattctttcatgaaccctttctcatcttttaaaaccagcctttttttttcacccaatggatacctcaaccacagccaaaggaaagaaacgaaaaataaaaattactctatcctctgatcttacataagattatctgaagttcacccatgacatattactttatacctacatgactactagaattattatagttatgtataatattgacttgtgtccttagtaactgctaatggcaggttccatgtatcattcctcttttagctagtgtacacataataggaacaagatgaatatttattaaaagccttggttaatggtggttgattaaatataccattctgtatagttagcataggttcataccaagtttggggccttaccagatatgttacagtgggcagttgcagtttgattttccccaatactttaaatattgagcataattttctcatgttaagcatcattaaacacagctttctatcacatactactgttgtgctattgaatgaaatgagtggagatgtctttagatcttgattgatcaattgatcatttccacataactataattatctttctttgatctctcattttaaaacttaaataaatttttaaaaataaattttattgtatatatttaaggtatacaacatgatattatgagatatatttagatagtaaaagttactatagtgaaggaaatgaacatatcaatcatcttatataattatacactttagttgtttctgtggcaagagcatggaaatctactcatttagcatgaatcccaaatacagtacaattgtgttaacaatgtccttatgttgtacaatagactcctagactttatcccacatagctgctactttgtatcctctaatctacatctccccatttcctctctgtccctggtaaccactgctttgttctctatctctgtatatctgaatttttcttttagatttcacatgtaagtgagatcatgcaatattatttctgtgtctagcttatttcacttagcataatgtcctccatgttcatccatgttttggcaaatggcaagtctcattattttttaggactaaataatatttcactgaatatggaatattattctttatccattcatccattaacagacacttttagtttctacgtcttggctgtcatgaaaatgggagtccacatatccttatgtggtggtaatttcatatcctctgggtatatgcccagaaaaagggattgattgatggatcacttggtagttctatttttaatttctttcaaaatctccatactattttattttttttccttttttttttatttgacagtctcactctgtcatccaggctggagtgcagtggtgccatttcggcccactgcaacctctaccttccaggttcaaatgattctcctgcctcagcctcttcagtagctaggattacagtcaagtgccaccacacctagccaatttttgtatttttagtagggacggggtttcaccatgttggccaggctggtctcaaactcctgacctcaggtgatcctcctgccccagcctcccaaagtgctgggattacaggtgtgagccactgcacccagccgaaatctccatactattttctataatggctgcaccagtatgcgtttccatcaacagtgtacaagagttcccctggctgataaaagctggaaacatcttgaatcaacaacctaacatcacaattaaaagaactagagaaccaaaagcaaacaaaccccaaagctggcagaagacaagaaataaccaagatcagagtggaactgaaggagatacagaacgaaaaaaccttcaataaatcaatgaatccaggagttggctttttgaaaaaattaataaaagagactactatctagactaataaagaagaaaggaaagaagtatcaaatagacaaaatcagaaatgataagggggatatcaccactgaccccacagaaatacaaacaaccatcagagactactataaacacctctgtgcacataagctagaagaaatgtataaattcctggactcatacaccctccaaagactgaaccaggaaaaaactgaatccctgaatagaccaaaaatgagttctgaaattgaggcagtaataaatagcctaccaagcaaaaaaaaaaaaaaaaaaaagcctgggactggatggatttacagttgaattctaccagaggtacaaagaagagctaacaccatttctactgaaactattttaaataattgaaaaggaggaactcctccctaactcattttatgaggccagcatcatcctgataccaaaacctggcagagatacaacaaaaatataaaacctcgggccaatatctctgatgaacatcaatgcaaaaatcctcaataaaatactggcaaaccgaatccagcagcacatcaaaaagcttatccaccatgatcaagttggcttcatcaccaggatgcaaggttggttcaacataagcaaatcaataaatgtaattcatcacgtaaacagaactaaagccaaaaaccacacgattgtctcaatagatgcagaaaaggccttcaataaaattcaaaatccctttatgttaaaaactctaaataaactgggtattgaaggaacatacctctaaataataagagccatatatgacaaacccacagccaatatcatactgaatgggcaaaacctggaagcattccccttgaaaaccagcacaagacaaggatcccctcttttaccactcctattcaacatagtattggaagttctggccagggcaattaggcaagagaaagaaataaagatattcaaatagaaagagaggaagtcatattatctttgtttgcagatgacatgatcctgtacctagaaaactccattgtctcagtgcaaaagcttcttaagctgataagcaacttcagcaaagcctggggatataaaatcaatgtgcaaaaatcactagcattcctatacaccaacagcatgcaagcatagagccaaatcatgaataaactcacattcataattgctacaaagagaataaaatacctaggaataaaactaacaagggaagcaaaggacctttttgaggagaaccacaaaccactgctcaaggaaatcagagaagacacaaacaaatggaaaaacattccatgctcatggataggaagaatcaatattgtgaaaatggccatactgcccaaagtaatttatagattcagtgctattcccattaaactactattgacattcttcatagaattaggaaaaaaactattttaaaattcatatggaaccaaaaagagcctgaatatccaaggcaatcctcagcaaaaaagaacaaagctggaggcatcaccctacctgacttcaaactatattacaaggctacagtaaccaaagcagcatggtactggtacaaaaacatgcacatagaccaatggaacagaatagagaactcagaaataagaccacacacctaaaaccatctgatcttcaacaaccctgacaaaaacaagcaatggggaaaggattttctatttagtaaatgatgctgggagagctggctagccatatgcagataattgaaactggaccccttccttataccttatacaaaaattaactcaagatggattaaagacataaatgtaaaactcaaaactataaaaaccctagaagaaaatctaggcaataccattcaggacacaggcacaggcaaagatttcatgatgaaaatgacaaaagcaattgcaacaaaagcaaaaattgacaattggggtctaattaaactaaagagcttctgcacagcaaaaggaactatcatcagagtgaacagacaaaatacagaataggaaaaaatttttgcaatctatccatatgataaaagtgtaatatccagaccctacaaggaacttaaacaagaaaaaaaaaacattttaagaagtgggcaaatgacaggaacagatgcttctcaaaagaagacattcatgcagtcaacaaacatgaaaaaaagctcatcattgatcattagagaaatgcaaatcaaaactacaatgagataccatctcatgccagtcagaatcacgattgttaaaaagttaagaaacaacaaatgctgatgagattgcagagaaaaaggaatgcttttacattcttggtaggagtgtaaattagttcaaccattgtggaagacagtgtagcaattcctcaaagacctagaggcagaaataccatttggcccagcaatcccattattggatatatacccaaaggaatataaaccatcctatcataaagttatatgcatgcatatgttcattgcagcactgttcacaatagcaaatatatggaatcaacccaaacgtccatcagtgatagactggataaacaaaatctggtatatatacaccatggtatactgtgtagccataaaaagtaatgagatcatgtcctttgtctggacatggatggagctggaagccattatcctcagcaaacgaatgcagaaacagaaaaccaaacactgtatgttctcacttacaagtcggagctgagccataagaacacatggacacatggggcgggggacaacacacactggggcctatcagtggtgagagaggtgtgcgggggaagagagagcattaggagtagtgaatggatgctgggcttaatatctaggtgatgggatgctctatgcagcaaaccatcacggcacacgtttatctgtgtaacaaacctgcacatctgcacatcctgcacatacactctggaacttaaaatgaaagttgggggaaaaaaagaattcccttgtcttcatacccttgccaaaatgtgttatcttttgactttttgataatatacaccctaatgggtgtgaggtagtatcacatagtagttttgatttatatttccctgatgattaatgatgttgaccacatttgcatgcacatgttggcaattttcatgtcttctttcacaaaatgtctattcagggtattttgcccattttttaatcatgctatttgtctttctacatttgcatcttaaccccttatcaggtatatggtttgcaaatatttttccccaatttgtagcatgctgttttattttgctgattatttcctttgctgtgcagaagctttttagtttgatgtagtcccatttatttatttttgattttgtggcctgagcttttggtctgatataaaaaaaaaatcatttctgaggccaatgcccagcagattttcccctatgttgtcttctaggagttttatagtttctggtcttacctttcagtctttcatccattttcagttgatttttgtgcatcgtttaagatagggtccaatttcattcttttacgtgtagaaatccagtttttgcagcaccatttagtgaaaagactatcatatacccattgtgtgctgttggtgtctttgtaaagaatttgttgacagtacacatttagatttatttccgggatctttattctgtttcactggtctatgtgtctgtttttatgccagcaccatattgttttattatagatttgtaatataattttaactcaggaaatgtgatgcctccaactttttttttattttcagaattgttttggctatttggggtcattcatgttttcatacatatttttggaatgtttttttatttctgtgaagaatgaccttgggattttaacaaggattgtgttgaatatatagaatattgctttttgacattttaacaatataaatttttctgattcataaatacagtgtatctttccatttatttctgtctccttcaaattcttttatcaatgttttctctttcagtatacaaatgtttcactttctcggttaaatttattcctaaggacagatggtcctcaactcacaagttttaactttacaatggggtttaagacataaccccattgtaagctgaggagcatctggacttgtgatggtttgactcaacaatttttcagctttaatatgagtttatcagggtattgagtgcatttttgacatacaacattttcaacgtatgatgggtttatcagaatgtaaccccatggtaagtcagaaagcatcagtaattttttatggtaccataaatgaaattgtttttttcagttagattgttatttgtgtatgaaatgctagtacttctggtaccatgttaatttttccttttgcgactttactgaattcatttattagttctaacagttttttctgtggaatcattacacataagattatttcatctgcaagtggagatttttttttctttttgattttgatgtcttttatttcttttccttgtatgattgctcgtgctagtacttctggtactatgttgaacagaagtgacaagagtgggcatccttacctagtactggatctgagtggaaaagctttaacttttccccattgattataattgtagctgtgggtttttcataaatgttttttattatattgagaaacattccttttatgcctaaactgttgagagttttttttttaatcaagaattgatgttggattttgaaaaatgctttttctgtgtcaagatcattgtgtggtttttatctttcattctgttaatgtcatatattactttgattgatttgtatatgttaaactagccttgcatatcagaaataaatcccacttggtcacaatatataattcttttggtgtgctgttgggtttagtttgttatgttgttgggtttagtttaatcctcaatattttactaaggatttttgcatctgcattcgtcagacagattggtctgcatttttcttgtcttgtaatatctttgtctgacttaggtatcaaggtgatgtggtccttataaaatgtggttggaactattcattctacctctattttgtttaaaagagtttaagaagtatcattattaattctctgaaggtttggtagaattcagcttttataaaactatctgtttctgggcttttctttgttgggaagttttttgttacttctttgatctctttatttgttattggtctgttgttcaagctttctatttcttcttgaattgatcctggtaggttttagtttttgtttttttgttttgttttgttttattctgttttttaagcaatttatctgtttagattatccagtcgttggcatatattttttcgtagtagtcttaacgatccttttaatttctgaggtgtttcatttttttcgctttaatttatgattttatttattagtcttccctttttttcatttagaccagctaaaggtttatccatttttttttattttttgaaagcaccaactcttaattttattgattcttcctatgatttttctgttctctatttatgtttttatttttattattttcttctttctgctaatttggggtttaatttattcttcttttgttagttccttgaagtgtaatgttagattacttatttgagattctttttgtttttaatgtcggcatgtattgctataaacttttctctttgaactgcttttgctacatttcataggttttggtatgttgtgctttaattattgtttgtctcaagatattttttaatttctctttttatttcttctttgactcattggttgttcaggagcacgttacttaattatcatataattgtggattttcaagattcctcttattattgatttctagtttcatagcattatagtctgaaatgatattagatattatttcaatttaaaatttagtaagtcttgttttgtggcttatcatatggcctatcccagggaatgttccatgtgaactaaagaaaaatgtggcatattatcctgctgttaaagtaaagctctgtatatgtctgttaggtctaatgggtgaaaagtgcaattcaagtctagtatttcttttttaattttctgtctggttgatctatctactctttttaaattattttttattaattttgtgttcttttttattttaatagcttttggggtacaagtggtttttttgttacatggatgaattatatagtggtgaattctgaggttttagtgcatctgtcacctgagtagtgtatattgtacctaatgtgcagtttgtattcctagcctcactcccacgttcccccttctgagcctctaaagtttattatatcattctgtatgcctttgcatactcatagcttagctcccacttgtaagtgagaatatacaatgtttggttttctcttcctgagttacttcacttaaaataatggcctccaactccatccaaatatctgcaaaagacattatttcactctttttaatggctgagaagtattctatggtgtgtgtgtatatatatatgtgatatatataaatatatatcacactttatttatgcactcattaatcaatgggtacttaggttggttccacatttttgcagttgtaaatcatgttactataaacatacatgcgcaagtgtatttttaatatgacgacttcttttcctttgggttgacatctagcagtgggattgctggatgatctatccgttgttaaaagtggggtaataccagcactttgggaggccaaggcaggcagatcatgaggtcaggagattgagaccatcctggctaacatggtgaaaccccgtcttgactaaaaatacaaaaaaaaagtagctgagcatggtggcaggcacctgtagtcccagctacttgggaagctgaggcaggagaatggtgtgaacctgtgaggcagagcttgcagtgagctgcgattgtgccactgcactccagcctgggcaacagagtgagactctgtctcaaaaaaaaaaaaagtggggtattaaagtccttcaatattataatattgctctttatttctcctttcatgtccattaatatttgctttatgtatttaggtgctccaatgttggttgtatatatatttacaattgtaatgtcctgttgatacattgacccctttatcattaaataatgacattctttgtctcttgtgacaatttttgacttgaattatatttcatcaggtgtaagtatagctactccttctctctttattatttgcatggaatatcttcttccattgctttactttcagcctatgtgtccttaaagcttaactgggtgtcttgtaggcagcatatagttggatcttgtttttattcattcaaccattctatgtcttttaactagagaaattaatttatttgtatccaaggtcattattgataggtaaggactcattgctgtcattttgttatttgttttctgattattggtagcttcgtttctttctctctcattgtctacctttgtaatttggtaattttctgtagtgttaatccttgattcttttctctttatcatttatatacctgctgtagtttcttatgttgtggttaccatgaatcttccataaaacaccttataatcaactattttaagcagataataacttaaattctgttgcatacaaaaactctatacatttacctttcccctcacaatttgcttttgatgtcacaattttcatcttttaatattgtatatttattaacaacttgttatacgtttagttatttttgaccattttgacatttaaccgtcatgctagagatacacatgatttacacaccactattacagtattagagtgttcctgattttactatgtatttacctcttcagtgagtttatactttatagatatgtcatatgtatttataatagtaattgtcattttttaagattcccatttgaagaactcctttaagcatttcttgtaaggcaggtctagtggtgatgaattccttcagcttttcttgtctgggaacaattttatttccccattttgaaggagagctttgttgaacatagtatagttggctagcaatgcttttgttctttcagctctttaaatatattattcaatctctcttgatctgcaaggtttctattgagaaatccactgataacctaatggcaattcctttacatgtgatttgatgcttttctcttgttgcttttaaatttctctttgtctttgactttgaagagtctggttataatgtgccttagagaggatctctttgggttgtatattttggagggcctttgagctttatgaatccaaatgtctatatctcttttaagatgtgggaaattttcagcaattattttattaaataagctttctgtctctttctttgtctctttttcttttgtagaatgtgcttgcttaatggtgttccataagtcttgtaggctgtcttcactattttttattctttttcctctgatggagtaatttcagaagacctatctttaacttcacagattttatcttctgattgatctcgtctgctcttgaagttctctaataaattttttatttcattgattgaattcttcagcttcaagatttctgtttggttctttttatatctgtcttttcattgaatttcctaattatataatgaattgttttcctgattttattaaattgtctatttgtattctcttgaatctccaagtttccttcagttcattatttaattttatttcatttttattatttttctgagacaaagtctcactctgtcacccaggctagagtgcagtggtgcaatcttggctcactgaaatctccacctcccagattcaagagattctcctgcctcagcctcccaagtagctggcattacaggtgtgtgccaccacacatggctaatttttgtatttttagtagagacagggttttgccatgttggccaggctggttttgaactcctgacttcaagtgatctgcccatctcagcttcccaaagtgttgggatcacaggcattagccaccacacccagcccagctcattactttaaatcacttttcagagagtttgtaatttctgcttctttgtcgctagttattggagaactatgatttccgtgtggtaccatgcttccttgctttcatgttccttgtgtccctgcattgatgtctgcacatttagtgatgtagtttcctttttcaaactctagtaggggaagactttcagttgcatatgggtctgaggctgccagttgggcagggcgcctctggttacatgtaggcacagtggggtaatcaatgtgcagcttctttagttgtgatcaatgtcagcaatgaatgtaggtgcctcagtggcctagtttgtaggttgctagggcaaaggcttaacaattctcctgttcttgtctttcccacagtggggagtcttagctgaagaaaactatttttgtgtttggtctgatatggcccacaggcaaccatagcagcactgggagccagggcataggtgatcagagtagctgtggatataggtcatgggctcagggtcttgtgagactactgtagcaccttggacttgaggcacaggttcactttccaagatacaaatgaatgcagtttccccagtaaggcagggtctgttcctctgaggtgcacctcaccatcttaggcccagagtgctgaaatatagctgaggttgtgaccctggtggacatgggacaccactggcacagcttggtagaaaaaggagttctctagaagcttgggtccagggagcagagaatagctgtaatttgggaccaggagtcaacagaggtcagcaaaaatgtagacacttagcgatgaggtactatgtagtggtgactctggaccctgggatggtgggacatatcactaccccaggctctatgaggccaggtacagcagcagcaatgatgcagaaatggcaagacactgctgtagcttggaccttggtgggaggggtgcagcacagcaccagtcccccaagaggcagcatgtcagactgcaggggtgtagtgcaattttgggtgggcaggcatgtggctgttcagcctggagggcagggtggcacagctcaagccaggccttatttctttgggatgtgttgtgccacatctgtctggccccagaaatcatgtccatatgggtcagtggagcctctggatgcctgtggggtacggtactacattagctatggcactggagtgtgcaattattcttgtgtgccaaaggctctgagcccctgtgggtagcatgctgtcttatctgtggtgccagggctgggagtttactgctctagtgtaagtctgtgatcctggatggtggtggtggggtatgctgcctcatctatggcattgaggggcatgactgctctggtgtgcagaagacctgaggtccctgagggttggagcgccatttcagttcagtcctgagaggagagtgcacagtaactggaatgtggggagtggagtagctccacggaacttggccctagagggtaggaagtagtagcagcttggctggtggatggtatgctattatatggcttgttgcagtggtaacaaaacatcagggatggaggggtgcaatgcatactcacgcttggagcaggatgcacttgttcccaagattgtacagggcagtagcagcaggagccatgagacaagaggtaggggctgagaagaggagggagggccacagcatcagctccttctctagggatagctcagtatgtagactctggggagcaccctcagctgggctcaaaccctataaggactgcagaagtctctagtgcaaagactgcatgtatctgtggagatgacggaggttgttggggtcctcttgcttacctttttcctgcagaaaggggtctcttctggttttgagttgatcccaactagggaaatgggatggcagaggcaaggtgtttcctcctgtttcctatgtggccatcctgtgtttcagtggtctacaggatttctgctgctgttctccagagctttcctttagttattttgatcaagatgtagttgcttattcattatttttagttttttgtgggaagtgggaagagcactagaagcttttagttggccatcttgctgatgtcaccaacatggatctatttttgttttataatgttaaaatactatatctatgtacaatttgtcataatttacattttatatagaatccttacttatttttaatctcccaaaaaggttctacataaaatcatcatcaatttctagacgcttaataatagtttttgaagtcgttgcaaaaatgtaacttttcaaggaaattaaaactagctgcataatgttaaagaaaatatcaaatgtgagaactgtgtgtgatatattcaaagactgaatccatatttgcttatatttatagaaaggaaacaggactagtaattctatgggctgtaattttatgtcaacttctacctaaaacagaaatatgaattatttttaataatatgcctgcctttaatcgcatggatgaatatttcacaaatttggtattttaacatctttgatgccaaatacataaaactaaagaagtctttaatctgaaaaaaaccagaagtataaagaataccctgttaataaatttgttaattcatcttttgggggatggtgtttcctgatttagtctttagctgcaattcatatttgaagtttgaatgtaaaaaaatgagactcaattttctagtggcttataggaccagtctcatttctttttaatccactacgcaaataaattgtttgttacttatttggcttaggaaaattagtttacataactcgaaaaataaaaatagcctaaatgagcttttgttccacaaaaatcaattaaacttatagctggcattttgtaaataaaatttatttaaacaaaatgaaggatccttcagtccctccttaaagagaactgacaatttggctgcttcccaattcttcaactctgacttctccttgatagtcaatctgtgaagcagagggaaaaaaatctcttcccagaactgcatcagtcttctctgactggatgcactgtttttgtcttgttttgctgtttttcctctagtgcctgccaatttttagcctatgaagatggaaataataaaaaatatggtgattaatgaattaaaaaaatggtgattagtggagtaaagggaattaataatataaaaataacttctttaataatgagatatatgatatagaagaagataattattaaaagttaaaagcataataatttgattcaaattccttgaacacaagaggtagaagttagactaaggtgattacttagaatatttgctgtgaaaatagagcacccataatttttagtgtcactcataatttttttatttttctaatttttaaaaagttttatgaacctataggtttatttcatatttttagtttatttattttcatttttaaactttaattttagtctcagggatacacatgcaggtttgctatataggtaaactcgtgtcatggggagttgttgtaccaattattttatcacccaggtattaagcctagtacccaatagttattcttaatgctcctctccctcctcctaccctccaccctcaggtagaccccagtttctgttgtttccttctttgtgctcatgaattctcatcatctagatcccacttgtaagtgagaacatgcggaatttggttttctgttcctgtttcatttagttttcatttagtttacatatatcaaagatgaccagcactgaaagcttatgagatttgtcatttgtataagtaccaggtaggatgtagaaagataaaaatccctcagataactatgatttctgaacaggaagactcaacattgccatcttcccctgcccaacgatcttcaattcctattgctccattatccaaaaaacattcagtctaaaactaagggtggcaaatacgagcactaattggaatgatagcattttaaattgttaactgtggtttctaaggtcatctttttggatactatgaccagattttgttagaaagtaagagaagacattttgtacttctgggagaggtcacactgacaacagaaacagatcaagaacagtgggtttcagggcagaggacagagggcaatttcacaggcttttatacattcgctagagctggctccactcaccttagtcacagaacacttagacatgtccttatatgttctcctggtctgcatttttttaaactcaagtttttctaaacattttatttgtgatgtaatgttttcccttgtgctatttctccctgcccccaaactgattggtgtaatttgttttattcttgagattttacccatgaaaatactaagagagagacagagaaaaaagagcttacctggtatttctgttgttttaattgaactctgagtttcagctttagaaggaaaaaaagaaaaaaaatcagtacaattaaatgttgaatatcagatctattctcacaattgtttcaggtggtaaatgagtatgaattttagctcatttctgattcactattttcaaatcataaaatcatgattcttcatgattacaagaaacttcagagaaggtttttaagaaaaagtggttcaaccgatttttcccttaagggccaaattttttaggttttgtggaccataaatctctgtcataactattcacctctgccttacacagagaaagcagccatacacagtatctaaagaatgggaataactgtgtgccaataaaactttattttcaaaaagtcagggtattcaattttgcccgtgggccatagtttgctgagtcttgctttataggatctggtataccctcacactttgaatatcctgagataacatagaaaacaaaaatccttcagtaagtgcttaatgaaagtggctgccatgtgttgtaatcctactaagacttggtgcatctcatgatctgtggaagaagcagcaaagttcagacagatacttttaaaatgtaagaaattattttatgatatagtccaggagagctttctgcaaggaaagtcacttggaagaattataatcaaagatcacttcaacacctttgagtacatgcagcattttcaagatttggcacatgaaaaatacagaaaataatcttgaaacaaatagaagcccaataatgacatttttaaaagtccacttgcttcctttgtatattcacttgactctctacatcagcatcttaaatttaacatgccccaaacagaactcttgactgttatcctgaaatctgtctcttccgttgctttcttggttcaatacgtggtgccatttgttttccagttgcacaaaacaaaacgtcagtagcctgtcttgagttgcctatgtttctcacccttatcagctctagtttcaaaatgtattccaaattcaaacatgtctcaccaccttttctgctattgtccacccagcacctgtatctctcccctgagaacctgcaatagctgcttaggaaaatctttttaaatttaaacttcactgctccaatggctccctattgctcctcaactcatctccaaccattcagaccctgtttcgttgtactccacctcgtggctttgctgtggcagattgaaggcacaaggccctttctgccttgaagtcttccttccttccttccttccttccttcctccctccctccctccctcccttccttgctttctggcttgcttgcttgctttctgactctgctcagaagtcgctgttcagagaagtctccccaaccaccttcaccaaattgtttccacagaccttttcacatcattccatctcattgcttcattcattcaacagtacttttattactaccatgtatgtacttttgtctttaaaaaattattattttctgtcagaacataactccatgggggcagatttcttatcttgttcagagaagtgattccagtgcttaccagtagaaacatatggatagaatgaatgacagtagaaaataataatataaaaaactaattctacctacctgatttcaacttttaaagaaaaatgaatactttatttaaaatttcctagttggataattatagttactatttgtaagcaacttttatgatcagtttcatatcttattagttgatacctataagggaaatattgtatttccattttgcagatctgtaaacattagctgagagtagtaaaattaatttcttaaggaaaaaaccaggtatataggccaggtctgttagctctagttttcatcttctttcagtaaaatggacagcttttccttccactaaactgttccaaatagaaagctatgtaattaattcctacttttgataactaattaaaacacttttgaacatggcattatgctgcatttgaaagatacaattaaaatatctattagctgcaagagggttagaatacaaggaaatcaaaatccttgttcctcttattatcaggtcataacctttcttggtagacttcactgagaagacaaaaccttctgattatcccttctttgaattattttagccttcaaaaatgtgtaataattctagaggaacataataaaagaaatataactatacattaaggtatagctgagtcttcataaaacacatcacttcaaaacccttctgttgagcagtgtaagaggtttggacatttatatatataaatgaatacattgatattttgaggacaaaattctgtaagtctcaaatatttaatccagtatagaatatattccttttttccctgaaatcaagaaaatattttaaaaatgataaagtgtttttacataaatacaactttcaaatttggactcagttctgtggaaacaaaagcttagtaaagatgaatgctatggaatatggctaaagttctgagaattaatgagtgaagatattttcaattattcctgtttattatttatgactttcatgaaacatgtgtttttgggaaaaggccaagctttgatcttaaaagaatctcagaaaagtcaaatagcaaattagcagtgtgcttagttaaccattctcaaacttagatgtttagtaaggacccaaaacttagtcaaggtggttggcaacttacaatctgtttgttgagtttaatttttgaatatgaaattgaagtcttatgaaatgtaaatgaattttgaaatgctaatcacattaatccaacgttaaactttgctcaagcatttagtttttaaatcagaaatcttgaacagcaatacaacaaataactttgctaaatattcttatctcacaaaggatattgcaggatattttgaactaacagacttacacctagaacatgataatatcattaacaggtacaagagaaaaatatatacatctattcccatatataattatctactgatttgctgttgaataatttattatgaccaattcaaatcctcttcatcctttctccatatggcattgactgagtcattagacatgagaatacttctcatctggctaaaccatgacgtctgactaagactttatcatcctgaggagtactcttgtatctgcctacttgaaatgatataaattaattaaatcgcatatgagaaatgttataactaagtctcaaaataagtttcatagacaaatggtgcaattcacaaaataaatattgaagctgggtgggtaattagataaattagtgttttctaaagtgttggatagccttgtgtgagagattctataaggtagtactggaaagcagcattaaataagatggaaacatttaatgggaaaattgtttccttttcagctttcttgcagtttacttggttattttaatgagaaaattctaaaattttcattggatgcacatatattgttaatatctaacatgtgcttatcttagtttatttttttaaagaacaagcatgtctcaagctcagaacctctagcaaagaacaaattctagctagaattttatttatttatttacatagtagtgatttttatagctattgtttatttatgccaagcaaaactggtttttcatttatggtagtttatttttcaaacaaatttaaaaataagtgcatcgatttaaagaaaaacactaaaaaaataatagcacagatgatatacatctctagcaacactcatgaagttgtgggaaatatcagggtaaaatctagtagaggtccttgatgaatatgaatgtgtagaatttgaatcagcatttagaggtaggaggaggaaagaaggaataaaaaatatacaaatgggacaaatgaaaaatatacacattcaagtataaatcaggcatagtgggcaagaggaccaccctggttagaattgcaggtttaaatttattcattcagtcagtatcttgtcatatatttattgaacacctacttgtcaagtgcatgatgcacctaattagaagctagttgttttctaattccttagatttagatactttgtgtaaaatagttttcatgagaacaagtgtggtatagtgaaaggtgtatagggtttgaggcaagaaaaacagggttttaatcttttaaatttaatcttggccaagtcatttagtgtttctgaacttgtttccttatttgtgaaattggtatcatatatacttactttgcctggcttttatgagaattactatgactaaaaaaatagctaacatgtattgtgtttttgtgtgtgtgtttatttctttatatgatttatctcccttaatcttcacaaagatcctgtgaaagtataatcctattttaattattttacagatgaagaaactgaggcactgagaagttaagtagtgaattaaaaaccacacagcacaaataactagttgtgctgttttttgaacgtaagcaatcagacatcataatcactattcataaccaataagctaacttactcttggcatgattgaagtgccaaatttttattttatgaagggtatgatgccttgaagaaaaaagacctgggtgttggtcactctcatgtccagctagtagcttatctaaaatgcgtacttggttattataaaattatctttgctttttgtataaaaataaactccatattaaactaagataaattatgcaaaaggaaatacatttgataatttatttattatatataaatgttatcaattcctactaaatagcatactggttgattataaatgttattaagaaaagccagattatcttttcaggcttcaaatctctaatattgtattcactgtggtagaagaaactctcacttggcaaaacccttaaaggtgttcctatccaagtacttgctttagtagagttctatattggagttccgcacatcccaatttatcatctatctataatcttattctgcattcttgtctcagccaagttacaattcagtaaagggaaaaagagcaatagtccctccttccctgccaatcctttacagtgtgcaagatatctcctttaaaatctggttatagataccagaatgactaagttaccagcaagaaatgcgtatgtattgttttcttccctccatctcttcttctttcctttctcttctatcctcataaaccaagaggatacacaggtagcatcacactacctgacttcaaactatactacaaggctacagtaaccaaaacagcatggtactggtaccaaaacagagatatagaccaatggaacagaacagagccctcagaaataatgcctcatatctacaactatctgatctttgacaaacctgacaaaaacaagcaatagggaaaggattccctatttaataaatggtgctgggaaaactggctagccatatgtagaaagctgaaactggatcccttccttacatcttatacagaaattaattcaagatgggttaaagacttacatgttagacctaaaaccataaaaaccctagaagaaaacctaggcaataccattcaggactaggcaaggacttcctctctaaaacaccaaaagcagtggcaacaaaagccaaaattgacaaatgggatctaattaaactaaagagcttctgcacagcaaaagaaaccaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaagacacatgaaaaattgctcatcatcactggccatcagagaaatgcaaatgaaaaccacaatgagataccatctcacacctgttagaatggcaaccattaaaaagccaggaaacaacaggtgctggagaggatgtggagaaataggaacacttttacactgttggtgggactgtaaactagttcaaccactgtggaagtcagtgtggcgattcctcagggatctagaactagaaataccatttgacccagccatcccattactgggtatatacccaaaggattataaatcatgctgctataaagacacatgcacacgtatgtttattgtggcactattcacaatagcaaagacttggaaccaacctaaatgtccaacaatgatagactggattaagaaaatgtggcacatatacaccatggaatactatgcagccataaaaaatgatgagttcatgtcctttgtagggacatggttgaagctggaaaccatcattctcagcaaactatcgcaaggtcaaaaacaccaaacaccgcgtgttctcactcataggtgggaattgaacagtgagaacacatggacacaggaaggggaacatcacacaccagggactgttgtggggtggggggaggggagagggatagcattgggagatatacctaatgctaaatgacgagttaatgggtgcagcacaccagcatggcacatgtatagatatgtaagaaacctgcaagttgtgcacatgtaccctaaaacttaaagtataataataataaaaaaattaaaaaaataaaaaagagttaatgagtatgtcgtgttttcaagccattagcaaaaaaaaaaaaaaatagctcaggaagagaaaaagatttgaagttttgcaaggaagttttacactcaatccctccacagtttagctattgaagggtgggggacctttgttattgacaactaacacttcttttgaagcacccctcagtgacaaccaacgtagctctgcatatagtcaatgataaacgtatggattatgaaacctaggtatagtgagggctaatgcaaggacctggtctgtgatgagttaaatggtgactccctgaccccctactcccaaaagataggcagacctggaacctgtgatcttatttttttagcaagaatataaaactaatatagatcatcaagacactgtgagatttctactctaagtaatctaaacacaaaagtcactatcctcttttgctaagcatacaatttctttttctgcggaatgtgttttgggtgagaataccagataactgtcaccaatgatgtcaaagtatagatctttctataaatactaattaaacatttggtgtcttgtactttctttaagaaagtcaaggttcaaataactctctttatccccgataaaactccttcctttgaaaccttctctgtctgatattattgtagtcccttcaactttcttttaattagttttaccaaagtataccttttcctgtcttttgtttttaataaatttatacttaaagtaggttttctgaatactgcacatatttgggaagaggttatgctttttatccagtttaacaatcttatctttataaataaaatgtttaagccgttttattttatgtgataaattattataattgattttaagtacacaatctgattgtaaaaattttccatctgttctctgtttctttttttcttgtttattgccttcttttggattgagtctttttttaagattttatttatctccagtattgattttacaacagtatagttataacctttctctcattttggcatttgtgccattgttatacattttgtttctacatatgtcgtaaaccttccatacatttttgttattttatctttaaacaataaattgtcttttgaagagactaaaaatgagataaaagtctttcatagttgctcacatatttaccatttctaatgttcttcatgcctttatttagattgaaatttccatctggtaccatatttttctgttcctgaatgtctttactgatatgaatttcgcagcttttatatgtctgaaaaaatatttacagaattctagggtgaaaagtttttttttttttttcttccagtactaaaaagttgtttcattgttttctggcatgcattgttcctgatgagtctctgctgtaatttttatcattgttcttctctatttaatgtataatttttttcaatagcttctttcaagattttctctttatctccggttttccatgatttgattatgatgtgctttggtgtagttttcttcaacttggggctctttaagttacctgaatctatgggtttataattttatacacttggattatcttcccttttgttcgttttttcttttgttttttttcttgagacagagtttcactctgccacccaggctggagtgcagtggcataatcatggctcactgaattctcgatctccctggctcaatcaatcctcctgcctcaccctcccaagtagctgggaatacaggtgcctgccactatgcctgtctaatttttgtattttttgtagagacagggtttcaccacgttgtccaggctggtctcaaactcctgggctcaagcgatttgcccactttggactctcaagtgttggaactactttggggttggggagacaccacacctggcccttcttcaaatatgttttcggtccatccttctcacatcttcttctgaaattgtatgtatcttaggcccctggggtgtcccacacctcactgatattttattctatttttctggtcttttttctctccaacttatctagtttctattgttatgcattcatgttgaaaaacccaaaatattagtttttgttgatccactttatggtacatttgctttccaattcattaattcctactcatatttttattgttttcttccttcaactttttgggggtttattatttattttttctgccttattgagatggttgttctagtaattaagtttgaaccattctttttcctgcctgatatatgcattttagagctataaattttaccgttaagattggctttaattatattgccagttttggtactgcatatttttgctatcattcagttcaaactatttgctgattgtcattatgattacttctttgacacataagttactgtagtttaaaatgtatcagcatagagctatcttttagttttttttttgtttagattaattcctctttgatcaagagacacactctgtatcacttaaatcatttaaaacctgttgagacttgctttatgacacaggctatgatctatgatagtaacgaattcttatctacctgaaaatagttcactttctgtagttgagatagttcactttctgtagttgaggtgcagtgttccacatatttccattaaattgtttgttaatcatattgatttatgctacatcaatacctatattttgtcaactaatgagaaaggtatattaaaattttcatgagaattgtggatttgtgtttttcactaaatgtttgctttatatattttcatgctatatgataacgtaaaatttttaacttgttttattttcctggaaaattaaatattttagtattatgaaatgttcctatttatttcgatttagttttttttgccttaaattctactttttctgatatagatgtatttatttcagggtatatcctttttcactcttttaaatttaactgttgtatgtcttttttaagcaacatatagtttggttgtgtgtgtgtgtgtgtgtgtgtgtgcgatcattagtttctattaataagatcatgtcatctgagaacagagatcattttactacttccttctctatatgactgcttttaatttctttttctttcctgattgctctgaatagaactttcagtattatattcaatagaagtgatgagagtggacatcatttgctttgtaggaaaagctttcaactttgtactgttgactataaagttacttgtggacttttcatatatgaactttattatttggggcaatttttaaaaatttatagtttattgagcatttttatcctgaaaagatgttaaattttgtcaaatgtttttctgcaacaattgagataatcatgtggctattgaccttcattctgttaatgtggtatattatattgattgattttcctatgttgaaccatctcgcattccacaaataaatgccacttgaaacaagatgtctaatcctcttaatgtgttattgaatttggcttgctaatattttgttgaacgtatttgcatcaatattcattaagaatatcagtctgcagtgttcttttcttgtagtttttgtgaatgattttggtatctgcctaattttagtctcatagaatgcatttgaaagtgttcctggctgggtgtggtggctcacacctgtaatcccaggacgttgggaggctcaggtgggtggatcatgagatcaggagtgcaagaccagcctggccaagatggtgaaatcccgtctctactaaaaatacgaaaattacccgggcatggtagtgggtgcctgtaatcccagctactcgggaggctgatgcagagaactgcttggacctgggaggtggagtttgcagtgagccgagattgtgccactgcactccagcctgggcaacagggcaagaccctgtcaaaaaaaaaaaagtgtttccttctctttatttttttataagagtttgaggaggattggtgttaattcttctttaatttttggtggaatgctttaatgaggccatctggacctgagcttttctttgttgggaggtttattttatgtcattattttattttatttttagggctgttttaactgctaggctctttgataacagtatctggggcctaaaatatttccaagggcctagtgaaatctttgagatctcaaacacagaattattgcctccattatacaaaaaaatcagcaaaatctaaattgataaatgattccctaatgtgtctacaaaatgcatacaaccttaaaatccattaaggtctgaaacacttctgatcccaagcactttgataagggatattcaacttgtatcacttttataacttttgataaatttttataagtttttataacttttataattttataacttataatctataaattcagttaacataggatgtgggggcaattcaatgtttgagaagggggacctaaagtcagaaggcctaaaactaacaaaggccttaaaacagcctgtattccaacaacaaacatactctatcttcttttcaattgaccttcactcaaacagttttccttttcccaaaatgactcctcccttctttgcagctggtgcttactcctcaaaacttattcagtactagacaaaaaactctgcctcctcagaaggctccaccttttgtggtttgaaacttcctttatcatgttctgtcttgatggtaaaacctcataaacatttagccttcccctgggtgctagaggctctgttcagcatggagagaggttctttgccctgaaagatttcactgttgagttagagaagcaggcaaatccacatgaaaaaaaaatcagtattaaaatgactttccagtggatggcaagtcttctttggctttctctttcttgagaattacatgaatttgtaggacttcttttatttagtttattaagttggacaactcctcctagctggagccattgccctcagatgctctctctctctctctctctctctctctctctctctctctctctctctctctctctctctcatctctagagagagagacagagaggttgttttcagtattttcagtatatgacaatattttgtgtgtgtgtacaccatatatatatacatatggtgtacaatgtgatgttttgagatatacatgtattgtggaatgattaaatcaagctgattaacatatgatctcacatacttattagtttttttgtggtcagaacatttaaaatctactctcttagtgattttcaagtagaaaatacattattattaattatagacactaggttgtaaaataggtctccagaaggtattcctcctgtctaactgaaattttgtataatttgaccaacatcttctcattcccaccctacccaactccccacctccagcttctagtaactaccattctactctctatctctatgagttcaacatgtttagattccacatgtaagggaaaacttgcaatatttgtcttcctgtgccagacgtatttcagttagcataatgacctctaagtttatccgcgctttcgcaaatgacaggttttcctttttctttccaggcaaaatagtatactattgtgtatatataccacattttctttacctcttcatctgttaatggacacttaggttgattccatatcttgtctattgtgaatattgctgtgatgaacatgagaattaaatatccctttgacacactaattttatttccttggatatgtacccagaagtgggattactggatcatatgatagctataattttaattttgggggaatatccatacagttttccacaatggctacactattttatatttccatcaacagtatacaagatttctcttttctctatatctttgacagcactttttatctctcatctttttgataatggccattctaacaggtatgaggtgataactcatagtggttttaatttgcatttccttgatgattagtaatgttgggaatattttcatatgtctgttggccatttgtatgtctttttttgtgaaatgtccattcaggtccttggcccattttaaaattgggttatttgtttctttgctattacattgtttgagttccttatatattttgtatgttaacctcttaacatttgtatggtttgcaaatattttcttccattttataggtgtattagtctgttctcacacttgtaataaagacatacctgagactgggtaatttatgaaataagaggtttacttgaatcacaattccacatggcaggggaggcgtcacaatcatggctgaaggctaatgaggagcaaagtcacgtcttacatgatggcaggcaagagagcttgtgcaaggtaactgccttttataaaaccatcaggtctcatgaaacttattcactgtcacaagaacggtatggaaaagacctgccctcatgattcagttacctccctccaggtccctcccatgacacgtggaaattatgggagctacaattcaagtgagatttgagtggggacacagccaaaccattatcaataggttatctcttcaccccgttgattgtttccttttctgcactgaagccttttcatttgatacaatctcatttgtctaattatgcttttgttgcctttgcttttgatgttatatctgaaaaatcattgcacagactaatgtcaagaagcatttctcctaggttttcttctagtaggtttacaatttaggtcttttgaaaatgtaaataatatcatatcattgctctgctctcaactctccatcacattgtgtatccaattagaataaaattcactgtccttaccatggcctatgtagccctgtctggactgaccccttcttcctgctctaatggcatgtgctatcttttcttcccttcattccttccaatcaaccacagatgactcctctttattcaaacaacttaaatccacccacatatcagcacctgtgcactttgtatttcctctttgaattctctcccagatatccatatgttcacttcttgactttatttagttctctttccaaatggcacttgttcagagagggattctttgaacaccttatgaaaattggcactaccatcaccacttgcttttttttactgttttattattatttagagtatcactgatattgaattattaatatttaacttatttatctttttcatccactagaaggtaaatttcatgatagcatggtctgtctaatatacaacgatttatcacaatccagaatagttccaggtacatagataatcctctgaaagatttttagtaaataagataatttttaattcaaaaagcccacattttttaaataataaagtcagagcactagattaatgagaagttctatcttaaaaattctaggattctagaaattgtttccttttaaataggaaaaatacacacccctctaaaagaatgggaaaagattagagagaaatgttttgagtatgatcttcttttttgatctgaattccaactttctagggaataaagcaacaaatctcactaactcttctactctaaattaaacctgtatttgttttcatctttagatgaaatacccacaatgtacttgtctgatatttcctatccaaggaaccattgcccagatgtttaagagggagctgaatcttcagctgttcaacatttaaccaacagtagattgttttgttttgtctctatctctctgtcctgtatccactaatcctaacagtgtttatgtgtgatgggcggaaagggagtggtgctctgctaaccaggaatctgggagaggtcccggtttcatcacttggcaaatggaaatgtgtgcaaacacattatatcaagtagggtccatgttgggcaataagcaccttgagaaaagagagggatctagggaataatggctgacccagaaataaatgtaataataaattctaaaaaattttgtataaaacttgtttgtcaaataacaaaagcaatggacaacagtaaatacgcttatttcattatcctgctttccagagtgtttcatttcttaagaaaatggctttgatgtattttttaaactacttggaagaaagccattttaaactgagtttagaagctaaatcaatacaacagtccccagaactgagacgcagagagcattctacttcatgaattgaagtggaattaaaagtcttaactgactcatgggctgaccacatacttctgaaatgtatgtaataggtttaataaatcacagtccgtgaatgacattttcttcctcacaagtcactgaatgggtgagtatttagtgcaggatacaaattatttgagtctaattttccagaagctgctatacactttgcagatatatatatagtagttttatttttatattataggggccatcatattatacgtagatgaattttggtttcctgaaggtgccttttagatatatattacttacaaaataggttctacttatcagaaaccaaaccactactacacgaaaatgttatccatatgaagaagagatgattctgctcttcaaattcctctacggggtgactgtcccattaaaaagaagtagtagtttacaattatggtgtgaaattagactccttctaggcaaacttctgtatgttgtgcttgagatgattacaataaaaaagagacaatttatgtttctgaagtttctagacaagagtaggtcttggatagccacaatttctacttgtcatctctttctaccttagagatttcccaagaaaagacttagacattatgagtcatctgtagccatttcttagtaaggactatggatacaccaaaaatgcttccattacttatattcctaactcttccagtcaagtgtgtttactatacatagaaattacttatatcatggagtccagaatgtgagaagtacctgttgtgagaaaactggaactggaaagctgtcagaaattatgggagttctagcttctacttgtctctctgcctcgcacaaacattttaattttgctcacagggtattcctatctcccaatatactctccattcttttctgtcaatttgtttactcataataactgcttctggatgccataggtatgcacatgaattgccatgactaccgcagactcccactactaaacttcgcaccttcaattcccgtagctaactctgctgtttgtttgttgggttttctagttcaaactactcagaaagaaaatttgattggctaagctcatcattttctttccttctgtttttcaacaaagctttataaaaaatatgatttacacaccattaaatgcactcattttaagaatacaagtaataatttttagtaaatttgtagagttgtgcaaccatcatcataacataatctagttttagaacagctccatcaaatgaaaaactcctgtgagcttatttagagtcaatccccactcccatctccagctgcaggcaaccacttacctgctttctgtccctataaactgtcttttctgcatatttactgtaagtggaatcataccacatgtcatgttttgtgtatggcttctttcattgagtataatgtttttgaggttcatacttcattacaatagctttagaataagttttgaaattgggttgtgtcctctaactttgttctttttcaaaagtgttttgactattccaggtcctttttatttccgtacaaatctagggtcatcttatcaatttctttaaaagaactgggattctggtagggattgcattaaatatattaatcaattattgatcaacttggagagaattatcatttaaaatattgaggtttctaatctataaacatgtaatgtatctttagatatttaatttctcaccaaaatagtttatagtttagtgtataaatcttgcacttctattgttaaatttatttctacatattttatactttttgatgctattgaagatggaattattttcttaattttattttggatcaccactgttaacatataaaaatataatttattttaatatattttatatcctgtgctacaaaccgctctttagtggttttagttttatagtgaatccttggaattttctacgtagataattatgtagtcttctaataaaaaatgctttatttcttccttttcaatctaaatgtatctatgtattatccattgttgaattgtactatctaaaacctctggctataatgttgaataaaactgataagaacagacatctttggtatgttccagatcttaaggggaaaacattaagtctttcattattaggtatgatgttagctgtaggctttttgtatatgccctttatcaagttgaggaaatttcattacatttctagtttattgagagtttttaatatgagtgaatgttagattttgtcgaatgctccttctacatgtactgattttactaatatgttgtattactttctttggttttcatatgttaaactaatcttgcatttctgggataaatctgacttgttcatattttatattcctttttacttgttactgatttttttgcaatattttatcgaggatatttgcatctatgtctaagagccatattggtctatagttttctttacttgctttttcttttcattcttttcttgctttggtgtcagggtaacattagcctctgataattatttgtgcagtgttttcccctcctttactttctaaaagagtttgggaagagttggtatgatttatttctgaaatgctttatagaattgacaattgaagccatcatggcttggggttttcttcataggaatatttttagttcctatttcaatttctttaatcattataggttttttcagatttccatatcttcttgagtcagttttagcaatttatttctttctaacaattttttcatttcatctaagttgtctaattttttggctgagctctccttttagtgccaggtaatatcatagattactgcccagtcttgcattaatcttccttgtgacccattcctttgtggctgcagtgggatagggtatcactgtaaaagatgaggctgccaaatgattgttctattgggtagagattaagagacaatttaagcagagcataattccttggcagttgtatgctggaaaacattctgaaactagttttatgcaacacactagtttaacacttcagcacaaatcctcatacttactcttgggtttggaactttgtaatgttgaaacagcatttggaagtgtaacacttgttactgttacgtttgaaatgatggagtcattcttcctgacatcagtggttgtggctttcaatcctataaaaagaatgaacagtcatcaggagtataacaaatcaccagatcatcttattaatattcatattaatatccaactaaaacttgaagattaatttctagaagtcttctgactaagccttagaaatccagcattttaacattcaccttttggtgatataattaattactttaaagaatgtggagggacattaactttcttgtgtacatgctgtaggttatctcacttgattgtcatggtaatcttacgaattaagtaatcatgatgatgatgattttatatataagactcagaggaattaaataatttccccacggtcacataacttataataggagagaacaatgacctgaattcaagcctttctgatgcaaaagttaatcactcagctgccctgggaaaagaaaggtaaggatgtggtagtaattaagtatggcactattgttctcatgccacttgggaaaatattttcaagcaggtggaatagtcaggggatgagggataattggacataaatggaatacacttttaattatacttagttcatttttctttgaaaaaaaaatttacaacaaaaatataggctgagcttttcaaagataacattggaataagatgacttgaaacaacttatatttgcccatatattctgaaaaaaaatcgatgcccttcagttttttcagtctaatgtggaaacattgggccagtgaagaaaatgcagacatgccatttactgcatgcttggtgttagctggatgtgatgctagctggagatgaggggaaagcagtttagtagatctctaacacagagtagaatggagcaagaattgctggtgttttctagaagtgcagtcaacttccattctatgtcaacaagcatctactgtgtaatacaaattcttagtgcagttgaggaagtcatgctgaagaaagggatcatttgcaagaagacttcatagacagtagataaatacattttccttcaggtaaaaagcctttgggaattagtgtgcaaacaaaatgaaacaaattcaaatgtagtctacagtgttaatcctgcatatgagagagaatgactggaaatagccacacatttcagaggtatcatgaagtgttaaattgggaggaaaatatgtgaagtagagataatgccttattacagcaagaaagcagaagttggtattcgtgttagcatggaagtgggacaggtcacccaaggtgcagaaactcaacatttgaggatggaggaactcctgggggtaaagattttgcttcccactggaattccaacatatgttggggaaagatcagaacaggagtttctcttcagaaatttttggagaaaaattcttcagctgagctaaaattggaaagcatgaaaaagctatcctgaaggcctaaagagttccctagtatcaagcagactcaacagtcttggtggagggaaagagtatatatagctaagaaagatgtggagggctgccagattggaaatatgcaaagaaaggagaaaaataatggaatagctgggaatgcaatgccaaagattttgcttagagaattgcctattataaatgtggaatatacttcacaaatgagaattagagcctacactcaatgtaggacaggttgtcaattatactacatgaagtaggccttggagcaaatcttgaatgtttaagataaatcaaaatgttttaaaatattcatggtaaactcaaactgaatagaataaaagatgctgccacagccacaaatttttaaactttactaatatacagaaatgcttcaaatcctagtctcaggagagaagaatctatgcatggttgactaacatttattaagatatgagaatcggccgggcgcggtggctcacgcctgtaatcccagcactttgggaggccgaggcgggcggatcacgaggtcaggagatcgagaccatcctggctaacacggtgaaaccccgtctctactaaaaatacaaaaaaaaaattagccgggcgtggtggtgggcgcctgtagtcccagctactcgggaggctgaggcaggagaatggcatgaacccaagaggcggagcttgcagtgagccgggatagcgccactgcagtccagcttgggcgaaagagtgagactccgtctcaaaaaaaaaaaaaaaaaaaagatatgagaatcatagtcatattaacatctttttgagaaaatttttccagttgtatttatagttaacacatagtttattccaaactactgccaatgagtaattcacaccttcagagaaaaagtaaatcaatcttaaagctggtctttaaatctaaatactttctactttcccctacaaaacaatatgtacctgctgtcatctacagttatgaattgcactataatcctaggcaatagtgcatgcattaggtttcacaaacataatttttctggagaaatattaatttataagagaattgcatcaagatacattggctttacatttatgacttgtgtttttaagattcatgtatgtttaaatcgtagcttttggtataggtgggacacattaaagacaaaacataatgaatttatccatatttgagttggaaaaaataagaatttaacacaagagatgcttgagggagtcgtatcagtaccagattgtaaatggagaaaagaaaccttgattccaagcatgtccttaggtgaaaaccactgcatagggctgagagaaatgtgggagagggtctgttttataatgatcttggaattgttaacgtgtaatttattttgtatattttgaggaattaagtttattgaggaaaacaataaatcaggacattaactatattaggaatctaatgtgtagttaccaattaacatgaagagatggtttgtggtcatggattttaattttatagggagggagattggcagctttattcctttggaattacataatttgaattacagcattgttttatctgatgcccataggaaaaatgtctgaccactttgtcttaagaaatagaataaaaggtaagagacttttgacaaggttagcatttactaaaatacatgctgtagactactagtactgtggtatatttggttttacatgaataaaagatgctcttaaaatatttaggattaaatttaatcaaggaaatgaaagagctgcacactgaaaactataaaacattaataaaaaaactgaagaattcacaaataaatgaaaagatatcctatgttcatggattaaaataattaatattaaaatgtccatattacccaaatcaatatatagatttttaaaaatccctatcaaaattcacatgttattgtttacagaaatagaaaaaaaaattgtatggaaacacaaaagatcctgaatagcaaaacaatcttgagaaagaaaaataaaagtagaggcatcacacttcctaattatttaaaattatatcacaaagctacagtaatccaaacagtataatactggcatgaaaacagacacatagaccagtggaagaaaataaagagtccagatataaatctaaacatatatggtcaattaattttcaacaagggcaccaagaggttactataaagaaaggatagtctcttcaatacattgcactggggaaactgtgctaccacatgcaaaagaatgaaattgcacccttatttgacacaacacacaaaaatcaactctaaatggataaaagacctaaatgtaatatctgaaatcataaacctccagaagagaagataggggcaaatctccttcacattggcctcagcaattatttctggatattacatcaaaagctcagggtatggcctcagcaattatttttggatattacatcaaaagctcagctacaaaagcaaaagtaaataaatgggactacatcaaactaaaaacctagtgcacagcaaaggaaacaattagcaaaatgaaaaagcagcttacaaattgagaaaaataatttgtaaattatatatctgataaggagttaatagtcaaagtttataaaataattatttaatttaagtctttaatctatcgagttaatttttgaatatggtgtaaagaaggggtacagttttaatcttctgcatatggctagccaattattccagcttcatttattgaacagggagtcctttctccattgtttgtttttggcagctttgttgaagattagatagtgtaggtatgtggccttatttctgggttctctattctgttccatttgtctatggttactgtagcccagtagtatagtttgaagtgaggtaacataatgcctctagctttgttcttattgcctaggatttctttggctatttgggttcttttttggttccatatgaatttttaaatagtttttttccagttctgtgaagattttcaatgttagtttaatagacaataccatttaggacataagcatgggcaaagttttcatgatgaagacaccagaaataattgcaacaaaagcaaaaattgacaaatgggattgaattaaactaaaaagcttctgcatagcaaaagaaactatcaaaagaataaacagataacctacagaatgggggaaatttttgcatactctgcatccaacaaaagtctaatattccgcatctataaggaatttaaatttacaagaaaaaacaaccccatgcccaataacatgggcaaaggacatgaacagacacttttaaaaagaagacatacatgtagccaacaatcatataaaaaaagttcaacatcagtgattattagagacatgcaaatcaaaaccacaatgagataccctctcacaccagttagaatggctattactaaaatgttaaaaaaaaaaacaggtgccagtgaggttgtggagaaaaaggaaggcttatacattgttggtgggagtgtaaattagttcaaacattgtggaagacagtatggcaatttctttaagacctaaaaacagaaataccactcaacctaacaatcccattacttggtatataaccaaatgaatagaaaccattctattatgaagcacacatatgttcgttgcagcactattcagaagagtaaaggcatgcaatcaacctaaatgacccatcaatgacaaattggataaacaatatatggtacatatacaccatgaaataccatgcagctataaaaaagaatgagatcatgtcctctgcaggaatatggatgaagctggaggacattatccttaacaaattaacacaggaaaagaaaataaaatattgcatgttctcacttataagtgggagctaaatgatgagaacacatgaacacatagaggggtcaaggaataaatcataaaaaatattagaaaatactttgcagtaaatgaatatgaaaacataatataccaaaatttacggaatgcagagaaagcaatggaaagaaggaaatttataggtgttaacacatattaacaagaagaataatctcaatcaaaatcctcactggccaatttgagaaactagaaaaagaagagcaaactaaacccatacgaagccgtgggaaagaaacactaaggattcgagaagaatgaaataaaatagagaatagaaacacaacacagaaaaaaaacacaaaagtttgttctttgaaaagatatataaaattgagacacttttggctatgctgataaagaaataagagagaggagtcaagttatcaaaattatgaatgaaagaggattcattattaccaaccttacagaaattagaaggattataaggcaatgctgtgaacaactatatgccgacaaattagataatctagattaaatgggcaaattcctaggaaatcactaactacaaaaactgaggcaagaagaaatagaaaatctaatagatttataataagtaaagaaattgttagtattttaaaaaaatttcataaagaaagctcagcaccagggtcttccctggaaaattctaccaaatatttaaagagcaattaccaccaatcctcataaactctttcaaaaattagtagagaagggaacacttcccaacttattctatgaggctagtattattttgatttcaaaactagacaaatacatcacaagaaaactacaaacatatatttcatgaatatagacataaaaattcttaacaaaataatataaataaagtttaacaccatgtaaaaagaattataccccatgaccaagttggatttagcctaggaattcaaggttgactcaacatatagaaatcaatatcatatgccacattaacaaaataaggaattttttaaaaacatgataatctcaatataataagacaaggcatttttaaaaatccaatacccttgcataataaacacactcaacgaactagtaataaaagagaacttcctcattctgataaaggtcatttattaaaaactcataattaacatcatacttactggtgaaaaactgacagtttttcctgagagttagaaacaagacaaggatgtcccctcccacaacttctactcaaccttgtattgaaggtgctagccagggtagttaagcaataaaataaataaaataaaattataaataaaagaaagtcatccacactggaaagaaggaagtaaaactatctatatttgcagataacataatcttgaacatagaaaattctaaggaatacacattcacatatacacacacacaaattacagttaataagttagttcaatagagtggaaggatataatactaacatataaaaataaattatatttctatatagtagcaatgaataatccaaaattgaaataaaaaattattttattacaaaataattttattaaaagtgaataaaatattaggaataaattttacaaaaataagtttaagccttccacacttggaaactacaaacatcatcaaaataaattgaagaagacattgataaacggaaagacatcctatgctcatgaattgaaagccctgattgttaagatggcaatactcctcaaattgatctacagatttaatgcaatccctatcacaatcctagctggctttgcagaaattgacaagttgatctcaaaattcacattaaaattagtgtgataaaattggcgtgataaagttgaatagccaaaacaatcttggataaaaaagaaaaagttggaggactcacatttcctgttttcaaaacttaatacgaagtaatagtaatcaagagtatatgattctgacataacaataggcatataggtataagtggagtagattcgggagtccagaaaaaactcatattaggtggatgcaaatgtagttgcagcttttgcattgttggaatgtaccatttgatactggcatacattcttaaataaatgtggttatgttttatagatagatagatagatatccctatcataaaataaacttctatatatatattctagaaatatatatattctagaagtatatatatatattatatatatatattttttttttttgaggtggagtttattctgtcgcccaggctggaatgcagtggcccaatctcggctcactgcaacctccacctcctggatccaagcgattctcctgcctcagcctcccgggtagctgggattacagatgcgtgccaccacgcccagtaaatttttgtatttttagtagagacatacacatactcagggtttcaccatgttggttaggctggtcttgaactcctgacctcaagtgatccacacttctcggcctcccaaagtgttgggattacaggtgtgagccactgcacccgtccatgttatatataattctaatgggcatttcccgtttcgtgtttttttgttttttttttttgtttttttttttgctaatgacatcacttgctgtttatgtttattttagactatggaaatgatgttagacaaaaacaaatccaagcgattttcttatttgagttcaaaatgggtcgtaaaagaagcgcagacaactcacgatataaacaaagcatttgtctcaggaattgctaacgaacatacagtgcattcaagaagttcaagaagttttgcaaaggaaaagagatccttgtagatgaggagcatagtggccagacatcggaagtccacaatgaccatttgagagcaatcattgaagctgtttctctaacaactacatgagaagttgccaaagaactcaaaccttgacgattctacagccctttagcatttgaagcaaattggaaagctgggaaaatctcgctaagtgggtgcctcatgagctgagcgaaaattaaaaaatcctcgttttgaagtgtcatcttctcttattctacacgacaaaccatttcttgatctgattgtgatgtgcgacaaaaagtgacaactggcaacaactagctcagtggttggagtgagaaaaagctccaaagcacttcccaaagccaaacttgcaccaaataaaggtcatggtcactgtttggtggtcgggtccactgcagctttctgaatcttcaggcttcaaaagatactatcaacaaaattaaaagataacctatagaatgggaaaaatatttgcaaattatctatcttgtaaacttctagtcttgaatgtatacagaactcttgcaactcgacaataagaggacaaatagccaaatttttaaaaagatagacaaagaatttgagcggacatttttccaaggacaatacacaaatggctaccaaacacatgaaatatgttcaacatcattaatcattagagaaatataactcagagtcacaatgagataccagttcacacccactgagataattataattaagacagacaagtgttagctagaatatagagatattggaactcttgtatgttgctggtggaaatgtaatatagtacagctgctttggaaatcagttccttaaaatgttaaacatagagttaacctgtgacttagcaattcggcctcaagacatatacttaagagaaatgaaaaacgtaggcagacaaaaacttgcacataaatgttcatagcagcattatttataatcattagcaagtagaaacaatgcagatgttcatcaattaataaacggataaacaaaatgtggtatatccatacaatgcaatattatttagtaataaaaaagaatgaactacagatacatgttacaacatggatgaacttgaaaactttatgctaagtgagagaatccagacacaaaaggtcatatattgtatgattccatttatatgaaatgtccagaacaggcaaatctataaaggaggttagtggttaccagaagctgggagggggatatgggaagtgattggtaattaatacaggttttcctcttggggagattaaaatgtgctgaaattaatagtggtggtggctgtaaaatcttgttaaaatactaaaaacttctgaattgtacactttaaaagggtgactattatgttatgtgaattatatattttttaaaattgtagaaaaatgaatcattactcaccttcatctttacttgttaaaaaagtagctgttgacatcagagacattttaagtaattcattggtgattgttcctagtttgataaaatagattaaattattattaatcataatctcatgttatctgtcaataaataaagtaagttaaatctataggtggactggcattctcctttgtctatctttaatttttcccattttccagttcgttttgtctaaagaatatatgtatattaaatatatgtatattaaatatttgggtggcctacacacacacacacacacacacacacacacacatttttcataataagtccccaaaacaagtttccactgaagattgttacttaggtatctttaaacatgcaaaaaattgttacaaaattctaaattctaatgtttaaaatcattttatttttccctgtgagaaaagtgacatggtcaataggacttaggagtatcatgccttttttttttctagaattacatttcattttattgatgtagttatggcagtgaaacttctaaatgaacatacatcatgaaggaacttgaaaacttccctattaatttgtgtgcccttctttgctctttgctcttgagggcagtatccaattctagtcctttttttttttttttttttttttttttttttttttggagacagaatctcgctctgtcgcccaggctggagtgcagtggcgcgatctcggctcactgcaagctctgcctcctgggttcacgccattctcctgcctcagcctcccgagtagatgggactacaggcgcccgccaccacgcccggctaatttttttgtattttttgttggtagagacggggtttcaccgtgttagcgaggatggtctcgatctcatgatcctcccacctcggcctcccaaaatgctgggattacaggcgtgagccactgtgcccagcctctagtcacatttttaatcttagtatcaagaattattcctggcatacactaggcatttagtcaatgttgtttcaactaaggaagcactcatataacatatgaaaatcaaccaaggggcaaatctgccctaagtagtcaacatgactcatcagtttgatacctactctccaactctctgtaatggtctttctccctccctccctccctccctcccttcttccttccttcctttctccctccatccctccctcccttccttccttctttctttccttccttccttttttccttccttctttccttcccctttttcttctctccttcttgcttgacaaggtcttgctctgtcacccaggctggagtccagtggtatgagcatacctcactgcagaatcagacttctggcctcaagtgatcccccaatttcaaccacccaaagtgctgagattacaggtgtgagccgcagcacccggcccctcttctttgttccttccttttttaacaattttatttgcaggtttgttgcatgggcatattgtgtgattagggcaaaaagctatttatttttaaagatattatattattttgagtcaataaatgtttataatagattaaatcattaagatatcataattttattctctgcaaaattgtttcttaaactagcattcattcatgccattttccaaaacaatctttgagaaacatgttgaattctatttaggctacaactgtttcaaagaaatgcctaatttgtaaacatttcatattttgtgatgataaagtaaaagcaaaatatcaactttgccacttcaaaattctatgaaaaggagaaaccaaaaaatcatgtacaaagatatcccaggcacttcattttctattcaaatataacagggaacagaaagacaatgaataaaaggagaaagactacagagaaaaatggggtacccaaactcatttttttctgactaatcatacaagaaatttccaagaatgtttttaaaattttgttctttatagttgtatctagttagtttctacatagaggatgtacaatggaaacatcaccatatttagcaccctgtgtgagataggtggccaaaagcatcaggctcctttactgacttcagctgaaatttctggtactaaatattttattatcagaaactgttagtatcactgttgagaaacttttattcctgcattataattcaactctagtattgaaaaatactagactattcaatgtttttaaaatgaagctgaataataatcaactttttaacttaaaaaaattaaatttcaagtttcttttttatcctagaagttcattttatgatagggatattcaacatctgtcaaatgttgatttttaactccagccttttggccttgcacaaaatgtgcattgcacttgatgtacatctaggaagaggtcaagtcccatttctctaattgggtgaatctctgagagcaagccctgctccaggcgaagctctatcaatcacgtctgccacttcagtgattatgttgctgcaagaagaattctcatctcagttgcacattttccacttttttgatgatagaatttctgccattggcaagaaaaataaattgtatgtgatttagaaagacataagcactactagaccaatgatcttttgacctttaaacaaaagaattctgattaggaagccttaaaatgaaaacaaagatgcttttccatgttgtgtttttttggtaaatactttcatcgtggctaagaggaccatactggacatgagaaagagggaataagggacttcttcactacagatacctttttttttgtattattgagtaattttaaaaattattattttggagaatgggacagtgtataaaactcctccaaatttaagcccctcagagtcctgaaattagtaagtcaaatttactgatacacaatccctagaacatgataattcttaagataaattctccatctcctttattactgtatactaattgcgttgctctttggaagatgggcatattaagtgtacttagtctgactcatctaacccttaatacacagtggtgatcaagtaagccagacaaaaaggagttattttctctgttgtctttgtccaatgttgttccctcattctcctataagcaccacggaccccaatttgcctaacggctttctcagccctaccactgtgccagaatttctgtttcccactctggatccaagcagctgaggacctgagagcctgcctttcctgctttatctctcttccacctcgctctctcagtagctctcattagagaccctagaatagactaacctccttcctttaatttccctcccactgctagatttatgtttcgagattttaacccttaaaattctcaaaataaatatcagatgatactaaagtattgttatttatttggaggatttgatgatggcatggtagctttgtgattgtctatattttttgagatgcatatttaatgtatagaagtaaactggcatgaagtctgggttcccttcaaagtaccttgacaaccaaattaagagagagagtgaaacagaaagaaggcaggaaggggaaataaaaagaaaaatgaagcaaatgtgataaaatctagataaagagtgatttggggagatggacatatggagattaattacagtattctctactttcggatatagctgtctatttttataataaaaattgataaaaagtaaaacttctctgacccattacattctttataattgtatatgaataatttaacactcaagtgcataactactgaaggacacagacaacagtgtagtttatattaaatgggtaatataaatcagtgaaagtgtcccaaaaaaggagtgtgtgtgtgtatgtgtgggtgtatgtatgtaacctcaagtattctatgcacttgcttcaaagaaggatgcttcagtgttctgctatggagggccccaagtagtaaagttgctaaaaatggtttggtttcatcttataatcaaacaatgcagaaataatggactatgatcatagtactctttgtctctgagaatcaccaccctattcaagcccagcgaactagctttcattggtcttctgcatatgtttgaccctagtcttagactgaaaattaaggggggaatagaaagaggtaaaaaagacagcataagaatttcagttatccattcatcaagatatatgattttctggggtctttctatgaccttagcattctaaccagagtttttgtccatagacaatccacaaatctgttttccattgattacaggacctgtgtgatatgccttattttttgtgtgttgcaagatgggcagatgcagtatgcattgcattgataatctcttgttttttttaatggaagtattctaatggcttttaacatttttgtggatggtaaagtaatctcctttaatacctagctagatatagttgtcactcagtccagcaacaataatgattacattgctactgaaacctacaagttaaatctattatcaacagaatgcaaccaacaaaaccaatctgttattaatacagtttcaccatgttggctgtgctgcttaggtggagaactggaatatttagaaagatattttatgacttaggacatggcaatttctttcttctctaaaaataaactttgtgtatgtaacattcacaatagaatcattctcaaacaggttgtgatcccaaagaatatcaacaaagcggcccactgagatctcagggttttgtatggaaccccaaataacacataatttcaaaatcgtgaaatagcactgacctttataacaatcagatataagatcccgaattattttttcatactgatgtatatacatactactaattttatttgttaaagttaaactaaatttactaacagttaatcctacctttaggagttgttccagttgttggtgtgacaacatttttctgtaatgattctgtgtttggtgttgttatagatggttttgttgtagtaacaacaagtgaattattagctgcctctaaaacacctgaaaaaagtaaagtagttgcattaacatttacatatagtttgccaattaatagactagtatatttaaacaagtgtactggtcagtagaatgtgaatttgcaaccaattttccagttgtaatcaatttatccttagctcagcatttattcattaactgcatctacttctccccagtggcatgaattttcaagatggctggtaggagcagtttgtggtttcagagcaatataatttctgagaaaactaatgaggaataaatgtataaatctgaaatttaataatatttttaatccaacgaaactaaccttgccagatgaaatgcttaaatgggcactctctgggcagtagatgtttcactaaatatttttacatcacattaaagttattaagtagtaaaatgtcaaaattagtatatgtcttcttgatataaagcactctatataaatgtgtactatataaagtataaaatataaaacattataattaataaagacaagagtatacatatatacatatacatatatgtgtatatatatacacacacatatatatacacacaaagataagttccaaagaaagacaataatctttaatgaaattcaacaactgcaacatacttaaaagtaatagggccaccataaatccacattttttaattgtttatttctctaaattttaacattaattgggcaggcaaaggcacagaaatgaaggcaatacattttgatccatattatatatttcttttaaataaggattcttaaaacttctattgaaacaaatgatgaaatcagtcttctgtaacaaccagagttggcaaaatcatcatttcattattatttttcaaagtgaagtatgtaagatttaactcagtgttctatgaaaagatttacttcacataaaattattgtaatttattagcatttataaaatatttttagtcctgtattttgttgttttcatctctggaaatacagttttatgttaaaaatcaaaatacagcgagcaagtgtataagagaatttggaaaaaaatattcacgtctatggaaagcattgttttttgttgttacttggtctggatagagtatatataccatgttagttaagaggatggactttgaataatacaggcatattcaaatcccagtcaaactgggtatgttattatagtaaatgtatgtcaatagtatgacttctcaaatttaaattacatttgaaatgttccttttgaatctgagaaaaaccaataatctagcatgtcagtgaaactaatatctcaaatgtcatgacatagagaatatgtgctgtataattttatagtcttgagatgcttggaagtgttagttcttagcactgactctttatagatagcacatagaaattgcttgatgtattcagcacatagagaaaagtgttcagcacatacagaaatgatagaactgcattttcacaggctttatggaaatcaagtcaaaagcttttttcacctctggaggtgcacttcacacccttggtcttacctccctaccccacaatattcagcagggagcaggaatgcagcctctagaagcttatcttttctccattagtcattttgttctggctatttttgttttagccttaacttctatgatgtaacactaattttaaatttcatattgaggttgaagaaattacaaaataaataccacttagacaggaaaattcacctataaatagcctgaatgatcctcacctatggacttcctaaatagtaacattcttaatttctgagcataatcaacgtctttagagatgttttccttccttccttcctttcttccttccttccttcttcccttcctcccttccttctttcctccctctttccttctttctcttccttcctccttccttctttcccttcctttccttctctcgttttctccctcaatatttattgagcaactacttatgtaaaaatcatgattagatacaataaaagactctatgatttatcacatgatatcaaacattactttcagtctggtaggaaatataatgcctatgcacaataaataataatgtatatcatatatgggttgtataaaccagtgtttttcatactgcaggttgtgatacaattaaagaataattaaatctctgtagtagattacagtcagagctttttccaagttggtaaagaaaagaaacaatatgagagtggtattgcaaataatagggtaagtattgtttcatgaagctttggtataggtgtgtgtgtgtgtgttgtgtgtaagtctgcacgaaatgtgtgccaatgcaaaatacatttcttaatgtgattctagttaaaaatttgaaagctgctggacaaacaataaattggaaaagactttataagataaaataagactactctgctggcatgaataatgaatacttcatgctaggagctagggctggaagagtaataatatatccatgcagggagaggaaagggcatgagcagagctctggagtggagaagtgaaaggtatttcagagtactgcaaacagttctgtctagctggattgcagtgtgctatgaaggaacatagtgcgcatgatctgggaaaatactgaaggcgaactgtagaggaccatgaacacccagaccaagatttaagattttatcaagtcactggagagccatggaaagtgaccaaacagaaattccaccctaggaaagacaatgggaaaatgcatggggcagagaatgagaagacaccagttggatcaagctgcaagccttcatttttatatttattaatgtcctctgcccttttgaagtcatcatgtgacatcaatgagttcacatccaaaaaatgactgtatgaaaactacaattaagtgaatttctaaccactggtgcagtaagattgagatgtactgtaaggcttttcctcctcaacatccttaaacatatttggcccctgatttcccctgagtcaaactttaattaattagtactctttaacatctctattattagttctttgggttgtttaacaaacagcatgccctcttttggcaagggctgacaactcctaaaagtactgagtgtgccatattccaggctcaatgtaaatactttctgtgggttatctaatttaaagacacaaagaggctcatattcttatgatcatcattttatggataagcacactgaggctcaaaaagggtaaacagtttgccaacactatgcactgttaagtgatatagttggtatttaaattcagacagccttgacttcagataatatattcttaaccatcacacatctggccataagaaggtagtgttatgcaaagctacatacctcagctccagctgctctctgcttttgacagggtgtgatagtgactaggcacacacatgttttgctcttatgtaactacaatgaggaaatagacaaaatagttcactatttttttcttgaaaaaaaccaaacatttcaagtgccacatatatacatgtgtatgtatacatacgaacacataaaatgtttccatattagacttcaagcttcaaaggaaatttcccactggataacactatttagatctgaaaaatgcaaaaaaaagtttttcatttagaaaaattttgcaactggaaactttgtcttaccatgtggtggaaaagaattatttcctctaactaccatggttgaaggttttgtagaccatgatgcaagtaacaccagatatgcttttactgtattatctgtaaattccttctaggtcttatttgattttgtaataaaccattgagaggaatagcttattctaaagtatctccttttcacaggacatggtgagatactatttttttcctctgtatgtcaaaatgattaaagataaatttaacaaggcaaattgagcctcatgactttacttgtgccaaagcagatagcgctgctcttgggatgttgtaagagaaacagatggtattttgtcctgattctaccctgtccccatatatccagacttagagagctcaagggatactgtgatacgagtttcctgtactacaaaggatgaagcattatctgaatattaagaaaataactattctaattataaaaattctatgatagatttttgctgaggtctttccatagattctgaaatagttctgtattctctgaagttcaatataggaaattcccaaatgtgcacatatagggtctttaatgtgaacttgctttgttttttatctttgagaattcagcttatagttggaaactaaatatattttctctgttttcaaatgataaagtcatctactctttgtaattacaaagcatgtctaatctttgtaattatatttttagataattgtcaaatagtcactaaaaggtttttgtttaaagggacagggtcttgctatttttctcagactggccttgaactcctgcgctcaagatatcatctcacctatgcctcctgagtagctaggattacaggtgtgcaccatgactggctaaagtcagagtttttatccattcttataatgagtagtgctctctccagctatctttcctctttgggacggcggatcacctctcctttactaagtctacacctaaagtccagtagaaatccactactaaagaaagtagatctggcttcttctagatcaacataaacattgaagacagtaacttaaaattccaggatgatttgagatcgggaaataaattttttggtatcctaatgaaatataatctttgcattttctagcttagaaaagttatgagttttagggtagtttcagaagatcatagcaccaattagtaaaaaagtttcttttatttctatttcagtactcttgattacatgatatacaaaaatctgtttttgtttctaattatactacttgggtatatggaatgcacttgccctctgaattatctctgagaacatatttacttgccagtgtgctccataaacaaaattttggaaggaaggtttaaactcttaaagaaaatgatttcttcaaaaatatataattacggtacatgcaaaatgctaattaccaggtggtcttataaatgtcaaatgccctattattaggtaataatgtcataacctagaccaactaatttatggaattgatattaaaacaattttaattcttaacaacttacaatgtcttatttctacaaatttatatggtcttcatgcattgctaccttgtatttattcccagcaactcagtgttttacaattttttgaaaattttatcttaaaataaaataattgccagtttttcagttatgattttgtgcatttttattctctggtgtatcacagtatatcatgaacaaaaatgtacttcttaagtttgcatgtaatggcaatgcataaattgggacttataaatggtaggagggtcccttttcattgtaatttttcagtaattgctaacattataattcttattgtatactttctatggcagcaaatgaccattaatgaactgtaagttgaaaatttctgtctttctcacatattaaagagatatataaaatatatacataaaaatataataaaatatacaaaaatagatacaaataaaataaagtactgtttccatatttgcatcaaatagtcttcataaaagacctggcaccaacttctttttgattattaatttcatattaacacggttgtacactaatggtgctccttctcttttgatatgggagaggtcactttgatccatggccaaccacattaaatgcagcaaattttttcagttaaaagaaaaaaattattatgtgatgatgcaacctggataatttcttctgtttgccttcctccaaaaattgtaagatatcatataaaaatgtataagtaactcattagccaagagtcatttgcctcaataaatatttattcagcatcaatttcaacaggtgttaagcacaattttaaaatgtgtgtttttcctagagtaacttaaaagtttttttctgatgcttaagctataaatacatgtgaaacaactagaagattatgcttgcagttgtgccatataaaaatggtgttatataattagtactatacatagctggttctacacaatattaagtgaaatcaaagtgaggtcatgtctctctacgtgtctggcataatcagaaattattttcttggaggaaaatttttcaagaaaagccagataactgaacacaacagggaaagaaaaaagtttatattcaaatagaagaggaaaaccaatagtgccaataataggaggtccaaaaagggacattgacaatgttacacattaataagcctaatattttgggaggggaaatcagggaaatcccatttacaatgaaaacatcagagctaggggcaactcttgtaaaagaagcttttaaatttaaagtacattttcaattaaagctaaaaagtattgtagcaagcacaacagttctgagagtgtttaaatttcctatatgaaatgactttggaagataagtaagaaaatctcatctctcgcagagagaaaaatatttagataagtgggagaaagctgcacctgaaagaggaatctcctcaggttgccagccatctgtgaggtggggagggagtgccaagcctggcaggctctgagattggacaggtgtctcagccacctggccgctctggggagaacaggaagacagcattccagtggtgagtttgttaaacagaaaacaacaatatctgcaaaatggacccaagaacctgagatgtcctggctgacaaatggatggaggtgtacaaggtaaattgcctacactcacccaggtgtcttgttcaaaagtacggggccatgcagttatttttccttcacaaatggataattcttcaaagatcatgttccatagtaatgagatatttttagattgtggactttagtataaggagtcattttatatattatagccagtttggttgaggaatttcaaatcctgaggtaaaaaaggcaaaggttacatttaatatttataaatgtaggagtgggaggaaaaaggaatatcttggcaatgctccttggccttcagacacttgtcctgagatccctttcttcctccatacagttctctgaatctagaaaggaactatggttctgcagctcaaaaactaccttccaacgaagtaagatgctggggctcagcacatccctgtaagcaacaacaaatccttataaggaagttaccttccaaggaagtaagatgctggagctcagcacatccttgtagggagcaacaaaagcaatcaagtctcttggatccatctcatgacttcagacaagggatcactttgggtgccctctcagtcctgaggggagcagcactgctttgtcccttttctgggctccacatagaggaggggaaagtaggagaggatgcagttcctattatctcttgaattaaatcttcggcttttgatagagttaggagttgtgtccccacccaaatctcatcttgaattgtgatctccataatccccatgtgtcaagggagagaccagatggagatagctgaatcatggggacagttttccccatgctgttttcatgacagtgagtgagtctcatgaaatctgatggttttataaagggtatttcctgtgcacttgcacacatgctctcccacctgccgtcatgtaagacatgagtttgcttctccttcaccttccactgtgattgtaagtttcctgaggcatttccagcagtgcagaacggtgagtccattaaacctcttttctttataaattactgagtcttgggtacttcttcatagcagtatagaatggactaatacagctttcctctgaacttcaaaggtagccacttacaatcttaatttgtaaagtactggctctcctgagcatttctttggagacaaggagagtctcactggacactttttactagcagatcacattagtttagtatagtgacttgcacacatgaaatggcatgatggaagaaaattacaaacctggcaactctgacattagctaactgtgtaactgtgtgagccactttaccttgctgggcctccattttttcatctataaaaagtgactattgagcaatgtctcctcaactgtgaaactgtattacatctaaggttcagttacaatgtaaatatccatcatgacaaataataaagaataacttgcatttatacatatcaaggggaagcttgtatgtcaggagttctacataattggtctatggagttattaacttcttacctgggagaaatctgtgcccaaaagggaattgtgtattttaggggacaaagataactacattcatttacaatttggtgatgttgcctggattaaatgtatttccctttagtgtgttgatctacccagaactagagaaaatgttaaaggtaaaatttgaaacagacatttggaatactttgctttggaattttcttttcaccatagaagagcaagtataataagatgaaatctttttatagataaatcaattcctacctgaataaacagagcccatattcaatacgttagctaattcccttttaaagtgtagtatgtgtatgttatgcctataattagtgaaaactgagtttctaaaaatagtctacagtattgcacttgaagctagaacatgatatttgactgagtctgagatgtcttgcttttcatattatctactcttatttttcttttctctaaatgtaaagaaaaactatttagttgatttaaaatactccttagtttgtatcaactgaaagactagttataaaggggtaaaattttaaaagttatttttaccttctaaaaaatcagagagaattttttttgccctgaaaggttgttttaagttacagaaaatgtaacttaaatgactggcattccaagaaaacaagcacatataacaataattacttttatttacattatttgattctaataacaattttgtgaaacagttgaacaggcactacttgtatctccattttatagatggagaaacctggtaaccaattttgacttttgaagatgcagtcagaaagtgttagagccttgttcaaattcaggtgatctagtctcagcttccatgttctctttctctacattggctataggtttagaactgtaatatgaaattatgctgtttgtggttgcagtattcccatgctactactttagtactctgatgactttaaagagttcatttttcccttatgctattcctaatcattatgaaaataaatgtaacaaattagggtatatgatcttatggtaattctatttttaattttttgaggaacctccatacagttttccacaatgatggtagtaatttagattcacagcagcagtgtggagtcatgtgacacataacaccatttcagtcagtgacagaccacatatgcaagagcaagatgataaaggagctgaaaaattcctgttgtctaatgacatcatagctgttgtaatgttgcagtacaatgcattactgacatgtttgtggtgatgctagtataaaaaaacctgtgctgccagtcatgttcaagtatagcatatataattatgtacagtatataatatctgataatgataataaatgactatgttactggtttatgtatataccatacagtcaaccctctatatctgcacctacaaattcaaccaaatgcggtatttctgggatacaaaacctgtggatacggaagaccagcttttcatatctgtgggctccacaaggccgactgtgggacttgagcatgcctagatttcagtacctgcaggtgtcctagaaccaacctcgttggatactgaaacacaactgcattactttattatcattattttagagtgtacatctatttatttaaaaaaagatggttaactagaaagcagcctcagagagttccttcattaggtatttcagaagaagacattattataggagatgatagctccatgaatgttattgcccttgaagaccttccagtgggacaagatgtggaggtgaaagagagtgatattgatgatcatagccctgtgtatggctaggctaatatgtgtttttgtgtcttaattttttacaacttgaaaaagtaaaaaaaaaaaaaaagattaaaaacagaaaaaagcttatagattaagaatattaaaaaagaaactatttttgtacagctgtgcaatgtgtttgtgttttaagctaagtgttattacaaaagactcaaaaagttaaaaaaattaaaaatgtcataaggtaaaaacattaccataagataagcttaacatattagtatagaaaaaaatattttttataaacttggtatagcccaagtatacagtgtttatacagtctatagcattgtgcagtaaattcctagaccttcacattcactggccactcactcactgactcacccagggcaacttccagtcctgtaagccctattcatggtaagtgccctatacaggtgtactgtttttactgtgccttttctatgtttagatacatgcatacttaccattgtatttaaattgcctactgtattccatacaataacatgttacatcggtttttagcctaagagcaagaggttataccataaggcctaggtgtgtagtaggttgtgtaagtgcgctttatgatgttcacacaatgacctaacaagacgtttcgtagaatgtatccccatcattaaacactgcatgactgtactagggttccgttttctctacatcctatctaatacatatcttcttttatattttttatagtagccattctaacaggtatgaggtggtatctcattgtgattttaatttgcattttccctaaagattaacgacattgagcattttttcatatatctgttggccatttatatgtttttactgagaaatgtctctttagttctcttacccatttccagttgggaattattttctttctatagagttgtttgagtttcttatatattctggatactcttttatgatagctatggcttgcaaatattttctccctatctataggttgattcttcattctgttgtttcctttgatgtatagggctttttatttttatgtaatcccatttgtctgttttagcttttgttgcctgcatgtgggggatcaaatataaaacaaactttgcctagactaatgtctctattctgttccataggttgatgaatctactcttacgctagcactatactattttaattactattgctttgccgaggaactagctgcaccacacttgggaatttaacagctctctgcatggcctcaaagtccatctccagttcttgccaagggagggagatgaccatcacagcaaattttagcaaagatcagaggctaaatctgccatacctatgaatttaaacagtgttcagccaaacctaaaagcccccctgcctcaaggctccccataggcaggtgggcaaacttcaaccgtgcaattctacagagcaaagcagttggtcccatccatcctgatcagcaactccacctaaccttagggccccttcagcaaccctgtccaactcttaaaataaaatagtggtaccacttgaccaaggaatagaccctgtaacctggcccaacatgaggtggttgcagtgcctatccagcagcttagcctgataacagaggtcagtcagtggtcttgccacatagcagagcccagccagctgcctcacccaaattaatagcaaaggcagtaggccagctatctagagaactcaaaagcaggctctctctgaccagggttgttaccaactggttcatctagaatcacaggctagactaaatagtgaaagtttattccttccaaagaacacctgtgaaatttagaaaaagtagctgtctcctcacatgtacagacaccaatgcaaggatacgaggattacaaagacttaggaaatgatgacacctccaaaagaaactattaaagtcccaacagtaaccctaaagggagatctaagaaatgacaggaaaaatatcagagtaattctcttgaagaagttcaatgaactataagaaaataggaataaaaaattaatgaaattaatacacaaacattaaatgaaacaatacaatacacaaacaaaatgagaagtatgacaaagaaatagaaacaacttagaaaaccaaatagaaatccttgagataaagaatacaatgactaaactgaaaaatgcaatagaaagctccagcatcagactcaaagaatcagtgagcttaaagatagaacatttgaaattgtccaatcagaggagcaaaaagaaaaaagaatgaaaaaagcctgtagcaattgtgggataccattaagagaccaaacatacacataatgggaatttaagagaaaagcaaaagaggaaaagaaagagaaaagagacagcatatttaaagaagtaatggctgaaaacttccctaatctgggggaaaattttaacattcagatacaggaagtgcagatgtcttaaatcaaattcgatccaaatatgagttcaccaagacacatcacaatcaaactaccaaaacattaaagatgaataaaaaattcagaaagcaacaatagataaaaaacacatcatatataaagggatcccaatacaactatcaacatacttcccagaatattattctttaatatatatatccaatgtcctttgcgaatggaagagaagacactaaataaatcaaaataatttattaccagaaaaaaagcaaggggtggtgtagtgtagggagtagaaaacgcggtctgggggccatgttgcccaatttgagtccaggccccatcacttatcagctatgtgaccatatgcaaacagcttaacctttttagcctcagtttataatctcatagaaatctaccttatagactttttgtgcagatctagagattaaaacatataaaaagttaagaagtacagctaacatctgggttacacttgaatttatcatgtttataactcaatgatataaagtacattttagagttctaccattaggttatgttccttgctaatactgtcgctatacagtcagttaactagttaatggggccatctccaacccatttagtaagttcaggacactaaaatcttttgaatgaaaacttaatctcctccctaactcataatcttattctctgaattttgtcaactttgatgaccacttttctagaatttataaattatacttattattctctttttctaatatcctttcaccattccttctaagaaactgtgattatagttgtaaaacaaaaagattgcagaatagaaaaaagaaaacttgcaaattgggctcatgtggcggaagaaagagattttacctgttatggttctgtgggctccacattaagtgctctcatgctctagaccttgggctactgggaactgcagagtttacaccagggatctttgaatccatattcacactaaatattgtctatatatggataaaatgatttacccatctatgctactaattttaaaatcagtaacttctattctgattaaaagtgtatgaaattttagaaattgcaaaatatttagtagcattttatttgtttcctcaaatgatgaatgcaattattattttacacgggggttgtttcacaacttttttccatataagtgagttatttatattttaagagttgggggaccactcctctgtggatcttcaattagtatagcagtagaagtagagtttatttaaattcactcaagtcttcatatagcatcacaggacaaatccataatctgacagcttttcttattcattccctgcaaatagtcagagactttcttcaaacattgatgactcatactttttaattaaaaacaaataagcaaatacctacagagtagaggatttatagctctttggttccaggatataccagttctaagtgctgggacaaaaacatatcttttccttttccaaatctgttcccccagtttctccacattggatgtggaaaaactgctctgaaccacatgctcagcaagaggccatcatgtatttatccaagaacaaagaagaattcatgattgtctgatttttgattttttatactagcttttatatggtatagtttccaaattaaaaatattttgagctatgtcattaagatgccatcaaaagagttacttgtggtgggttaattaaagtgaacacatttagaaataactctgcatgttgtgggacagatgtagcctttggagaaggaatgagcctacactgaacattacaacatagttttgtatttagtaataggcaacagacacagtttcagaatatgctcaaagtctggttggggagtatctgctctgctgacagtgggagaaatcaggaaattcatatttaaaaagaaggagatcaagaagtaaacagcatatctttgcttctcaatcaactcaaacttgcttcattatttaaaagtagtaacctgttgtataacattggccaactttaactagaaaaacaaaccactccagaatcccttctcaaattccaagacacagatgaggacagaaatgataattatctaagtacacatggtcaggtgtacccttgcaagaggcaattttggaaatttaaaagaatgtctagaactgagagtaaaagaaagagctgaagataaatgaatttttctgctgcggaaaataaaacaaaacttgttatacttttttttttgccccaagagtatgggtaagagaagagaaaaaaggtcaagaaaaaatgaagcatccaaaggacttttaagaacaaaaatatctaaaactcaccctttgcattactgtgatataaacctcccatcacctaccaagattttaattaactgtattttttttgtcatccatgaaggaaggggaactacattttggttgttgctaatgtgaatttaaaaaaaagtcataagaatccaaagaaatatgagatttgacagatgcagggagctgggaagaaaagtgagcgtgagaacttaatcctccctctaccacatgggatttgcagaaattggtggcattggatttttgagcatagaataagtcttcaatctcaacatattttatattaaagggtggcaatacctagatgatatttgagttacctaatttttttttatttcattaaacattgtttacaaagctcaaatcaaatttgctgagtcacaataatgagtttgacaagcagaggataatcataaatttgttctataacaaattattccaaacagtttggctataaattgtttgctttacaaatatggcaggataatcagaacaaataaaatctgaagctatggaataagtacttcaatgcagcctcaatatacttaaatctgagatatcacctgtattaagtaataaagtgtttcctaaatgtgaagactaccattagaacagagttaacatttgtaaactgatttttctggttttgaagacaaattcatgccagaacaattaaatttactttcctgacagagtaacaaggatataaataggagaaaaccaatcgatgtaatctcatattatgatcaatacgtaatttcttttattgagacctaagagatatggtgctttgtataattaaaattttgttagtttagagtcattacataaaacatataagactaatcagttttcaaataacttttatagcattaacatttatctgtgtatctttagctactaatgcagtacttgattttaggccctcaataaatgtttattaaatgctaaatataagtaaatttattcttgaatagctagaatcatcaaaatattaggattattctatcattttaaatagaattaccatctgctaaaagtagaagagtaaaacaactgtgttgaatttatattgattatatgatttactgttgaaatttcatattgaaataaaatttctcggcttaaatttgtttgcagtctgttcacatataattattatttctaaacacacttttgctcttttgtgacctcagtagtgttcaatgctgaataaatatggatttatgatttttgtttttcagatagagggtcactttaaaatctgggaatattgcccatgttcttggcatttttcttatgtctagtgagactctgtaacatttgaaaatactactcttcctatcctcctgggtgataaagattgaagtaaaatatatttgataagttcagaagagtcatttaccaactatcaaaatgtcctaaaaactcttgtcgattttagcagccttctagggagaaaaaaatgctggcaaaaggaaatgccaaatttggctgtagcagctgcctgtggtttaatctccagaaatgtatgtccaaaacttcattcactttcttagcacctttatgagttttttcatattctttattattttcttactctttttcttaaaattacttccctttaaatgattcaattcaatgttccaaaagaaatgttataatactaccacaaaagtggtaatagaaataactacaaaaacaaataatgtgaaaaaagtaattcagctctagacaggtatcattaactatgatggtttcatgcttgaaccttgctctcttgatgttaaagagtgaactagtgagttttagggcatggtaaaaacatgaaagcaccaaacatgtatgttctaaattaaaaaccagacgcagattagagatttgagtcaatgttatttaattctatgggcatttatggctaaaattatcttaagtaccagaagttgtaccctattacacaaactggaaatattgctctagataaagctttttaaggtctccaaatcagtcatgaaggattttgtaatgcaccatatgatagcttctccatatgacagaaagtgagtcccattccattttctctctttccttttttttttctcatattagcatgccttaagaactgtattagcatgctttgagaaataaagtcagggaagcccaaatttcagtattgctttagggactgataatataggtagaaactaagggccatgtagttgattaaaaaccgctttatgtctaaagtccctatgacaagaaaaaattatatataaaaaaggaagtataagacctacaataatctagctagacttgagtaaggcttttgatttttgtctcttgttactattaaaaaaaaaaaaaaaaactagattaacctatgagccagtaagtagcaaagtcaatctaaagaagatttagtacagcattgcaaaggaatatgaactttacagtttaaaaagtaatgcaaatcaagtttgtttgtttgtttttttttttgagacggagtctcgccctgtcgcccaggctggagtgcagtagcccaatctcggctcactgcaagctccgcctcccaggttcatgccattctcctgcttcagcctcctgagtagttgggactacaggcacccaccaccacgcctggctaatttttttgtatttttagtaaagccgggtttcaccgtgttagccaggatggtctcgatctcctgacctcatgatccgcctgcctcagcctcccaaagttctgggattacaggcgtgagccaccgctccaggcccaaatcaagtttttaaagaagagcaagttgaacttcatttttaaggtcttggataatactaaggaaaatgacaatataaaaataatttgagaaattattgctcatgtataggataaagttcagaagaaaaaatataaagtaaaaaacaaaagagcaaaaaagatacataaaaatttagtaaaatagtataggagtaaatgcatcaggaaagatgtaaaaccaaaggaaccctaagtaggaaatgagtcattaatatggtattttattttaaaatcttattttcaaatggtactagagtgatgagatcatgatatttaagtattaagagataactattgctgtttttttcaatagtggttggattcttattacagcaggaattcagtttttgtgaattttaaacaagagcaaagttgtcaaagaagagaaactaatgtgagtaaagatgtaaattggattccaaaaggagaaggaaaggagttggaatgatttactgtttagtctgaagaaacaatgtctgaaatgaaatttaataccaaccaaatttacacatctatatcatttgcctatcttaattttccaatctgtaaatgaaagtaaaaagaatttcagcctaaaatttgtttcgctagatgaaaaaaagtatttattttcctaatattaggagaaaataaataggcaaatctagttcatgaacaaagtaactctcttggagacatgtcaaggaatgtaaattataattataagctaaatcaattagtaaaatatctctgtcatgaaagtaacatgatactttccataattacagtgtatcactttttttttttttagacggagtctcgctctgtcacccaggagtgcagtggcacaatctcagctcactgcaacctccacctcctgggttcaagcgattctcctgcctcagcctcttgagtagctgggattacaggcgcccaccaccatgcccagctggccaggctggtcttgaactcctgacctcaggtgatccacccacctcggcctcccaaagtgctgggagtacaggcgtgagccaccgtgcccggcctatgcataacaattattaaactctacatttaaacatttaatgaatctttttcattcatttaacacagataattacagaatgcctatatgtaccagggctgtgctaggtgatgatataaacattaattatttattttccttatcaattcaaataatttacttacatatcttattttcattatactactatttagtatgctttgcaggtatgttcttagagctattaaatgtattctttaaaaaatatcctcaagtgtacattttgtttgcagaaaagattttttcagtggttaattaggctttagaagttaatgttccatttttttttaagttacagaataaaaaaatctatttatcttgtaagattttaagtttaatttacaaatgtgattattccatttactaatgtagtgaatgcagtcatcattctagggatcctttagcatttaatcccatttatatattttgttaagtaaactcccttaagtattcaaaactctattattaattgaaaatagttaacatttaccactttgactgcttttaagtgttttgtagaactaacgtatgtaaaagtattttgtaaactttcaattaaatacacaaatatggcaatattagtattacattataatgtcagatgtgttaccacattgaaatgattcatcaaagaacaaacttcatggctttgctcataagtgctttaacaattgattagtttttaagatgtttacattttttaattaccttttctgccctgaattagatgggatttgaggaaaatcaaacttaagtgaattaaagtcttcagaagaattcaaacatttctccaactaataatagtctatcttaagcaccaagaagcattgtaagcaagcttcagtttgggcttcagaagacagcctcgtgacaaaccttttgtcctagccttgtgacaaggaccccatgcagaacaaggattttgaagtgtgcagttagccacaaatccttggggtcagttttcaatttagtggcacaacagataaatcaattagtgtataactaattaaagatggtgaatacctttaactgctaaaataatttgaggcagtcacatcttacagaaagctatctccctacaaaatgacaagcctaagcaagccttacaagtgaggctttgaaccctaaataggtaaggtttaatgagaaactgaaattcagaatagcagagtatcattgagagcaattgataatagctaaattaaagcttaaaagtgtaaagtatatcttttttgttcataggggatttgttctagagatgtggggaaatggaaaatcctcaaatagtgtacaaagaataatgataatacagatttatttgtaaaaaaaagagtttgttattgtcacaaaacacatcagaggctgctgacatttctctccatggttttcctgatatttcttaagatttttgaattaaatacattcagtctcttttaagtagtaatcattcttaagaccttgaaggatcttatcatctttccccaataagacttttaatagattccctgcttcaatttaaaattcttaaactcaaaatctgagttttatttatttctgcctaatgtttgtgacaactataaaagctaacagaccaaaacatgacaaaatataaatgtaaacataatgaataaatcttagcgaaaacctggtgtaatcattacccagattaaaaaatagaatattaccagcagtgtaaaatctccttgggactgtaaacgtatcagttatatccctcttccactactctagaggtaactgctaatctgatttatggtaatcattcttagcctttctttatagaactactctctatgtgtacatgtgaatataatatagtttagatttcagtgttttaattttatgtaaatggcaacatattgaggcattgtgttttgcccagtatattttaatttttttcattttattgattatagctatagtcattgtcactggtatatacaatacattgaacaaataaagcataatttacatatttattttgcaattgatagacatttgagctgtcactaattttgagctattctcaaaagttctgctaaaaacatatttttatttctattattgcataaaaggaaagtacttacttaagtcagccaaattttttgactgggttgtttttatttttcttactgatttgtagttttttttctatattaagatgagtcattttttggtcagttatatatacacagcaaatattttctcccattttgtggctgtattttcaattttgccactgcatcttctgataaatagaataattaattccaatgcaatgaaatgtatgtcttttcttttatggttagtgcttttttgtgtgttttcctgaaataaggttataaagctattctcctattttttgtaaagttttaaagatttccattccatatttaagtcaatggttcatctggaattagctttcatatgtagtgctatgtaagagtctaatttatttttttccactggctacccaatggtaccagcagcatttattgaaaagatcaatcattactcactgctccgttataccatctttgttttatatcaaagacctatatatctgtaagtcagtttcagagctctctattcttttctattcatctatgtggcatcaatgtgactaccacttgatttgtctaccttgcaccaatttgactgttctaattactgtatctttgttatgggactctataaatggtagagttatgttatcctttcctgtttttcttctttaaaaattactaaggatttcttggttttgtgcagttttatacaaaattataaaaagcttcttgtattccacatactggattgcccagtcaatccagttttctttatttcaagttttctttaacttttcaataaagtgttataattattctcatacaaataatgcacatcttttattataattatttgtaggtgcttttttatgtttccgtaaatggcatattgctacattttctttttaattatttgttgcatcaatagaaatacaattgatttcataaactttatatacagagaccctgataaactctttaattctagtgggtttttttttttgataagttctcataaatactgtacttaaacaatcatgtttacatggtgtcatttgtttggggaaatacccgaggttcgtcatctagtgctaaggaaattgaagatgcagcacacaaggagtggggttaaaagtagaaaatttaataggcgaaagaaagaagagaaaagctcccccacgtaaaggaagtgaggttccaaaaaggtcttccttttcatggcaggatgcagtgggcttaatagaggggcttgaggaagtggtgtctgatttatatagaacgtagtggattggttggactagatgtaacatttacatagctcacgaagagcctggctgtcccaccctaatttcttattatgcaaatgggatctttacctggctggggccatgttacctgcacatgtggcaagaaagaaaagggaagacaaaacctccatgttgaatatacctggcttccagatatcccttttttattggtacaattgcaggcatttacctatgcaagcttgcatatctatgcttgtggcttgatttttcaggccgccctagaaaaaaaatgatttgggggctgcttttaattaaaggaaattccaccaagaaatcttttatgctcattaactgcctaaacaatttctttttaactcctatatcaatgtcctataacatctacaaataatatcaattttgattttttctttccaattcttaatatattcatttttcatgttttacagcattagctaggatattttgtacaaagttttataaaagtagaattgttgggcaagattgtcttattgttattctcacaaaatgctaacattttactattattcacgatgattgctacagtttttgaagctgctctattagattaggaaaatcctcttattgttttagttttctaagcatttttatcagcaataaatattaaatgtgcagaagtgttttttctgcttcaatgagattatcatatattttctctttatttttccatgtaatgaattatgtcaattgattttctagtgtaaaaccaacttcacattgataatataatctcaatttgatataataaaagtatcattttaaacattttgctggcttttaaaaaatcttttttcataatgggattggtctataccatttttcttttataatattgttgtcaggttttggtttcaacaataagctaactttgtaacataagttggaaaataaaacttctatttttattctctagaagagcttatataaaagtgaatttatttattaaataaaataaaattttgtataacttccatgtgacacctactgggctggaaattttttgtgtgagaagattattaatggctgatttaatttcttttacaatttaaggcctaccgaagttttgtatttctgcttgtgtcagttttgataggctatagtttttagaaatttatttactttacataaatttttggcataaggctttggcataaggcaaaattattggcataaggcttttcataatatctatttattatacttatattttggcacaatttgcagtagtatttcctttttcatttctattcacttgtttctgctctcttgattagtatcagcagaggattaccaaccttatcattacacatgggtgttctttgcactatgtatttcttttccatttcattagttttgcttttatttttattattttcaccaatctacttttttattttttagttctaagacagggttttgctctgtcacccaggctggagtgcagtggcgtgatcatggttcattgcagccttgacctcctgggctcaagcaatcttaccacctcaggaagctggggtggtatgtgctaccatacctggcttacttttgtattcttttgtagagacaggattttgccatattatccaggctgggaaagatacagatattttattttcctaattataatattgatttattatctaattatattaaacccagagaaaatacacattcagatctttagttattttcaaaggaaatgttagtgcaagatatcaagcacaatatgtgaatactaaagttttaaccagatatctagatatgttaaattacaagaagatgggaaaaataaccatatgcaaattttcaagtaaaatatctataatctgtttgataaaccctgtaaaccctttacctattccatgacgtaaacaaaatcaaagtatgtgtgcagagagagagagaattatttgagaagaggatgtctttgtagaatattgtttctgaatcccattcccacctcttccatccccaaggagaagggcttgtctgctccctcaattcaaacctactttaatatgtgatccttacagttggaaggcataacggcctaggatctgactcactcctgggaaatctagagaattaaagatagccgatagctgcctaaatgccttgatgtaggatcgggagagttgttaaccatgttgagaataagccttgtgggcggcaagccatccaggcgctgaggcaagagaccgagggcacgaactttttcagtataataaaatatataaaacaacaagaattacactagatctagatcatagacatgattatatatgaatgtcattaatcattagtttgtagcaattactctttattccaatattataataatcctcgctctataatcataacctagggaaaaccaggccatacagagataggagctgaagggagatagtgagaagtgaccagaagacaagagtgtgagccttctgttatgcccggacagggccaccggagggctccttggtctagcggtgacgccagcgtctgggaagacgccttttgccaagcggaccacggtctagcggtagagtcagtgccaaggaaaaacacccgctacttagcagactgagaaagggaatctcccttttcctgggggagtttagagaagaccctactcctccacctcttgtggagggcctgactgatgtcaggcctgcctgcagttatccagaggcctaaccatctccctgtgatgctgtgcttcagtggtcacactcctagtctgctttcatgttccatcctatacacctggctctcccttttagatagcagtagcaaaattggtgaaagtactaaaagtctctgatatgcagaaataatggcataagctgtctctctctctttctctgcttcggctgccaggcagggaagggccccctgtccagtggacatgtgacccacatgaccttacctatcattggagatggctcacactccttaccctgcccctttgtcttgtatccagtaaatatcagtgcagcctggcattcggggccactactggtctccgcgtcttggtggtagtggtccccgggcccagctgtcttttcttttatctctttgtcttgtgtctttatttctacaatctctcatctccacacacggggagaaaaactcactgaccctgtggggctggaccctacaaagcctgcactgcttgatgttgccagggaaagaggtattggactgtttcctgtgggccaaataaaagggagagagaatgagagtgtgggcttagggttatcctgaattccattccttagctctgtctggagaactgggaacatgaggaagctctcggttaacaaggatgaccagtgctttggaaggggtaaccagtgaactcccagaatagggattcacccacatgaggcaaggaactacagaggagagaggctgaaaagtgcacttttgaggaacccttgaaaatacaccattcagcagttgggctttaactatctcccagactgtgagcacagcttacggcgccacatcaagtaatgtctttcattcatcctctcactcctcccttactctgctcccagtacagttggtcagaaaggagcttgagagaggaagcagaaaaatagagacctctaaaaaaagccactttgtagaatcctactccacactggcatgacctacaagagagaaattttaattataattttggattatgtattctaatttctaattgatacactctgaaaatttagttgtccacaaaactgtccatttcttaaaggtgagcaaaaaagccataggtttccaatagtttcatcaaagatgaaaagtttatattcaccaaatcaatattaaagagatagtgggaaacaaaaataaaatagaattttaactacattttatgatttgtggtttctatgttttttaaatcattttctaagttttatgctttcctaagactatgaaacaagagtggtaatcactgctaagttaattatttatagtaacattttaataaaagcaatcatctttatgaaaaatggaaagatttggcacctagaatgtgtctttaaaattctgagattgagctggcaagcctagttaattgtagaaaaaggcccccagaaccctatcttttcgatatccattgagtcaccacaaacatggtgacagctttgcaaatcgtatgcctaatgcttagacaaaaccctacagctactatgaaataggtgatgagattaacccaaatgcccatgggtcatgcagagaggtaaaagaggataaggtagggtttaaatgcatatatgtttgtagaaaaaaggggcatttctcaatttaaaggggtgcttattactcagatctaactgaataatatcatgaggggatatgaagtccaatttgtcaaaaaaaaaaccctgaaaatacaactttatttcttttattgttgttattgttgttttgcaaaatttccttattttaaaatatttgtaaatatttatatggtcataaaacacacctggtatgttacatgtttagtgtggccaaacaacacagacattcaagttagaggttaagggttgctagcttgtaaattctggaagatagactgctaaattcttcttgtaagttatcctaattcattaagtaacggtaagctaatgaaccagttgacaaatttcagtctgttgttttttgatactagaagtgtgactacccttctagcctagattcataatatcatagcttctgcatttttttcatgctcacaaatgctagtaatttaatcctctatatattcttaaactcttcttacagttaacagttctctgggaaccagaaatatttgtgtttggattatctaatgcatcttgatcccacttgaaactttgaagggaataccatagttgtttctctaataaaactatttttaaatgtggctaaatttcttgagtaccctataggatagaggcccaggatcattcaatgttaatgaaaacatgagggactttaatagtagaagtgaaagcaattgatatgattttataatgattaggagatgaagggcgcctctttgcgaggagattgtcaaacaaagctggaatttaagcctgtatgcctagtgagatttcagcactttgactaatatttgtattaaccaaatctgtccttggccaaatttatcttaaactagtacaagcaaaaaataataataataatttagattaaatttataccaatattttccctgaaagccctagactctaacactttcctagaaaggtaaacatctctgcttaccttgtgggtatgggacagtgaaaagagcacactgcacattgagtggatggagggaagaaggattggcaagagctttaatggcaagaaggaagaactccactgggtactggccttgtaagagtggctagagggcctgtgcagaatactcttcccaaatccttagaccaattaatgagtttccccatctcctcttcccagcttcccagctgtcttagacagtttctgtctttctcccagcatctgtcatttcctcaatctcttttaacctcatttttattctcaatcttttttccggatgttggtttctgtccccaccctctctccaagtcttttttctagccccacgcctaacaaatatctcccatttgcataaaaatgagaccacatggaaaaatgaaaaacatgtttttttgttgatgtgtactatgagaaataactctcatgacagagaattggccttttacatgcaaagtggacactttctaacatccctaactgaaaaatctctaaaggaagtaaacattagggaatagaataaaacatcttgctgcagaagaagcgtatctagtgataacaggatgaaaatgaagcaagataacttcaggcaaaatgtataagaattgtttgttacacaaaggttatggaactgtagatctggaagaaatctttcatatcacttgattaaaccacactcattttatagacatgaaaattaaagccttgagaggttaaaaattttgcctgcctcagtcacacagcaagcatgtggcccctggtaactaacccaagtgctcttggctcaaaggttcagtgtactcttcaccacttcagtatgctggcttgtcacaccagtcagggctcaatgggaaaaatataagaaagttgttatattgccaaatatattcttttttttagtgaaagtaccctttcttttatgtaatattctaatgaatagcatatgtattatggggaaaggattctgtatttaacaaagaacaaggtggtttatctcatgtcaattgcacaaagggcgtttggattatttactgatctaggaacaactgaattatgtggtgcttttgcttctgcacaagattaggataaagttaattactcaacatactgaattaagacttcagagttggaaaggcaaactatgtaatcaaagtgcctttacaattgaattttcataattttacagtctatcctagtgggggtggggactaatctgatctaaatggttcagaattacctgatgaattacagaccactaatttttgtatatgtgagcaagtaataggaatgacttggcacttgtgttcagatattcatgacactctggtatgatttgaacagtcactataattcaaagttaagtattttctgctatttatacaatagtaagagggtaggtcaacttcataaagcaaatcaaataagtttagccaaccaaacgagtattccaaaatacacttactgcttccgctctacagaggccagggataaaaataaatattgccctcaagtaactgaaaacaaatctaggaatgccttgggtattttcaactcttctgacttttgaagaaacagaattctccaaattaaagcaagggctagctacgaaatatcacctatgtgcccaaaaataggtcttgggaaacacacacaaaaatagtcacttagaaattgtccttgcttcctatatacagttaagttgtaacaaaacctaataatagatgtctaaatgattttttcttctcctttgtataccttaagaattttaaactttaattgatataaaacttgtacccaacaaatgaggctgtcaaaaaatgaaaaggaaagagaaaaaataaaaagttcactgatcacatcatttaattattctaatcccaataatgcaattagttaataaatctttaagttagttcactctgtgcatttaaaaaaggtgagtcccacttttaaaaactgggtttgcagagagagataattggagaattctcatggttgtttagagttgtcacaatggctttgagctcattaatgtaggagtggcctttgtatcctggggagagtgcccaagaactcaacgcttatgttctcacacttgctgaacaccctaggagggcgatttcacagttcataccacaaaaaagtatttcttttcccacttcagttaaaaataaattcaatgtgtgatacaaatggttttccgtgttttgtgtgtgtgatttttataactgaagcattatttcaacacatggccatttggatgtgaacagccataaaaattatgtaaaggtattatggctaaaatagaaatgatacaatggcagttaaaggcccaactagtaagggaaaattctgaaatttatggaacggtttcctatttctctcttgattctgtgagttaatgttaacttatacaataatagctaatgttttagtaatttatgatgtgcacagtatctaaaatgggtattcccattgtcatgtaacaccaataccatgtcaatatgtatctttcttctcattttttacatgcagaaactgggattaagaaagatttaatgtctgggccaatttgaacatacttagaagctagactcaaacttaagttttcacattaataccgtgtttccttccactaacatattcaacctctcagattaagcaacactcaatactttatgagagtagtaacaatatttgaggatgttgactattttcagactaaaaagagttttaattaaatacaaacacaattttgcttattaatttgagtgattagtttatagatgaaggtaaataacataaatctgaaagatatttgagaaaatacacctgtttgcatataatgtataaaattgtgcctgcatatattgtaattaaaatattacttggcagtcatcttacaacagttctattgtgaaaaattttcagatgctcatttttcactttgcgagaattaacattgtaattgtttaaatattttctgcttctggattggaatcaacttagaaataaaatatttcatctacggtgcaggatatgagttccattaactcagcaaaactttatataacatttatctcatatcagacgctattctgggtgctttctgcatattaccttgtgtgattcttccaatatccctatgaggtaattccttgtagagatattgcaagaaccacataaggcaatcatctccattttacagctgaggaagccaaaagttgagtaacttgtccaagtttatacagctagtaagtggcagagctggaacttgaactcagacaatctgtctccagaagcattataaacgtgacaccaagtgattaattcactgatagctatttcctctttgtttctttccttcttctccaagtcccatattagcttcactgacatttatagccaagtacatgtttttttcaacaaacataacaatgactggtaggcaaatgcctacaactccttccaacccatcccctaagaattaattgaatccagaatattaagaaaacattattgctaggtaaaaattcatttatggcattatagtcttagttgtcagtttagaaggctgaagttgctgtgaggcggagtagtgacttctaaattactcgagcggtaagtctttatccttattctttttcagaaaactcaacttactgaagtgtcactacatcagaaggtagctgaagagcaacagtccttgctttgattttaagccacaccagccttgtgtaactttatactatttccaagcatctgtttcttaatcagtaagatgggataaagctggccttgaaatttgtgatggaagtaatgtgtgtaaagtgcctggcacaataaatggtagatgttagtagatgttgtgacaatacttctttgggttaacttggaccgttcccaactgtgatctccattctctagtctttgacacaactaatacaggtttcagctagagtatgactgattcaatggatttaaaaaaacagttcacatttcagttgagaagtacagaaagaataaaatcaatgacatcaacattttttactactaacctcacagtataattcattactgcaaacaggcaaataattgccttagaacagaatctgtttagaatattgttaagcttatgtaacaaaagattgatcaaagatatttcattttctttgaaatgaaaaggaagaagggtagtacatattaatgagagtgtcagagaaaccaaaactaatctttacttagatatacactaccatctaaactaaaatgttctcatcaagaaaaataataaatcctgggttttcctaaatagcagagcctgaaacaagggcttctgttcagacagtttataaaaaaaaaaataggaagaggagaaaaggactaaaacaatgaaactggagcaggaatataagagaaaagcatttatgtattcagtgactccattccctcttttgtcaggagctgtctcatagaatgctaatgctcctgcacttctagttcaggcatctgataatgccagattctgaaatgcacctttataacagaatagcaccagaaagaaagcaggatatatgcattaaagtgaggcaagcggctgtcaggttacacccgtgcgtagctggttgccatagcaatggctggagtaaacgtggccagagaagatgtagggaaagacacaacaggaatctaatgctcatacggtgacttcttctactttgggactaattatgattatctctacatatatcattctataggatatgaaacctctattcaagttttaaaaatctatttttcttatggttgccccaaatttgggaaccatatagtgccctttctagatgtaattgacaccactaatgtttcccatggtgtgcaatggtacaaaaaggatcttgtttgctaactgagagagctgcttctatcagtcaaaaggtactgttagcctaagctaacagacctataatggataggaattcagtagctggaaaggattcagtacacaggaattgaaagttacttaaattcctattctgagctgggcatggtggctcatgcctgtaatcccagcattttgggagaccgaggcaggtggatcacctgaggtcaggagttcgcaaccagtctggccagcatggtaaaaccctgtctctactaaaaataaaaaaatttagctgggcatggtggtgggtgtctgtaatcccagctacttgggaggctgaggcaggagaatcgcttgaacccgggatgcggaagttgcagtgagccaatatcataccgttgcactccagcctgggcaacaagagcaaaactccatctcaaaaaaaaaaaaaaaaaattcctactctgacattcagtatttagaaacgtgcatctcatgttgttcttaaagacaaagaggaagttggaaagtgattactaagaaaaaaagaatgtgagtaacttgaattagataattattcacaagttaaaatatttggctgcagcttgaaatgtaacttcaccaatgaaaaggaaaggatgggcagttgtctagtaaattcaaagctttgtgaaacccttaaatattcatttttttcttagttgtctggataactacaattttcaagataaaattgccagagaatttgtttctgacaactgttataaatcttttgaaagtaggagttctagaatgatcacttctacttttaggtggggattattaaaaatcagcagtggagaaagaatgcaaagaaatggtttgcagactaaatacttttccatttggatttgttctatattggtttagtcttcctacaatagactacccatttcaggtaagagatactggtgtggattaagctcaacagaagtacttagcaaaattatctactctgaagcaactcacgttacctgtaatgacgcataaagatgtatgattttttttaactttcctccaacttctatttctgtaaatttcacttgtaaaaaagccattttgtatttttgagaagttggttgagaataaggtagctccttgaatacttttaactataggaatgtatcacattgagtatttgatacccaaaaataagtagagctggttctgtttagatattcttccccaaagtggttatagtttgagagctggctaacctttgataagaatccctttcccttatatttggtgctcactttcataactgaaatcaaaataatcgacttttttctatattatgttctctgattcatacttgtccataactttttcataaggacaagatagtaaactattaggtgattgtcataggaagaaattaaaatatgaaaataataagaaggcaactatttcattcaattatccattcattcagacaactatgtccttattatgtgttcagaactgttgctgagcaatctgtaacaaatatagcccttactttcaaggcacttataatcttgtagagaaataagacattcatgcaaataactatgacagaattggaaataagtaccttaggagagttagatatacgggcatccagaagaaggataaattgcttctctatgttattaatgttacaatgggcaagattaagaaatatttggattcaggactaaagaacattcacctctcaacatcacctctggctccaggggcataccgactacgcatcagacacttttaatttaccattgaacatctctacataaatatcaggattacaaaatcaccatgtccaaaaccaaataccatttttctcactaaaccgtctcctcatatctttcctaatctctgctcccaagccattttcctatttctggtattaaaaaaaactctgtctctgcatttcagtcacattctccttcactgccagtcaatgatatgtcaaatcacacactttctacttccttaaagctcttcctagacccttcttttcattttattgacacactctcagacttgcaatgacagttgacctagtttccttaccttttatttctcttgactccagtagtctaatctatattctgctgacagattagtcttcccattttatagccatgatcatataattcccatactcaaaccatttacagactcaaactaattaactatatgagtcaatatttctcatcctggtattcaatatctcctgaggctatattccaatcttatttctcagtacttaactatgcccaaattgtgacctctttatgtttctagactagaatataccaatgtttcaatgtatctactcaataaattcccttcctctagaacctcttgattttcaagcttcaaagcttataataatttccacttttatatgtagccgtttcagatgtccttacatccaaaaccaggctagttgtaaattttctatgtcattctttatttacctcttaaagcctacaatatagccaaattgataataacttccctcatcttcctctctcccccacttctacggtgagggttaacttttattaagttctataaacttacgatatttagcatggagtctgctgatagtgtgtttaatctttctttttcatgaaattgaatgttcaatcactaacaaaggaatttctccaagcaattaaatccttcttcatataccaataaagaaaatggtgtttgtccctgtctgagaatgcctacaacattttaatatttcccaagttaaggcaaatttcaaaaagcaagtggcacttgatgagtaagtgcatattgtttccttcttcttggaggaatctctcttcattaacttctctcagccctgaaagtcaaaagctcatccatacatctagatttaaacgccagggtaggggtctgttcagttttaaatacaatttagaaaaccttaagaaagaatggcagttccgtttcagaaaccttccatacacatttcaatagaacagctttccaaattggagactgaaaaaatattataccaccaaccaagtaataaaaagtaactcactgactgtgatgtagaaagattcccttgattttcacaaacagcatgaaagactgtattgtagttatttaaatctgagactgacaaaaacatcagaagaaaagaaaagtagtcaatttatctaaaagataattatttaggaataaattactacgcaaaagagcatggatctgcttgacagcttgtgaatttaaggcagatgaaatgcctccctcctcacccccaagaatcaactttgctgatgaaatatgttaatcattcctaagtttgaggaacatgtaaaactctgaaatcaaatgtgtatctggaactaggggttaaggaaaaataaaggtactcagtcagcttaggaaatgctttcttccctgtgcccaatctgcaaaaacaaacaaacaaacaaacaaacaaaaaaacaggcagaaccaggtacaacaaaatcatacatgtagatgggaaattatcttccaatcctttcatgctccactcaaatggtcaatttatactcttgagcatagcctcctctctaagacaaatggagtaggtttggtttgtttgtttgtttacagatactggccttcagttaacaagtagacttgttggctgacttgaaggagatagttattatgtaactattgtctctgctcaaatggaaattatcctacaggggttaacagttcattagaaagaagaactgttaacaggttgagctcattaccagtgagcaaaaggaggtttgtattttcccaaaatgaccataacagaaaaacctgccagtacatctctggattgtccttcatcttcatgtctttcttaaggccaggtattgcaggctacttctattgatgctattccactttactttcggaagaacgaatgatctattcagagtttaacaatgccggcaaagtattgcactcgtcgatgcttgcagacctggagcagcgagcaggctaagccagactttcagactttatactaatctgacacatctaattgtgagcaatattttccatgggattgagattcctatcaatcttccccaagcagaccgaagttacttataagctaatgcaataatttctgtggtaccacataaatgttctttattttaaaaaatcagattctagtaactcttctaagtgaaattttctggccttgataccagctgcaacttaaccgcagaaactccaagatgcatgatgagcaaatgtgcgtgaatttgaagtgtttttgaatttgtactaaatttacatagatatttacatagaaatgactgataaaatgttgttcagggagggatgtacttattttcttccgacattatcactgtaaattaagattttgtaggcagtaatcttttaaattgagaatgagcaaaataaaattagaaatgaatgtttttgtttttttccccccaagacccctcagagtctgaatcagtctttcccaattgtgttcttttatggtagtttgttcttcaattttcacacttattaaatctattttatattaaaatcacatgcttatttctcccagtagtacttctaccactttgggcaaggacgtcttacttgtttttatattccttgcagtacagggtaggaacctaataaatattgattaaatttaacagtttattttcaatcactcaggaagggttaaaagtcaaatgtaaatcgttcttgaaattgtccattgatatactcaaggcttatgaagatacaaacctattttttatctgagtttcttaaccagaagtcaataggtaggatttttatgtttataaattcctgaaatgttatgcaaaatgtatgtatatgtttagatatgtgcatatttcttcagcaaaaatctatagactgtaatcaaatgaatctctctctattcaccctacctcaaaatattaggactcacttccctaggcagctttactcaactcctcaatttatcagagctgaaaaatagttgggaaaaatacaggctaacatctgcaatataatgtctccgattacagcctttcacccacacatgccaatcttattatttctgagctatgtctgcaaagaatacatttttgagagagagtacatttttaaccagcattctattcccagatttttatactctaaagaggccattgtatatttccagtactttgtgatttcatcgaacatgctttcaggctgctgtacccgcaaacatttcccttcagtagaaacaaataccgtctctctcaagccttctccacgcactccaagtcaacatccaaacactcaactcatcaaaggaattgctgcatctaagtgtcaggggaagatccctgaaagtaaactgaggctgagtcacctactagtgatttccaatccgtaccaccagaggaataagagacaaaaatacctgtgctgttactgctgcaaatactgggcagaagaaaaagaatggtcacttgaagcagttccatggtgcccgtagatggtgtcaatatcttctttctccagaagcaggcagggacaattccctcccagcctggcagggccttattagcaaatggaaaaggtgtagtgaatgtgaatagccactgcccattcctacttattttgggggctctgataaagaacgggaggaaatacacacactccc

SEQ ID NO: 1817 - DNA, 122754 bp, Homo sapiens; identical to SEQ ID NO: 1816

SEQ ID NO: 1818 - DNA, 167436 bp, Homo sapiens
gggctctgtgtatgaatgacaaggataccttcagccagctcattctggatgaatgaatgattacactaagtgtcctccacattcctctgtgggtaagtttgaggcacttgtatatctcaaaggctttaaaagtatatgtcagtctgtatttctttgcttaatcaccacattctcacgtagctctgttaattgcactttgtatgagaagttgagtggggaaagccaaagcaggtttgctgaatgctgataattgaggttcctgcaagcaacagggctccagagctcagtagattattacaaaagcactttaattagatatgctggatggtccactcagtgtggaaaacgggtatgccaggcctctctgggaccttaggtggagaggatgcagcctgggcagctttagtttccgtccttttatgtgccacatactgatagagcacacacttaaactccagaccaaataggacctcctgcttgagaacgcagagagcatataatttctaattggagttgtaagatcaggtaagctcaggggacggggattttaggaagccactgaggaaaggtcagattccaactgtgaccttaaggctgtttcattccgactgaggtgttttactgattggatgtgttggtgtcgcaggttaagtactaaagcaggaaagctgaacagttccccagcggcgtttgaaatggtggcaggtagttccctggactgtttgccgtgtctggagttcgtgcgtgcttagctgaagcacgctcagatgaacataaccttcccaggcataaccttctgctgtttgatttagattgccccagcttttcttggctgattgcttcatgctttttgggtttcagctcaaagtactccctctgaaggacgctgaccacccaatctaaaggacgcccagccactgctaccacgccacgctctcttagttgcctgcaaagtccttgtccctcactgatcgttttctccttgcatatttatgtatcggcttgttgtctgtctccgccttccttagagcagaagctccacaagggcaggaaccttctctgcctggttcctcacctgtctccagagcccacaacagcatctgttgcacagcagatatgttttgtctgaatgtatgagttgaacggttaaatgaggctcattgtgtaaattgctcaatgtcacatggtgagatacttattcacactggaggatatttaaaaggtttgtctgtttaaacatttttttgaaatgtgaattcctccctcacattatgatcaaatttaacattagattagatgcaaacaggaagttatctaatatctctgggtttatttataaatataatacatattaaagctagaaattttgatcctaattttggtaagctttgtttgtgttgacctttttcttttttttatcatctacattggaatatccaaaagtagtatctaattagccttggagaggtgtttgtgctttaacgatgttcaaaactactgctgaaatacactatttggaaagcctaaggtctacagttatttagagtcagactgcctgagttctttgaatcctgtctctgacattttcttgctagtgacctggagtaggttattattgctatttttttgagacagcgacgcgctctgttgcccaggctggaatgcagtgacgtgatcttggctcactgcaacctcgaccacccgggatcaagcagtcctcccacctcagcctcctgagtagctgggaccacaggcccacaccactgggcccggctagttttttttataatttgtagagacgaggtcttgctatgttgctcaggctggtctcaatctcctggcctcaagtgatccgcctgcctcagcctcccaaagtgctgggattacaggcgtaatcccacccaggatcaagcagtcctcccacctcagcctcctgagtagctgggaccataggcccgcaccactgggcctggctaattttttaataatttgtagaggcgaggtcttgctatgttgctcaggctggtctcaatctcctgggctcaagtgatccgcccgtctcagcctcccaaagtgctgggattacaggcatgagccaccatgcaagctgggtaagttattaacctcttgatgcttcactttcttcttatgtaaaatggggataataaaattttccttgaagaatgattatgattaagtatgtgagtataggggttatataaatttctgctgttttatttagtatatactcagatttttatatattcaatatacaaattaggtttaaaaataatatatttgctcatgcctgtaatcccagcactttgggaggctgaggcaggcggatcacctgaggtcgggagttcaagaccagtctgaccaacatggagaaaccccgtctctactaaaaatacaaaattagccaggcttggtagtgcatgtctgtaatcccagctacttgggaggctgaggcaggagaatcacttgaacctgggaggcagaggttgtggtgagccaagatcgcaccattgcactccagcctgggcaacaagaatgaaactctgtctcaaaaaaataaattttatatttatatatttgggtagtggtcattaaatggtaacacaagtttgaaatttgttttgtttgcatggagaatttgttttgcattgaaaacagcagtccattcatgagatcaccagaaagaatagacttgcttataataagttatacttctaataagtaacagtgacaataaaactgtttgcaaacatgccattttctgtgtgtataacaatatagttgtctttttggtatcagacagacctggtttgagttttccagttgtgcttgttttgtggccttcagtaaattgctaaactttgcttggcctcagtttcctcatctgtaaaataatgataataatacagttcaaagaggattgctgtgagaattaaatatgaaaatgtatgtcacactcctggcatggtgcctacctcacagtgtaggtgcttaataatcctgagtgtccttctgtccctttctccagaccgtagatggaagatgcacgttgatagcaagaggaaggtgattgccattggggaaggtgtggaaagggcgtcctgtacatgatgatgaagggagtgggcttagcttagcaagtggtaagcttagcagggaacccaattccgaccttgaagtgtctgagcagatgtcatgtgtaaggggaagcagggatgctgtgtctgatctgcccctgcaggaagcactaggaccggcaggtatcagtagtgaaaggccactttgggtttcacgtgaggaagactttcctatagagctgtggaaagatgagatggtgcctctttgcaatagtgagcgtctcagggccggatgtggtgtctgacgactggttggctgcagatcaagagctctgtagagaggattcctccaagcaccaggaaggcagactacatggcctctgcggcccttttcaatgcttgtatgtcagtggccccctttctaaattcatgcctgattatctgctttcctaggccaagttggttgtatgcccccagaaacctaggatttagccttctgaagtcagggagttgggactgcttattgttttaatttaaaatgttttttaggattgacaatttttgtgtttgtattttgtcatttgcagcagaggctgcaaactggtgagttttgggctggttctgggctgtggataacctttgtttggcctagaaaatgtgatcaggggatcactgtgttaactaaatttaaattgattgcctgcgtttaaaaactaagaattttacaaaaaagccaaatttttagtgtttcttcaaaatgtgggattatctggcaacattgggttctaccttctcagctggcagtggatagctgaagctgtgtagatggtggccttttggttgggtcatgcgtcagctggtttgccacagtccccaccactccacacagtcttcccatcatcaaatgtcagttgtcatttttcatttacttaagttgttttcttttagtagaattaggagaaaactgaaacagttattttttcaatgtccatagtagtaatggaaaaactaaagatattttcatagtttcaaacttcaagaaaaaaatagaagagggtatattttggatgtatgccgaagtatacttgtagaagtctaacttgcaaacaagtggtttctgtgtctttagactgcatgactcagtcaggcctgcttcactcagactttttttttttttttttttttttgagacagggtctcactgttacccaggctggggtgcagtggcgctatctcagctcactgcagcttcaaactcctggacccaagcaatctgcccacctcagcctcctgagcagctgggattataggcatgtcccaccatacctggctatatctatggtttttttttttttgtttttttgtttttttgtttttttttgtagagatgaggtttcactatgttgcccaggctggtcttgaattcctgagctcaagtgatccgcccgcgtcagcctcccaaagtgctgggattacaggcatgagccaccgtgcctggcttcgctcatatatttaaatagctctgaaggtatctgagtgtgacccctaatctggacagttaaattttccctctgtcttcagatgtgactcatttcctccctctttttcagttctccatggtcatggagaaggagttgcctggcagcatatcttttttgccttccctaacatccactgtggcctcctggcttggtgaaatggggacagtgtgtaatttgcacacgtctgtgatctatggaactaagttccattctgctttttccagtggatccccaatcctccctagacttcatggccccaaacagatggagcctgtaacctcgttgactctgagtgatataaccgagggagtgggctcaatgcctattaaggcacagattgaagttttaggactctgttctttgtgcattttgatgtttagtacgaacagaatctggctttgttttgctttacaagagtgattctggcttcattgtgaagaacttggctggagagagagcagggaagatccgtggtaattaacttcagttttttgtagggtggttgggtggaagagaggagtaggatgtgtgttgataatgatggaaagactgattagtggaatttttagaatgactgatttaaagttgctggaaggagttctcatctatcaactggttatttactgatggaatgtgccccctaacagatctgtgaactttccgtcactcaatgtatttaggtaaatgagagtggccccatctgtcaggatgctgtaggagattcctaaattagagggaaggttgggctagatagatgacctctctggtctctttggaactcaaattcaattattctctgaattaaacttattaggaatcttccagcttgaacaattttacttcagtccataaagagaaaatattatgagttgactgagaggctgaatataacattataactttaactacaattagatctgggcagattacttgcactttctccaatgttccaatataaccttcaaaaatgttgtaaacagatgtacccagtagctagtatttataagccgggattttacaagcatatttcctgaaggattttttttctaccaaaaactttgttttaccttagccaaaactcattgtgtaggtttctttttgggtagcgtaataatacagatgttatcatttacataaaagtattatccgttactctttgtaaagcattttatttaatttcaaaacttaggattttgtacattatcattcattgctgtttgttaaggtgtatttaatttggatataatgacctacagaaaaaggtcactttaaagaaaaactttttaaaaatgatttttaaatgatgcataatcgatgtacatagttctggggtatgaatggtaattcagcacgttcatataatttgtaaagatcaaatcagtgtaattgggatgcccattaccttaaatatttgtgttttcttcatgttagaaacattagaactattcttttatagcttgtttggaacttataatacattattgtaaactagagtcactctactgatctaacactaggttttatttcttctatcaaacagtatatttgaacccattaatcaacctgtcttcatccattccttcctacccttcccagcctctggcaaccaccaatctactctctactttcattagacttactttttttcttttttttatctcccacatgtaagtgagaacatgtgatatttgtctttctgtgcttggcttatttcacttgatgacctccagtttcacccacattgctgcaaatgacaggatttcattctttttatggctgaataataatccattatgtatatataccacattttcttgacccattcatctcttgatgggtacttaggttgatatattttggcttttgtgaatagtgcagtaataaacatgggagtgcaaatacctctttgatatattggttttctttcttttggatctatacccactagtgggattgctggatcacatggtagttctatttttagttttttgaggaaactccaaaccgttctccatagtgattgtactaattcgcattccttcaaagagtgtacaagggtttccctttctctacatcctctctagcatctgtcattgcctgtcatttttataaaagccattttcactggggtgagatgatatctcattgtagttttgatttgcatttctctgatgattagtgatgctgagcattttttcatgtacctgttggccatttgtatgtcttcctttgagaaatatcagttcagatcttttgcccatttttaattgaattatttgttttttgctgttgagtagtttgagctctttatatatcatggttactaatcccttgtagataggtagtttgcagatattttctcccattttgtgggttgtctctttagtttgttgattgttcccttttctgtgcagagctttttatttttatttttttgaaacagggtcttcttctgtcaccctgactggagtgcattggtgcaatcacagctcactgcagcctcaaactcctgggctcaagccatcctcccatttcagtctcctgagtagctgggaatacaggcactcaccatcatagctagccactttttaaattttttgtagagagaggtcccgttctgttgcccaggctggcctcacacacctggcctcaagcgatcctcctgccttggccccccaaagtgctgggattacaggtgtgagccaccatgcctagcctgcaggagctttttagcttgatgtaattccatgtatcgatttctgcttttatgcctgtgcttttgaggtcttagacagaaaatcattgcccagaccaatgtcctgaagcatttcccaaatgttttcttctggccgtttcatattttcaggtcttagatttaagtctttaatccattttgacttgatttattgtgtatagtgagagatggagtctaattttattcttctgcctatagttaacagttttcccagcaccatttattgaagagactgtcctttccccattgtatattcttggtgcctttgtcaaagatgagttggttataaatgtgtgaatttttatctggattctctgttctgttctactggtgtatgtgtttttttgtttttctttctttcttaagccagtaccatgctcatttggttgttagagctttgcagtcaattttgaagtcaggtatagtttgatgcctccaactttgttcttattgatctatacctttggctattcagggtcttttgtggttttacataaagtttagaacaccttttttttcctatttttgtgaggaatgtcattggtattttgatagggattgcattgaatctgtaaattgctttgcgtagtattgccattttaacaatattaattcttccaagccgtgagcatggaatatctttccattttctaatgtgtcctctttggtttattttatcagtgtgttacagtttttatcgcatggatcttttacttctttggttaaattgcttcctagatattttacattcattgtagctattgtaaatgggattgcctacttgatttcattttcatattgttcgctgttggcatatatagatgctactgattttgtatgtttattttgtatcctgcaattttgctggattcatttatcagttccaacagtttttggtggagtctagatttttctaaatataaaaccatgtcatgtgtgaacaaaggctactttgaacaaaagggtaatttgacttcttcctttccaatttggatgctttttatttctttctctcgcctaattgccctggccaggatttccagtactatgttgaataaaagtggtaaaaatggaaaagaacaacttttatgaagaattagttttaaatccacatttttatgtcacaatatttgcactcttgtgaaagtaattaattggtcatttgatgatattattggggcttgcttgttatgtaagtaacacttggagtttataaatgtaccataaggccgggtgcagtggctcacgcctgtaatcccagcactttgggaggctgaggcgggctgatcacctcaggtcaggagtttgagaccagcctgaccaacacggagaaactccatctttactaaaaatacaaaattagtcgggcgtggtggcacatgcctgtaatcctagctacttgggaggctgaggcaggaggattgcttgaacccgggagtcagaggttgcggtgagccaagattgcgccactgcactccagcctgggcaacaagagcaaaactccatgtctctctttctctcatctatatgtgtatatatatatgtgtgtgtgtgtgtgtgtgtgtgtgtgtgtgtgtgtgtgtaataaaatatctcatttccaagataattgactgcattaaaatttatttgtgcatttaatgcctttgaaacacttagaaaaagtttatattagggaatttagatttgcaatggctttaaagcaatacataccatgctagtattgcgttttgaattttctcaaaattgactattgattttgaagacatcttcagtttgcttttaaaaatgttaaaaatttatcttgttcttcattttgttttcatttaatccgtagccattgagtaattaatgatggtgtggtataaggctcacaaacgtgatgcataataattgtgggagaggaaaattaccagaactttgaggcccagtaacattgcttcataacagtgttgtgaggtgatagcattgaagttattaacgctatggctaccagtgttttctgttcatttgtttgttatatttaggatttgtctgggtttatctgaatcagttaatatgcagtatagtcatgtatcacttgacaatggggaaagttctgagaaaagtgtaagatgatttcctcattgtgtgaacatcatagagtgtacttacatgaacctagatggtacagcctactacacacccaggctatatggcatagcctatgctcctaggctgcaaacctgtatggcatgtgactgtagtgaatactgtaggcagttgtaacacaatgggaagtatttgtgtatctaaacatctctaaatagagaaaaggtacagtaaaaatatggtatcataatcacgtggaaccaccgtatatgcagtctgtcgtcggctattacactgtgatgctgcacatgactgtattaagttttttaactgagactggtgggttctcttcatcagcatctgtgagatatgctgtcttttgactgcgtatgatcattatgagacaggcagagcagaagtttgggtcgtctgactttgtggctgtgagaccttgactcacagtagcaggtgctggcgcttctcccacagtgtggagcatagagcaggaggcaggagcaggtggccagctgccagcacggcggcactgcagtgttgccttgttgaagatgccggcttggaatatgaaatgctaacggagaatggtgggggatctttaagcagaaactctgtgaaaattttgcttgatgggcagtgatcgcatgtggagtggcttatttaaaataaaagggattgcttggcttctgacaacagagatgtagagtgcaacaaacactgttcttcctttcacatttaccaccactgccaccatcactgtcacctcccattcattaattcgttcattcatgcatgcagttacttaacatgtatttattgggtattcaccatgtgccaggcgcttcttaaagtcctggactttcaacagtaaacaatttaaacaaaatccctgccttcctgccttgtggaattaacattctaagaggcagaccttatgttaaacaatttacatctattgttttacatgatccttacaatagcttgggaggcagacaaaattatccccattttacagattaagaaactgagggttagagaaattaaatgatgtgtccagtgtcacatacgaaactgaggcgcagagaaattaaatgatgtgtccagtgtcatacagtgggatctgatgtcacgccagagggactctaaattgtgggccccgagttgttttgctagcctcttaggagcaatgtctgagcggccaatgaattgcacgtcagttgtacatttgcgtgggttttcagcatcacacgtgggaggtaaaccttcacaccacccctgttttagatatgaaggccagtcctacccgccctcactgtattctctgggcaaatttggaaacctttggttttagaaacagacttcctaaatttgggccttttgatcaaatggggagaaaaatcagctcccccggtaatgtttctgaggatctcaggattctcaggcagatacttggtgtgcctcattttcttctagtcttgccttcatctgggacatttttgctaccgcatttctcaaggtctgtgttccttcagcctacgttattcaaagtattgctttttcatcagaaacagtgtggggaagccctcttcagcacatgaatattgccgaggttttttgcccattaatgtaattacatccaaggtgcacatttacgtttgtgagggattatttaatcttttgtaatcctggttgggtaaaagtaatttatatttttaatctctacttatgattgttattcttttatttttacttttcttccttgactatagctaagcagtaaggagtggtgcttggtcagatgttctgtcagaagcattctgtgtttgacctgagaagtaaagaatatggaaggagtttttattgttttcttctttgaattctaagcagagaggttatttctgatagttcacattactttagaacatttatttatttatttatttagagacagagtcttgctctgttgcccaggctggagtacagtggtgcaatctcggctcactgcagcctctgcctctcgggttctcctgcctcagcctcccgagtagctgagactacaggtggacactgccacgcctggctattttttgtatttttttagtagagatgcggtttcaccatgttggctaggatggtcttgatctcctgacctcatgatctgcctgccttggcctcccaaagtgctgggattacaggcatgagcaaccgtgccggccttttttttttgagacacagtctcactttgtcgcccaggctggagtaagtgcagtggcactatcttagctcattgcaacctctgccatctgggttcaagtgattcttccacctcagcctcccaaatagctagggctacaggtgcgtgccaccatgcctggctaattttggggcagaaatggggtatcactgtgttggccaggctggtcttggactcctgacctcaagtggtctgcctgtcttggcctcccaaagtgctgggattacaggtgtgaatcactgcatctggcctagaacttatatttttaatgtcagtttttcttataattatttatagattagaacatgttatttacatttcttatttgtgataggcattatgattgtcaaccccactttatgatgaaggatatgggattcaggaagcctctaagttttgaagagatgaattgctagcccagatctactggttttgaagcctgagatgtttccactattcccttatttttattaataataatttgtcatgtgatagtggctctcaaacttttcattctgggggtgttccaatgccccatcttatcattttatattctccagctcttctctggataggaacagaaaccctcaagaatatatctttgcatgcatgtgtgcacatgcagtctaggatattcaggttttttattacagtcaggtttgcaacaatttttgcatagtttttgactaggtattagtaaaacatggtgttttttatggattaatttattgtgtgtgtgtgtgtgtgtgtgtgtgtgtgtgtgtgtgtgtgtatacatatattttcctcccaacattttattaagaaaatttgcaagaatatagaaaaatcaaaagaattgtatagtgaacacccataaacccaccacttgattctataattgttaatagcttgccatttttgcttttacatgggtcattttacattgtatccttcaaaatagaatacttcgtaagtggtaatttacatttttctcagagatctttgccaaggaatttaattttagatgcctgttaacacatatgtcctgttatattattatctcagaataaagcattagaaagatcaagtctagttttatgatttggaactctctggtttttgtaattttaggatggagaactaaattgacagtatacgactgtagttgggcagtctaaagaacttgagaaaccttacatagtttgaaaccccaagtgactttataaattcatagaactaaagtcatttgggtgacctcagtaataaaaaatgaaatcagacaatgcaaaaccatcggaaatatctgaggaatgttggagataattcatgtgtacaggaggttctggcagagaagggatctacatataaaatgtatcaaaaggtcagaattgttttaagaaaacctagaagcaggaattagtggccgggcgcggtagctcacgcctgtaatcctagcactttgggaggctgaggcgggtggatcacctgagatcaggagttcaagaccagcctggccaacatggtgaaaccctgtctcttctaaaaatacaaaaattagccgggtgtggtggtgcatgcctgtgatcccagctactcgggaggctgaggcaggagaatcacttgaacccaggaggcggaggttgcggtgagccgagatagcactattgcactccagcctgggcaacagagtgagactctgtctcaaaaaaaaaaaaaaaaaaaaaaggaattagagtaggggcatgcaaatatttccatgcaattaattgttcttctgatcttttttttgctctctgatacatatctctttaaatttccttctcctgcacaatttttcttccctttgtatcacagagtcccttttctgtcttaatgtggaaggctttcatttacactggctgttattttattttattttacctattttagtaacagaaatgaggctgctgggtctgaaggaagcagagctcatgatttaatagcattcattcttcttctgtatttacctcacacacacacacccccccccccacacccccacacacccccacacaccaaattaacattttgggaattcccgtgttttgtgttatgtgacttggcctccgtggcaacctctgacttcagtcccggggcttgtggttacttgggtggtacatccttgtgctgccgcctgttgctggccagctctgtgaccttttgcaagtcacttaaggtctctgtttctttatctgtaattccagagggttggactagggaattttgcaggtttatcccaccagcactaaaaattccctgttctgtgttcacattaacattttttctctcctccctgcgcttctcccctgaccccgccctgacttaaatgttttgtgctcaggctaatttttataactattacactgatggtcttcaataatggctcttattattggccaattaagattagaaagcatggccggcacggtgggtcacacctgtcatcccagcactttgggaggccaaggtgggcagatcatgaggtcaggagatcgagaccatcctggctaacacagtgaaaccccgtctctactaaaaatacaaaaaattagctgggcgtggtggcgggcgcttgtagtcccagctactagggaggctgaggcaggggaatcgcttgaacccgggaggcggaggttgccgtgagccgagatcgtgcctctgcactccagcctgggcaacagagagagactctgtctcaaaaaaaaaaaaaaattataaagcataccttcaagtgtataataacttcatgtggaaaaagattgtgtgtgtgcctatatgggtagatggatgtatgtgtatgtaaaatacagttttcatccagataaggaattaaaggcttatctgtctatggtagaggctggtctgtaatattaggtaaaaatctttctgttggatatgtagatcctttttcttttgagatagggtctcagtctgtcacccaggctggagtgcagtggtgcagtcatggctcactgcagccttgacctccccaggctcaatagatcctcccacctcagctcccaagtaactgggactactggcatgcactaccacacctggctaattttttgtatttttagtagagatggggtttcaccgtgttagccaggatggtctcaatctcctgtcttgctctgtctcccaggctgtagtgcagtggcacagtcttggctcactgcagcctctgcctcccgagttctcccacttcagcctcatgagtaggtgagactataggtgcatgccaccacgcccagctaatttttgtatttttagtagagacgaggtttcactgtgttggccaggctgatctcaaactcctggcttcaagtgatctgcccgcattggcctcccagaggctggaattatggcatgagccatcgcccctggccctggctaatttttttatttttactttttgtagagatagggtctccctatgttgtccagggtggtcttgaactcctgggctcaagtgatctgcccacatcagcctcccttgtagcttggaccacaggtgtgcactcccaggcttggctaatttttttttttttctgttagctaattgtttaatttttttctggtagagacagtctccctatgttgcccaggctggtctcctaggctcaagtgatcctcccacctcagcctcccaaagtgttggaatcacaggcatgagccaccgtgcccagcctttgttatttttaaaatgatgaaggtattaccttaaaaatctcttgccacatgtttgtccgggataatttgtgtattcacatacttagaatatgtacattttgaaaacctttgattaagtggttttcttctataaaatatgaaggtttgtgatcctgttctcctattcatcatcccgcctccacaataacataaaagatctgaaaatgctgctttatcttttgggtatttttatttattttattttattttattttattttattttatttttttgagagagagtctctatgtatcccaggctggagtgcagtggcgtgatctcggctcactgcaacctctgccccctgggttcaggcaattctcctgtctcagcctcctgagtagctgggattacaggcgtgtatcaccacacctggctaatttttgtagttttagtagagacagggtttcaccatattggtcaggctggttccgaactcctgacctcaggtgatctaccctcctcggcctcccaacgtgctgggattataggcgtaagtcaccatgcccagcctttttggggtatttttaaaatgtaaggtctttcatcaaaggatatagcaagaccccaaaacactctgaacctctgctgtatataacttttatttaagataatttaatggttcatttttaataaaaaagcaccacgttggggtaacaaggacttccaatgtacaagactgtagttcagccaacttaaaaatgaaagaactctagcaaggaacacaagtaagtttatacccgatattttgcaaatcatgatattatttttaagggcctctcttgaggcagggtttttatgatcataacattccagctgtggttttggaggcagaatgtttactactgctctaaatgcaaggatggtaggtgtgtattcttactgctaaagggcttaaaaaagaagctgaggctcccttcaagtgagtaaacctttattcggctgacttgggagccgtgttcctatggaacttcggtggtaattatggaatgcaggcccaacaacagcccagtcatgggcgagcctggcctctccgaggcatgatggcaggctgtcccggctaatggcttcaggcagcccatggaaaaccactttctggttaagtctgcatcatactgttccaccaatggaaaaaattgaacatgatgagggtgtgtagctagcagacaaaaatatatccagcattgcacaggatctgtttttagctctcaacggctgagcatttgaagtgttagacactgtttcctggcttaccatgagcagaaggaagagtgagtttgtggatgtgtatatagactctagctttgtgaaacttttcttattaacgaacagaccccgagaaatactggctacatccaaagttctggcaaaggtaaggttataaatgtttacttcccctcttctggagttgagacgtaattttacatgtgagataaaaatgtttctcaaaatgctcccaccggcaatatataagtgctgacttatttttgtctgacattattttgtacttaggcagcacacgttgctgtgcataagggaattgttgcctttaaattggagtgtctgtgtgctttcaaacacctattggtgatttattgcagttgcctgcgccgttttactaattaactctccaaaatttgtacgtattgtatggatttatttttcctgatggtctcaagaaagtaccacttctcagtgtgatcatgttaaagcattgatgactattactttaccagttaattttttcagagtagaaagggaaattaagatgtggcagagattgtattttgcagtttttgggttattatatcatctcatcagggcttaatttttagctgagtgggctatttggcttaagagtttcttttcaaacttgtaatttgactttcgctgtttagtatcgtttgtctttttgtcttaaactttatgaaaaagaaatggaatcccttgtaatcttgggaggggggtacttgtttaagaggagtgattgattcatattctagtccattagaggctgctcattcattagggtatttgaaacaccagaagcacaagtactgctgaacgtctggtgtgtgctcatcagcaggggccgaggagccctggctttggtgtagttcttccttggctttacattaatttggccaagcatgtaattcgcagaaaattggtaggtggagagacagaaatagggagctttattgaagtcattgtaacttacaggattatttatagaatttctggaaagtaagggtacgggtgaacagctgctggagtttttcctaacaggtttaaacattttgttgtggccttttgtcacacttagggattctaaaattttatactttcagcattatgaggttatgaattattttcaggcaggctacgtgggttcgttttcagctgtgctgggtcagggctgtcatctccatcggtgtattgggcatcccccatgtgttcacttcctttacagacacgtctttagggatggaggaatgtgagtgtggttcaggcaggttacagttcatagaaagattggtcatattttattgatgacttttccttttcatctaaaaaatgcggctctgacagagccagcaagcactgagagcaggaacagtgcactgaccgccgccttctccggtcacattaacacttgtcacctactttgatttttgccagagcttgtggacagaaagtgaagtccattgaagaacttaatgactcaaattcatactgaccagaccgtaaatagtgttttgaatgcaaatagataacaccttttttcaatactttagtgcagagggagtgactttccaaagccctctcattagatcaggcctgcaggaaggatgcctggaagtgcgagataagcgttaggctccttgtgaagagattagttttccagtgggtaagtgggtccttcacttacccattaagtaaaacagatgattctgtcttggtggtctgagattgtgtttgagcagagccatgctttcttttgcaaaattagttaagggtctttgcagcttcttcccaccagaagtattgaataaaaaaccacaaagcgtaaatatctgatggggcactttactatatgtgtatgtgcctctaggtttgactcactttgtaagattcccttatgtgattataataaatcaggttagtgagatcccttagttcaactttttcttttttgttttttgttttgaaacagagtctcactctgtcgcccaggctggagtgcaatggcgcgatctcagctcactgcaagctccgcctcctgggttcacaccattctcctgcctcagcctcccgagtagctgggactacaggcgcccaccaccacacccggctaatttttttgtatttttggtagagatggggtttcaccgtgttagccaggatggtcttgatctcctgacgtcatgatccgcccgcctcggcctcccaaagtgctgggattacaggtgtgagccactgcacccggccttcagcttttagatttagaaaaatacaggccgtgaagaacaaggtctatttggacattttttaaaggaataatttgcatcttttttgttttgaaattaagtgtgccttctacatgaaggtaataacagctttactagaagggctagaaaaaagataaaggtatggaatagaaagaaatagcagcagtattaaaaacagtaaaaagtaataataatggtagtagataaacctgaatgtctgactgttgaattctattaacagggtggaatgtctttttattactcagttctacttaaaacaggcttacaaatatcaggaggcttcaacatcagtgtctcaggaaacatattgaacactcatttttcaggtctttatagtccatagtattgtagagatagaacgttagagctgaaaatggaccttaggcagtttttcaaaggagacaattgaagaaccacagaactgaagcgacttgtccgaagccacagagatggttagttacccagctggaaggaaattccaggtatcctgttagtctttttcttactctacctgttccttaattgaggaaactttggcacatcctgatgtatcttagataattgatagagacttgtgtatgcatacacatgtgtgcaaatatatacagacaaatgcacagactttttttttttttttttttttaagacagagtctcactcttttacccaggctggagtgcagtggtgtaatctcggctcactgcaacctccacctctgggttcaagggactctcctgcctcagcctccctagtagctgggattacaggcaactgccactacgcccggctaatttttttttgtatttttagtagagacggggtttcaccatgttggccaggctggtcttgaactcctgatctcaagtgatccgcccgccttgaactcccaaagtgttaggattacaggcatgagccaccacgtccagccgacatgcacatacatttcctttcctccctttgtccatccttccttcttcctttcctctttcttttctttttttttttgttgttctttctttcatctatttacttacctgtttaccaaacgtgtttggtaacctgtgtgttggtttggtttacctgtctgtttaaagctctagtagagaaaagggcttttgcttttcccatagcctagtcaaattcaaagctgtacattcaatctgtgaccatcagctctctgactgttgccagagagaattttaggtgcacacatgttaccctaacctatgtgataagacaggtttgattagacttcatctgtcagtctcttcctggttcagtcttagattggttttctttggtttatagtcacattccaatagaagactgtttaggttttgttacttctgtgccttacaaaaaagaagccctggaagggaacagaaacacagcagatgaggcctggctttagtgccaaggtgatgtaaggcacttttggaaaagtaaagtttacacaaaaagtgataggccaagttatcatttacacttaaggaaagggatgcagtgggctccacagataatgtcaggatgaagttgattcagggtgttcctaggacttgaataaaggttcaaaaatcctgggtattgttcaagcactggaaagtgagaataatccttatcctgcctttgtgcttgaccctgacccatctctatagtcgcagaattgctagagtcggatttctaaaatggagatgtggggaagggctaaggagagacagagtttgcaagcttttaaagacaaaagctagaatccatatgattaaaggcaatgagaagaaaccaagtggagagaataaagacaggctctttttcgagttacccttggccacccctggaaggtggaaaaaggcatcttaaagataaatgaaaggaagctttatacacagacacagtagtgaaccgaggaaactcatgacattaggaggcactggagagtaaagcgcttcatggaaagtgtccatatattcttggaatacacacacacacacacacacacacacacacacacacacactctccgttgaaaattgataggatgatcacaaatgtatccaaacagccagacaagttaactataaaacaacaacaataacaagccccctgaaataacaggaaactaacaataaccatcacttacctttttaagaaatgtcacagtgggaaaaaaatagaaattacaagacaacacagtgacatgcaggtaatgaaggagtttctcactggagctcttgtatcctgacaccctactgcatgtatgtgatgttggtgcctctcaaacgtttctgaagtttctgtgataggaggggcagttgctctagagccacctcctcttgtgcgtgcaattcctctccctttgacccattctaggacattttaggaatggcccctctctctgcaccacatcacattttccctttaattctcattgcgtgctggaatttttcctgaagatacacacatagacaataaatgaagctctttttgatccctctgtccttcccgctagcaactgattcctctctgctcccctttatagtaaaactctttgaatgagctgtccctattcactcccttcagtttcactgaccttatcctcaaactcaatccagtcggtctttctccaccccattctgcccttgtcctgttcacagggacctgcataatgccagatctactaaatgcactgcttgttctaggtttttgttatttgaatcagaaacatttgacatggttgctcagtcttctccctgaagtgcttttcccaattggctttaggtgccacatactctcttggtttcctcttttttttttttttttttgagatggagtcttgctctgttgcccaggctggactgcagtgatgcgatctcggctcactgcaacctccgcctcccaggttcaagtgattctcctgcctcagcctcccaagcagctgggattacaggcatgcgccaccaagcccggctaatttttgtaattttttttagtagagacggggtttcgttggccaggctggtctcgaactcctgacctcaggtgatctgcccgcctcagcctcccaaagtgctgggattacaggtgtgagccaccaccgtgccaggtctcttggttcctcttaattcagttcaccaactgccccttctgtctccattatgggcttctcctcatttccttgaccccttaatgtcaaggtgccccagggcctccttggaccccatgtctttcctttgtttacttatggagaacccatccagtttgtgttttaaataccatctttgtgtgggtgagcagcccacttctctcctgaactccagactggtattaccacttaagtatccagtggacacctcaaacccagcttgtccaaaactgaactcctcatcttgcccgcggaagcctgctctgctctgccgtctgcattctcccatggctttaatggaacagtgtggaatcatccttggtgtcactcacacttgcttccacctgccctcgagtcctgctggctctcccttcggccctccagagcttcagctgtgtccggaggcagcctcctcccctaccacccccctcccttaccacccccacccaagctggggcgcattgcctctcccctgcatcgttccggtagcctagcaggtccccctgctgcttccactgtgtcgctgacaatccatatccacacagcagctacacagatccttttaaaatgtcccatgatgagccttctctatcacaccctctaattatgactttttttctcaaggtgaaagccaaagtccttaaactgtccctcaaggctgccttcactggctctgtggcccctctctgacctctcttgcccttcttcccctcgcttgctctgctgcggccatgctggtccctgcctctccggcacttgcactttctgttgcccctgcccacggtgccctttccctgaaatacacttggtgtctcctccttgcaagtctctgctgaagtgtcaccattcagagaggcttcctcgccttttaaaaattgcagcatccttcccctctccacgttgcctcctcccccatttccttctttactattttgtcaaagtgcttatcacctcctaaaagaaaatttatttttcggccaggcgtggtggctcatgcctataatcttagcactttgggaggctgaggccggcagatcacttgaggtcaggagttcgagaccagcctggccaacactgtgaaaccccatctctacttaaaaaaatacaaaaattagctgggcgttatggtgggctcctgtagtgccagctacttgggaggctgcggcaggagaatcacatgaacccaggaggtggaggttgtagtgagccgagatcatgccactgcaagccagcctgggcaacaaagcaagactccgtcttaaaaaaatttattttcgttgtttattgttcatctctctccactttagtataagctccatgagagcagggatacttctttggatgggggtctgttttgtttattgctgtatccccagggcttagaactgtctagcaaagagttgttattcagtgaacatttattgccttaatcagtgaaaatgtatcctccctgggaagcctgatgatgtagcagaagcaaactaatgtaaatgctaaatatcgttgaactcctatactttatcttaaaaatgtaaattttatactttactttatatatatatatatatatatatttttttttttttctttttttttttttttttttttgaaatggagtcttgctgtgtcacccaggctggagtgcagtggtgccttctcagctcactgcaacctctgcctctcaggttcaagtgattcttgtgcctcaggctcctgagtagctgggattacagaggcgtgccaccacacccagctaatatttgtatttttttgtagagatggggtttcactgtgttggccaggctggtctcaaattcctaatctcaagtgatcctcctgcctcagcctcccaaagtgttgggattacaggcgtgagccaccgtgccctgccatgatacatatttctttattatggacataatatttaaattacttagcattaaatgaaatcagagcttcaggaagatgccccttggttattctgtggccttgagtgtctcctctgctctccctttgtcttggtggccatgccccacccccacagccatttggaggcatactctaagttataattattattgaagacaattaccatgaagcttaaagtatcaagaaaacaaaattctcatttgcataatgttctttataaggcagtagactgggataactaaattttaaccataaagctccttgggtaacttagaagtttagtttttcattttattcttacctcttcatccccagccacggaaacctttgttacctggagaaaaaaaatacccttagagaaggatgtttaagatgtttgatttgtgaaaggggcatggattgatcagaaccacaaccaccctttatttatttaaatttaattttaatttttttgagatggagtctcgctttgtcacccaggctggagtgcagtggcgtgatctcatctcactacaacctccgccttccaggttcacgcaattctcctgtctcagcctcccaagtagctgggactacaggtgcccgccaccactcctggctaatttttgtatctttggtagagatggggtttcaccatgttggccaggctggtctcaaactcctgacctcaggtgatccacctgcctcggactcccaaattgctgggattacaggcgtgagccactgggcctggccaaaccactcttttgaaagggaatcctgaaagttaaattgtactaaaaaaaaaaaaaaaaggaataatttcagattaagaagtacaaaataatttaaaattattattttattttttaaagagacaacatcttactgtattgcccaggctggtctcaaactcctgggctcaagggatcctcccatcttggcctcccaaagtgctccgaatacaggcatgagccactgcattaaaatggcctggtgtggtggctcacacttataatcccagcgctttgggaggccaaggcaggaggattcaactccttgagcccaggagttgaaaatcagcctgggcaacatagtgagaccctgtctttacaaacaataaaataaaaaaattagcaggcatggtggtgcaagcctatagtcccagctacttgggaggctgagacaggaggctcacttgagccctggcatttgaggttacagtgagccgtgatcacaccactgtactccagcctgcgtgatagagcaagaccctggcaataagttgatcaatcaatcgatgttaaaaaatgatcgaaaatatccaggtttgattcctacctttgcctcattattcatcccctggaggctgaagttattttctgtaaaacagggatgattatgcaacctatgaggattcttgtgcctggggtatcccggcacacagcagcattaagaaaggattggtcaggcgtggtggctcacgcctgtaatctatgggaggccgaggtgggcggctcacctgagatcaggagtttgagaccagcctggccaacatggtgaaaccctatctctactacaaatacaaaaattagctggatgtaacggtgtgtgcctgtaatcccagaggctaaggcctgagacttgcttgaacctggcaggcagaggttgcagtgagctgagatcgcaccagtgcactccagcctgggtgacagagagagactgccatctcagaaaaaaagaatggattaggcccttccccctccatccgtgtttcatctactttggatatgaaaaaatgttaaatttctataaattagcaaatttaaactataccaactagtatatatatgttgttttttttcctgaaagtttctataaagttgttagctaaaatcttatcaggtttgttgtgaatactcatatgaattaaggaaaatttcagcaatgattggttaatttacctgcagccctcagggagaatctacattgtagcctgaagacatacatttctaaaaatgactctcaaacaaggcaaaaacccttgttgaagtagaatagttacacattttatgaaggtggggaaagcacccatttagatgaggggaaaaaaatatgtggtttaagccccgttcattttttaacttaaatgaaacagtgcataatgaagaaatgttttgccaagaataacttggtacaatgaccgtggtagattttggttacagaatgtgattggggtttaggaggacggtatctgcttctgatgtactgaagctcgggccttttacatccatgcaggtttccatagtcagcaagaagctgtgtggttgcagtctgagattccagcgcatgatgctgtttaagttttgatgtaaaccttgggaagtgcttacccaggcctaagcttgctctttgtggagtggctcaagctcagaaaggttaaaaacggaggttatttaaaagtcacactcacaattttgaatcccatgtttataaaagttataaaagagggccatttaaaagacatgctaacagctttaggtcttttgaatctttgttctggtagtcaccagaacaggaccacgaagtttatagaggccaggatgttggacaagttttagctgagacttgaagtagacgggggagaaagggcagagtgggactgaacatttgatatatttaaaaaaaaaaaatacatgtttcaaagagccgtggtgagaatgtgtaaaatgcctttgaataatttctaaaagaaaaataaggaaaatatttcgtcttatccaggattattttagacaatattgattctgtaatttaaaaaattaaaaaacaaaatttttattgggcagcccctgagccagaataggttcagagaagctccttgattttgtaattttgcttgaaagtgtgtgtgtgtttaaattccctgaaatattttcagtttctgcaatggctcacatatagccgggccactgaatttacttgacattccaaaaacataccagtaatatttgtgggattgccggtttcaccatctctctcataaacttgatgctgttaaagttgtcatattctctctcttccccctgtagacggagtcatgctttgtcgcccaggctggaatgcagtggcgccatctcggctcgctgcaacctccgcctcctgggctcaagcaattctcctgtctcagcctcccgagtagctggaactacagtcgtgtgccaccacgcctgactaatttttgtatttatagtaaaggcggggtttcaccatgttgatcgggctggtctcgaactcctgacctcaggtgatccacccacctcggccttccaaagtgctgggattacaggcacgagccactgtgcctggcctttcatattctctcttactgattctccacatgtttcatggtttataatctctctccctccaggcacaagctgatgagctcctttgggaagggatggtgtcatctctcacacttctgtccctcatggtgtccagcacagtgctccgtgtataggagagtctccaaacattcatgtcgaattgttgagtggaactttaaaatttcacttcatttccccaagtttctgccaatactttgaacattttcttcctgggccaacactgcctcccacactgacgctgagctgttggctactgtggactcctttcccagagggtgttccaaagtgtcctgaggttgatggtcgtgccgtggtgtttctgggaacagtgggtaggggagggtgtaaggggatgggcaggggcctgtccaagattcccttagcttcccctccctcagcctgccttttccctcttacctcctcctctctccaaactttgtccctgaccctggtgcttgggacctgcacccccttcacacctttccctgaaggagctggggtctttctccatgtattctcttgtggattcggtccttcagggatccagcaagtggttatggagcaccgtgtctttgaacaagccattttctgttccctggaattcctttctttcctttcctttatttttcttttttctttttctttttctttttctttttttttttttttgagacggagtcttgctctgttgcccaggatggagtgcagtggcgtgatcttgactcaccgcaacctttgcctcctggattcaagtgtttctcctgtctcagcctcccaagtagctggaattacaggcgcccgccaccacacccagctaatttttgtatttttttagtggagaaggggtttcaccgtgttggccaggctggtctcaaactcctgacctcaggtgatctgcctgccttggcctctcagtgtgttgcgattacaggcgtgagccaccgcgcacggccttctctttcctttcttcatctaatggaatcctactcatcctccaagacccacttgttgggttatcttccttattgggttgttcctaactttcctaccaagaagttgaatgtccagtgaatgtgtgtgcttttttttttaatttgtgcagtgcaaaaggatgaagcccatggacctaatctgtggtgtccagattgcacattaatgatgggccatctttaaaaaaaaaaaaaatcttgtacttactgtctgtatctgaagtgtttgccttggacaatgacttcccttcccttccattcctttccctttcttttttttttttgacggagtcttgctctgttgctcaggctggagtgcagtggcgcgatctcggctcactacaacctccgcctcctgggtttaagagattctcctgctccagcctcccgagtagctgggattacaggtgcctgccaccacgcccggctaatttttgtatttttagtagagacagggtttcactgtgttggccaggctggtctcagactcctgacttcatgtgatccaccagcctcggcctcccaaagtcctgggattacaggcgtgagccactgcacctggccctgactcttcttttcttttttttttgagtgagaatctcttcttcactcaggctggagcgcagtgatgcaatctccactcactgtaacctctgcctcccaggttcaagtgattctcatgcctcagcctctcgaatagctgggattacaggcatgagccactgtgaccggctaatttttgtatttttggtagagatgggtatcaccatgttggccaggctggtctcaaactcctgtcctcaagtgatctgcctgccttggccttccaaaatgttgggattacaggcgtgagccaccacgtccagccaacaatgacttttcgaatgttttgggactcgtcggagcttggctctccttggattttcttagagtggatgtaccattctggcaaaactacctcttgtggttttataagtcagtttttaaaacatttcttttttaatcgtgactcaagaagacataattttacttcacaacccagtatatggacaaacacacaagcacacacaagaatttagtttcatgaaacaaattttactcttactgggattcactcgtctattttccgttctgctagtctctcttctgctctattttgttctcttgtattcatttaaaaatactggtatcaattcatcgaatggatttcataacccaacaatgggccacgacccacggcttgatcagccttctgtaagccatgctgcagatgttgggatgttttctaaaacaggtgtgagtgtggagatcctccttgtgataaattgacttactaaggtgatgaactggacaaaaagctgagctattgtctctgtggaatttatgactttcccgcttgttgaataccagccatgcttgtcagcggagatcctgctcggagggcattccttgccgcagatgggtctatccattcatctgttaatatgcatttggaaggagtcccgctgaattcaaagacgaccagtgaggcccaacaatgaaagcttagcttctgaggcccttcacagcagcttgctttctgctcactttttttgtaaggattactcttcctaagcattattcctatggggaccagatgttccttttgcctgcctctttatataaattgggttcaagtcttcttgtgattagaaatgagctccttcaagtcttggtattcaattcatgcattctgagtgtagttcattgactcaggatgagagaaacagattctggcagtatttacagagtttattagtaagtttggatccctggtagaggtgaatgcttttgttttagatttttaggcacatttgtcctgagttttaatattttcagtgatagagacaataataaaacttcagggcaggatttctcagctttggaactactgacatattaggccagataattaattatttgttgtggcgaactgtcctgtatgttgtacggggttcagtagtatccccctagccttaacccactaggtgacagtagcagaccccagttgtgacaaccaaaaatattcccagacatgccaaatgtcccttgggggacaaaatcactgtagttgagaatgactgctttaaggttgtaccagttcaatgcgcattcaggttattttcttacatttcctaacgtgagttatctactaatgagagtgtatggcttgtgtcactggttttctttacatttgatagactgcttgcaaattaggtagttttatatgctgtaataatttggaggaattgatcaaaatgaaatgctaaaacctagaagattctaaatttatctatatataatatttaatttaataatagataatgaaagatctgaaatgacagttttaataagatctaatatcataatatacaaaatcagacttaaagctaaaatttaataatactttgtgttgcattattgaataatgagtaggtaatgacagacctgaaacagcagttattatgagatctgatatcataacatacaaaattagacttataactacaaattaataatagtactctgttgcatttcccagtattttagatggtttcacatatgtttccacacttgattctcagtctgtgaggtagtagtgcagatatttttatcctcaagttgcaaatgaggaaaaagaaattcagaaagcttgagcagtttgcccaaagtctcacatgctgtttgagagacagaagcagggcttaacccgagttcgctgacacaaaccagactagaatttacggagactcctctccttagtggttaaagctgtccccgaccctccccaaataaagaaaaccaagtagatattgctatggttaatgatggctagcccttttgttatctggctcttgtcactatctgaagtatttgcctgggactaggatgagggtcctagtttagtataagaatctctctggagcgacgtgaagcctgttggtatctcctggtagtagcacttgcgcttcctctcacggtcttggccagctgtagatctccttttttgcagtggctccgttctgtttgctgtccccgatccagcccccgccctcctcgcaggcctctgctcagcaccatctgcccacccggagggtttcctcctattccccttcagttgctccatctgggcagccagctcagggcctcagtccagagacaaagcagaggcagacgattctagttttctttgctgtaaatgccacactacatggaactagagaatttgggaatctgactcatccaatcaagcccaggctaaaggcaaatgaagaaaaggtaaatctcgaatttcctcctgaaagctgtttttccccgggactcagtagatgacagtggctgttgggattgtgatggcatacttaggacattcctccacattgctgcacgcttctggagtggttactgatcacacttttaagaaagaaaaacttccactcttggtaattttagcttaaaaagctacagagcatactcatgtgaatggggactgggagggaatgcagaatggaaggtaggattttggggattgggagggaatggagaatggaaggtaggattttggggattgggagggaatgcagaatggaaggtaggattttggggattaggagggaatggagaatggaaggcaggattttggggattgggaaggaatggagaatggaaggtaggattttggggattgggagggaatggagaatggatggtaggattttttttttttgttctaggtccatgtcattgtgataagttttttaaaattccaatatttattataattgtcccgtaaataaaaaataattataaaaaagtttgtacacagcataaaatgtttgctaactatacacattcttggtgccacattattccagagtgacttcacttaaattacgtctctaccagccctgggcctcgccacacgttattatacttcatatctcttcctgcaggttagaaaaccttcacaggggttgctgcgggtgactgtacgtatacatacttttgctatttgtaaacaccaggcccttttaaagtacttttttttttttttgaagagtttacatgaatgaaatctgttgttttttaaatttttttcagccccctttctattaactaaaatagtttttaaacttgaatatcataaaattcctttagtaaaggagtcagggggccagaggttactgaacatttgccttaaatattcccttgcttccagacaaaaatcatagctgaagcatgacagaaaaatatctgttcaatttgtcaaattcctcagggacaataattacttagcttccctcagggagtatccttcctgtcaataaatttctcataaatattggataaattcttcctcctactgtttaaggctgtttttttttttcttccctgccaggattgacccaacattgcacatttggtcagcattatgcatatgtgaaaatgcactttgttctatatttctgtcactccctgtttgcttttctctatcttaattatggaaatgtatcctcgtgagttgatataccagtctttctgtcatacccagtaaggaggattcccgcccttggtctggggtccgcatcaactgtgtagcacatgaattgctgtcatttggtcccacaggtgtctattgagtgcttatatgagcctccaggtgctaggccttgagtgcacagcatccagtagaggatgggggtctcctgtgtttttagaaatatcccatgaaataaaaaaattaagctatttaattgcaaaagtagtaagatgagcttaggttctaacctgccgctggggcagaaacttccacctgggagtgattctgcggctttgaattctggcctctttgtgtgtctgtgagtggctgacacagtcggccactcaatcgcagttttgtccgctggttttggcgagctcagggcctgtgctgtgtgtgctgcagctcgggagggctgacaaagagaggtggttgaggagtgagcggccgggagcctttcgcctccagtgtcttcgctggaccttggtctttacaaaaggaaacaaatgaaggctcactctgatccactcactgtgacagtctgagtggcagcagccaggagcttctctggccatttgtagttccctcagttaaaaaatgaaagggtagctaaggttcaacagctcaggctttgaactttatttatttgtttatttattattatcatcatcatttttgagacagagttgacagtcttgctgcgtctgtcacccaggctggagtccagtggcttgatctcagctcactgcaacctctgcctcccgattcaagcaattctcccacctcagcctcccaagtagctgggattacaggtgtgtgccctcacactcagctaatttttttgtagttttagtagagatggagtttcaccattttggccaggctggtcttgacctcctgggcttaagtgctccatctgcctcggattcccaaagtgctgggattacaggcttgagccaccatgcccagccaggttttgaactttttttttctcttttgagactgagtttcgctcttgttgcccaggctggagtgcaacggcacaatctcggctcaccgcaacctctgcctctggcgtttaagtgattctcttgcctcagcctcctgagtagctgggattacaggcatgcaccaccatgcctggctaattttatagttttagtagagacggggtttctccatgttgatcaggctggtctcgaactcccgacctcaggtgatctgccctgccttggcctcccaaagtgctgggattacaggcatgagccaccacacccagctggttttggacttttaaaaggtggggttcttgtggtccagccccatgtgtgagatggggccaggttctagtggcaagtctagcagttgctatcccctttttagacgtgtgacacagctgcctactaaaaggtagggtgccggcagtatagcagccaccttctcagtcctcattaattagaggctgagctattggatttcctgccaatggccaagtggaaaatctatttgacttttttttttttttttaatttaaaatgtatctgcgtggatagactcaggcaggagatttgtctttgtctttgttagaggaacctagctccagtgtcttgcttctcctcccactaactgtaacagtcaccactgaggccgggtgtggtgcctcatgcttgtaatcccagcactttgggaggccgaggcaggtggatcacctgagagttcgagaccagcctggctaacatggtgaaaccccgtctctactaaaaatacaaaaattagctgggtgtggtggcgggcacttgtaatcccagatgctcaggaagctgaggcaggggaatcacttgaacccgggaggcacaggttgcagtgagtcgagattgtaccgctgcactccagcctgggtaacagagtgagactctgtctcaaaaaaaataaaaggtgccattgaaccctcctaagaagatatacagtagccaataagcacatgaaaaagatggctcaatatcacttatcattagagaaatgcaaatgaaacccataatgagatactgcttatgtccattaggataactgctgtcgaaaaacagaaaataacaagcatgggtgaggatgtggaggaattggaactctgctgcactgttggtgagcatgtaaaatggtgcagctgttgcggaaaacagtatggcggttctgtaaagaattaaaaatagggctgggcgcggtggctcacgcctgttatcccagcactttgggaggctgaggtgggtggatcacttaaggccggaagttcgagaccagcctggccaacacggtgaagccctgtctctactaaaatcagaaaaattatctggtgcaatggtgcgcgcctataatcacagctacttgagaggctgaggcaggggagtcacttggacctgggaggcggaggttgcagtgagccgagattgtgccactgcactccagcctggacgacagagcaagactctgtctccaaaaaaagagagaaaaaaaaaagaattacaaatagaataacctaagtggtgtgcttatgacaataaatagtttattttctaaaaataaaataaaaatagaataacctaatgctattgcatttccacttctgggtatatatcataaagaattgaaagcagggtctggaagagctagttaaacacccatggtcatagcagcattattcataatagccaagaggtggaagcaacccaagtgtctctccatgggatgaatgaataaacaaaatgtggcatgcacatgtaatagaatgctattcagccttaacaaggaaggaaattctgacatctgctaccacgtggatgaaacttgagggcattatactaagtgaaataagccagttgcaaaaagacaaatgctttcacttatatgcggtatctagagtcctcaaattcatagaggcagaaagtagaatgacagttgccaggggctgtgggaccggggaattgctgtttaatgggtgcagagtttctgttctgcaagatggaaagagttctgaagatggatgtcggtgacggttgtacaacagtgtacttactgctgccctgtacatttaaaaatgggtaagatgggccaggcgcggtggctcacgcctgtaatccccgcgctttgggaggctgaggtgagcagatcacctgaggtcgggagtttgagaacagtctgaccaacatggagaaaccctgtctctactaaaaatacaaaattagctgggcgtggtggtgcgtgcctgtaatcccagttactcaggaggctgaggtaggagaatcgcttgaacccaggaggcggaggttgcagtgagccgagattgtgccactgcactcccgcctgggcaagaagaacaaaactctgtctcaaataaataaataaataaataaatggtaagatggaaaatgttatgttatccatgtttgaccacaattacaaataaacttttttttttttttttaaaggaacaaaaagtcactattaaggcctcacccctctgcttcccgtgtctgtggcttcgtgtccagcagtgagcacggccagaggggagcctccccatctcagccagtcctcctccctttcagaagccctgccttatccctcagagggggacctcttgcccctgctaacatgtgcttgagaaagcttttaatctcatttatgaggtcaacctctacaagctaaattattttaaccaaggactattcactgtgatgttatattttgggctttgtttttgctgcttggtcaaatagagaacaagggccacctctcgtcacacagcctgacgctcctgcagccctgtgagactgagagttgttttcctggtcatggtgacagatgagccacgcatgactcactggagcggtctcccctgaaacaaaggcatgcatttgactgcagactgggtgttgagttggtggcctttgcaagactgggtgggcagttctggcttcaaatgaccctgatgaatcacacggttcacagacgtttcatttattaccttgacagtgaccctggacaccagttgtttcttcatataatttgcgttaaggcttccttttgactttgtgggagcttggagtaaaacgcttcacagagttttcttgcgtttctgtttttcaggctcacttcatggactcactttgcgtgcttgttaaatgtgctgtgttgctcccaagaccatgtaaagcctactgaccactaacctccctcacagcagaaactagacgtcaggtaaacccaacccttgtgcctgggggtcacgtcaagttgcatgactgtgattaaggtaataagtaaaggtttaattatttgggctagcgattttggttttaaaatatttgataattaccaccaaagaaaagtcaatccatttaacttctgttttgtggctacacattcttagatataaaagaattaaaaataaaaagcctactaaatatatctggagatctcaccagaagagcatcacctccaactgacctaaaatagtgatatactggtttgagtgagaaactagctgggcatggtggcatgtgcctgtagttccagctacttgggaggctgaggcaggagaatcccttgagcccaggggtttgaaaccagcctgggcaacatagcaagatcccacctcaaaaaaattatttcagaatcaaaagagatggtttcttctttcctcccttcctccctccctccttctcccccttttcactttgagtttggcttaactaatagactccttgagcaaactggggtttttacaaggaagtaagagtctaatattaagtttttctgatgcccatattctaagtcagcttcatacttacttctctcatcatattctaaagtgaagatacctgaagtctttacaaaagctctagagattagttttattaaaatgtttttctttcccaaatgagagctcttattttttcccccatttttcatctcagcctcatttttgaggacttccaggcctttttcttttgtggtattcctagagccccaacagagcctggtacctggtgtcatgttataaaaatgtgatagtttttgagcaaaagtctctcaaaatactgtggagagattttagctctaccagtagtttatgtataatgaaaatgtatctctctgatcactgagatctgtgtatttagactgacagaataaagatactttccctaatttttctcttcaagaatcattagtttggtcaggtgtggtggctcacacctgtgatgctagcactttgggaggccgaggcaagaggatctcttgagcccaggagttcaagaccagcctggagcaacagagtgagaccccatatctttaaaaaaaaaaaaaaaccccgagcttgagagtggtagcacgtgcctatagtcccagctacttgggaagctaaggcaggaggatcacttgagcctaggaagtcgaggctgcagtgagctgtgactgcggcactgcactccagcctggatgataacagtgagactctgtctcaaaaaaaaagcaaaaaaaaatcattcaaagtctctcaacaccaagcctgaagcagatctttctcataagctgatttttatgcctgttcgccttctaaattaatattgtataatgaataatgtctttaaaataattagcagacaggtgtgcagtgttgtctgtctagctaatgagcagccttgcaaaataaggagagcctgttctactgactgactcttgtccctactcctctgagtccttccaggcactgaagttgctgtgtaatatgcagggcattctttttagaaagttctgtcataatggaatgtaatttaggccacggtcttactgatgcaactgttcttaatttaggttaaaatgggcaactccgacagtcagtacacccttcaaggatctaaaaatcatagcaatactattactggtgctaagcaaattccttgctccctgaaaatacgtggcattcatgcaaaagaggaaaagtcattgcatggatggggtcacggaagcaacggagcaggttacaagtccaggtccctggcccgaagctgcctttctcactttaagagtaaccagccttacgcatcgagactcggtggccccacatgcaaggtctccagaggtgttgcctactccacgcacaggacaaatgccccagggaaggatttccagggcatcagtgctgctttctcaactgagaatggcttccactctgttggccacgagctggcagataaccacatcacctccagagactgcaacggacaccttctcaactgctacgggaggaatgagagcattgcctccaccccaccgggcgaagaccgcaagagcccccgagtgctcatcaaaacgctggggaagctggatgggtgtttaagggtcgagttccacaatggtggcaaccccagcaaagtgcctgcagaggactgcagtgagccggtgcagctgctgaggtactcacctaccttagcatcggaaacctcccctgtgcctgaagccaggagggggtccagcgccgattccctgcccagccatcgcccctctcccacggactctcgcctgcggtccagcaaaggcagctccctgagttctgagtcatcctggtacgactccccttggggcaatgctggagagctgagcgaggctgagggctccttcctggcccccggcatgcctgaccccagtctccatgccagcttcccacctggcgatgccaaaaagcctttcaaccaaagctcttccctctcctccctccgggaactgtacaaagatgccaacctggggagcctctccccctcaggtatccgcctttctgatgaatacatgggcacgcatgccagcctgagcaaccgtgtctcttttgcttccgacattgatgtgccctccagagtggcacacggggaccccatccagtacagttccttcactctcccctgtcggaagcccaaagcctttgttgaggatactgcgaagaaggactccctcaaagccaggatgcgacggatcagtgactggacgggaagcctctcaaggaagaaaaggaaactccaggtgagcataccttagagcagagggaagggtccccacagtttccccacctggagaaggggaaggttagtagaagccaccatagagtgttgtcggggtgcttaagtgatctggcaaaagtgaagagttcagtggaaagcctggctcatctcattttcaagtgtgggtttgttctctcttttgcttcagatattttcacttttagcccacaactttaatcttcccatgtcttagtcagcttgggcagcaaacaaaataccacagacttggtttaatcaacagacatctatttctcataattctggaggctggaagtcagaggtcagagtgccagtgtggtccgattctggggagggctctcttcctggctgcagacagccgccttctcactgtgtcctcatgcggcagagagagcaggaggtctaggctcttttcctcttcttataaggaccctaatcccatcatggggactctaccctcatgaccccctctaaaccaattacctctcaaagatgtcagttaaatatcatccactggtagttaaggcctcaacatggattttggggaggggggaaacaaatgttcagtcaatagcattctggttctgtgcatgtccctgcactcttccatgcactccacaggcctaatcttaagacttggccatagccggtgtggcagctcatgcctgtcatcccagcacttggggatgccaaagtgggcagatcacttgaggccaggagtttgagaccagcctggccaacatggtgaaaccctgtctgtacccaaaatacaaaaattagcctggcgtggtggcgggtgcctgtaatccgagctactcaggaggctgaggcaggagaatcgcttgaacctgggaggcagaggttgcagtgagctgagatcacacctgggcaacagagagagactctgtctttaaaaaaaaaaaaaaagtaagtacagagttggagagaattcctgaaagaattggttatctgagaattttactagacctcattcttacagtccaaataaaacagttgagattgtcattatttttggttgaataggcttgttgaacttgatattactctgatgaaattaaaatttctatgcttaagttggtacatcaaaaaaaaaagttgatgatatatctacatgtgtaatcttttttttttttcttttttttgagacagagtatcgctccgttgtacaggctggagtacagtggtgcgatcttggctcactgcaacctctgcctcccgtgtccaagcgattctgctgcctcagcctcctgagtagctggcattacaggcgtgcaccaccatgcctggctaatttgtgtattttagtagagacggggtttcaccatgttggccaggctggtctggaactcctgacctcaggtgatccacctgcctcggcctcccaacatgctgggattacaagcgtgagccaccacatccggcctatatgtgtaatcttaacctcctcatggagatagctaatggcatcctgaaaatatcttgtacctaagtgcatgtaatagaaaaatatatatactgataaaactgataaaataagaatgatgaatatacttctgtatcatggcatgtaaagttttactgggggagcaaagtggcttatccaccaggaagaaaagtgatagtttgcctttttaggtaattagtggcaattgctagattttcagtttgttgttgttttgttatttgtttttatttttgattatttatataggggagaagcttctttttaaattactctgtataagtcatggagttgaagggaatttgtgtgggcagttagtctctagcagaattgcatcctagatagacataaaattataaaattatatagagatttaggggtggaaaataatataacttttttgagtagattgcttcagatttatgaagtttgactttcgttacttccttctgatgtatatagcgtgtctgcctccaccaccccctcctgtgctgggcttcggttctccctcctcttccttcacacagaggtgaagaacagatgatcagcatcctgttttcagggcctcttcatatccctgaatatattgtagtaatttgtatagtgattttactcctggatcatcactttttcagactaaaccacaaaatagtagagatttccttgacttttttctctcagctcccatttcctaaacaactgatccccactgagcataatgggagacgcagcttctgcttacttgagggctgaagtcccaggtggacaacgtccacgcctttttgattcaagtgttatggtgcccacctgtgttcagctgtcatccactgtgtcccctaattggtggtggcatcgagccaatgattctgcatctcttatgtgcactgagtttgttgctcatctgtatatgtggcctggcttacacgcggctctagtgagctgcattcagtgacagttcccacttggttcagatgtagaccagtggctgctgtgtatgaatcattctatcacgggtaagtatccctccttgcctctcctgtcaagttaccctccctgcgtctcctacccacgggaactgggtctccttcaattctgcattgtccaaaaacttaactctgaattgtgtgcctgtagagttaaaaacaaaccggttagggccgggtgtggtggctcacgcctgtcatcccagcactttgggaggctgaggcaggcggatcactggaggtcaggagtttgagaccaacctggccaacttggtgaaatcccatctctaatgaaaattagctgggcatgctggcatgtgcctgttagtcccactacttgggaggcagaggcaggagaatcgcttgaacctgggaggtggaggttgcagtgagctgagatcacgccagcgcactccagcctgggcaacagagtgagactccatctcaacaacaacaacaacaacaaaacagcaacaacaacaaaaaactggttagaatcaaggaattagaattttattatttattttattttatttatttattttttgagatggagtctctctgttaaaaaaagtaccttcttagcaaatttcaggcatagaatatagtgttattaactgtagtcaccataatttaccttagagctccagaacttattcctcctgcaaaactgaagctttgtaccctttgagcagcatcttcccattgccctctcctgcccctggcaaccaccattgtactctctgcttcaatgagttggactatttcagattccacgtataagtggaatcttgcagtgcatgtctttctgtagagtgacatctcttgagtttttactcttttttttttttgagatggagtcttgctctttttgcccaggctgtagtgcagtggcgccatgtcggctcactcaagcgattctcctgcctcagcgtcctgagtagctgatccggattacaggcgtgtgccaccacccccagctgattttgtgtttttagtagagacggggtttctccatgttggtcaggctggtctcgaactcccgacctcaggtgatccaccctcctcggcctcccaaagtgctgggataacaggcgtgagccacctggcttgagtttttactcttgagtctttactcatctccactctgctgtactgccctagtcatcaagttacattagcccttgtttctgattattcgatttgatggaagtgaagtcacttgtatggaaatggaaatcgtatgatttgtgtgtgtgtgtatatatatatatatagcaggcaccttagtttcatccgcataacagatgattaagaattctagctgaacctatttaaagacattctatattttttaaaggctcttttttattagcctgaaaattagtgactggctattaggattctagataaaaagatttggaaatttattagagactgggagagttcatacctatgtataagaataagttataaatgctaaaatgcatccccccacccccccccatttctgaaaaagaaaactccttgctttgctatggttaaacatttaaaagttggcactgtaagttgagaagcagtgtcaagagtgtgtgtaggtcacacttaactttgggacttctgtgcctttctgtggcagaattgggcttgttttgaagcatattccgtcatggcccttgcagggtatcagaggtaattccagtgtttttgggcgatgagtcagagggacatatttataactgagataatgttaatactagctagatgagaagtgtttcttcaccttttaggagttttttgtttttttgttttgtttttcttttgagacagagtctcgctctgtcgccgaggctggagtgcagtggcgtgatctctactcactgcaacctccgcctcccgggttcaagcgattctcctgcctcagcatcccaagtagctgggactacaggcatgtgccgccgcacctggctaatttttcgtattttttgtagagacggggtttcaccgtgttagccaggatggtctcgatctcctgacctcatgatctgcccacctcagcctcccaaagtgctgggattacaggcgtgagccaccgagcccagccaggagtttttgaaaagcaacaaattgacaattaaaaaaaaaactctaagtatttctaaagtttcctgtccaagtgactcacaacagctggtttatttgctctgttatgcataagcatcagtgtataaataaatatgactggagatgcagtgtaaacagtggcaaatcatatttctatttgtaatatctgcttggggcgcagttgttcatggctcctgggtatttggaagtactctccagttgtgtgattattctcttacaaaacagcaagtaattgcaacttgatttttggatgaaatttctgaaaaggaaacctctctatacaatgtaatattcaaaataaggcctttagtcaatggtccttgacccagttttccatcatttttattttaatgcataagaaaatataatcaaaagcccactagcagctgagtagtcttgagtgtgcttggcgtctctgcagagttatcttcatttaagccataaatgttgaatgtcagtgccttttgagtcagaagttaagctcactttatgctgaaaattttaattactgccatttaccagtgaaaagcctgtatgcaaattatttttcttcagtgactagacttctaatccagatattagagaaatgtctttatgttttcagctctgtgcatggccagcttgatgttcaatgcacctggtcctcacagggagcaacattattatataagtatgcattgtatttagagctacctgtgtttgatttttgtgttggagtaaatactgcagttaagaatcatgtctttgatatctccagtacctagaataaaataggtactcaaatgaaaggatgtgaatgaataaatgggtatatttttttcatgaaagtaattctctaagtaagaaatattaattatgaaaaaaactggccgggcgcggtggctcatgcctgtaatcccagcgctttgggaggctgaggtgggcggatcacctgaggttgggagtttgagaccagcctgaccaacatgaagaaaccgtgtctctactaaaaatacaaaattagccaggtgtggtggcgcatgcctgtaatcccagatacttgggaggccgaggcaggagagtcacttgaacccaggaggcagaggttgcagtgagccaagattgcgccattgcactccagcctgggcaatgagagcgaaactccatctcaaaaaaaaaaaaaaagaaaaacaaaaaagctatagttactagccagtacccttcatagataaggaatcctaagtgtattattattgttattatttttgagatggagtttcgctcttgttgcccaggctagagtgcaatggcctgatcttggttcacagcaacctctgccttccaggttcaggtgattctcctgcctcagccccctgagtagctgggattacaggtgctcaccgccaggcctggctaatttttgtatttttagtagagacgggtttcaccatgttggccaggctggttttgaactcctggcctcaggtgatccacctgcctcggcctcccaaagtgctagaattacaagcatgagccacctcgccatctattatttttactatatgaactgggaaaataagatactagagatctcaaagtctagaagtctagacctgggcacttggccagaagctggggactatagggagaggaagagaagtttttgggttttgcataacaatactgagtccctgtcttccccaccctaccctggtatagtaattttctaatttacctttcaaatgatccagggaaaaaataaattgcaagaatatgaattctttcctggaagatactgattcatggttagcaatgaagaaagaaatatcattctagtaatcttcactagtgtgttgtaaacatactagttaatttctcgatgctaagcataggttagatttaggagagccatttgtattttatttacctctttaagtgctaattctactggatataaattgacttgggcaacactatttttaaaattctttctggtatgaagacttgatggttaaagatgtatttttgttacaagaatcttgctttgcattacattatcagcagccactggtattacacttatgctgtgtgcaagaagggatgctttggatagccgtaagctctgatgggtgatcatgtgtgtttctcacaggagccgaggtccaaggagggcagtgactactttgacagtcgctctgatggactgaatacagatgtgcagggatcctcccaggcatctgcttttctgtggtcagggggctctactcagatcctgtctcagagaagtgaatccacacatgcgattggcagcgatcccctccggcagaacatttatgagaatttcatgcgagagttggaaatgagcaggaccaacactgagaacatagaaacatctacagaaaccgccgagtccagcagcgagtcactcagctctctggaacagctggatctgctctttgagaaggaacagggggtggtccggaaggccgggtggctcttcttcaagcccctggtcactgtgcagaaggaaaggaagcttgagctggtggcacgaaggaaatggaaacagtactgggtaacgctgaaaggtgagtgcagtgtcacctgctgaggccactggggattgtttccgccagccgtgctctttgccaggaagtgccaagagactagcattgatttgagttcacatgaggggtttgacacaggatccatgggctgccttcatgcagatactttctcacacccgtgaaataggctttacctactattcacatgtattatgcagttcaataaataattagtggattttttacttgtttttattttttttgagacagagtcttgctttgttgcccaggctggagtgcaatggcaggatctcagctcactgcaacctctgcctcccaggctcaagcaattctcgtgcctcagcctcctgagtagctggaattatgggcgtgggccaccacacctggctaagttttgtctaatttttagtagagatggggattcttcatgttgaccaggctgctctcataactcctgacctcaagcaggttgtccaccttggcctcccaaagtgctgggattataggcatgagccactgcacccggcctattataatggttggatttaatacttattgcttatttcataggtatttagcttatttataggtatgcctgtaccattttcgctggatttggagaaaaaaaagtcagtaaccaaaggtagtttagttgtttggaaggcagcttctgaatttcacattccgtacatgttcagaactccaaagaggttttctttccagcttgtgcaactaagattatcatctggattattgatttgtcattccagctttatgaacaaagtctgtttgttgtcatcactaacaagtgcagccgtctttttttttttttaatatactttaagttctagggtacatgtgcacaatgtgcatgcaggtttgttacataggtatatgtgtgccatgttggtttgctgcacccatcaactcgtcatttacattaggtatatctcctaatgctatccctcccccattcccccatccctcaacaggccccagtttgtgatgttccctgccctgtgtccatgtgttctcattgttcaattcccacctatgagtgagaacatgcggtgtttggttttctgtccttgtgatagtttgctgagaatgatggtttccagcttcatccatgtccctgcaaaggacaggaactcatccttttttatggctgcatagtattctgtggtgtatatgtgccacattttcttaatccagtctatcattgatggaccagctgtcttttttttttaaacataaaggcaatagaagtgagaatttgttttgttgacatgagaaaagttttttataagcattgccatttaaaaactataattgccttgaggaagagagaagctccaaatctgtacagcgttgatttatgcagatgcacccagagcggcctcgcagcctctggcattctgcacagccccctgggactctttgtcagaggagctgagtgtgttgttcaaaagccaaacctcatcgtcaagtgatgcccttccctgtcacaggagagagcagaaacatctgcaaatactacgtgtgcaatgtccagtgccctctcaattacccctttctagcttttctttgccccttatcgaacagttggagccctgcttccccaaccgtggagggcaggcatcatgccttcgttaccacaagcccctctggcacctctggtaaaggagcacttgcaaaggcatttcatatccaagtgataccttttcctagcaggccggcgggtgtacaaagcccaggggcccagcattcctcacacgctgcagtcctcttttccatccctagatttggatgcttgtagacattgtggctggctgaggaaggtaaagaacgtccccagtttttccatactggcgaggcagatttctgtattgaatgacagaaacaatttggaaaggtagaataatgggttgaatctggcaggattaacatttaaagagataagaaagttctgctttaaggtttaaaagtcagatagctacccaaggacaggatagggaaatgtggctgcaaactattatgagtgaggccaggtgtggtggctcacacctgtaatcccagcactttgggaggccgaggcgggtggatctcctgaggttaggagtttgagaccagcctggccaacatggtgaaaccccatctctactaaaaatacaataattagcctggcatgatggcaggttcctgtaatcccagctactcaggaggctgaggctgcagaatcgcttgaacctgggaggcggaggttgcagagagctgagatcatgccactgcactccagcctgggcgatgagtgaaactccatctcaaaaacaaacaaacaaacaaacaaaccaaaacaagtattatgagtgaaaaagatgtcgggatttaatttgcaggccatgtgtttccaagttgatgtggctgaaaaggtaaatgtgatttcaaagagcaaatgtgatctttagctacctcattagagatgtcatgtgatcatcagctacctccttagaaatgctatatctcttgcaaaggagatgacagtgtctcctttctttgccctggtcagagctggttgtttccctccttgtgggcacaatattgcaggagatttgttaggaaatgagaaattgatccttgaaaggttgtcctggaggatccctaaatggggagagagtgaacatgttcccttaaggggtaaacatctgggactgtttgtgaatcatagtctgaagctgcctcctagtcacatgatgtgaatacttagaatggatgcacgttaccccatcatttgtcatgtatctactttttaagtgtgaaatttgtttcttaaaattaattctgtgagaatttcttccctgcctgtctatggatttgaaaacccccagtatacatcaccctagtggtgggggttagactgggaggcagggtgactgtgtgtgtatgtgtgtgtgtgtgtgtgagagagagagagagagagagagagagagagagagagagagagaatataccactttgagaggctgggccataggtgatgacaaggagatttagagccgtgctagatggaggagggcataaagatctagggatatttagcatggagaaaataagaactgggtgagagtgaacagcagtgtgtagaagagacattgaatttattctgggtctgcagaggttaggatgggactaatagatgggagacaggctgattctaaattaatataaaaaacaacagtgacagccatgggcacgtggaaagatgctccctttttgatttctgtgctactgaccacatttgtccagagccaaattgtcgcaggcttcttgagggaaactcaggcagatatcacttaagggctggaagagctgattggcagcttcctgtattttatcccaaaaggtagaccaggaacttctggctaccaacttcaggggtagtgatgggcctgagttgtcactgagcattgctagatttgtagtcttggctaggtcctgctttcctggtgtttgcttgtaaaacacttcaagatccatggataaagggtgctttgtagtataaatgttatcaagcacacatttcttcctttcctttgcagccaaggcaagacttgtgataaagatgtttttttccccagcgtaaccttttccatgtggctttctacacctctttcctctgggaattcagtatgttgagttctaatttcttggcttagaatccaagttgtaatgtttggacttaactgtttggtttaatcttagttaaaaacacatatatgtgtacacacacacacacacacacacactcttaagcctaatttttaaattatccttaaagtatccatgtaaataaatgggagacagttttctggagagagccgttattaacaaaccatctggttatctgcctacctggaatgtataggtatatgagggacgtacatgtttttcaaggctttggaggatgtaataaattttcaacaagggtaattctgctttccatttgtcttttccagtgagtggattttcatgcagttcactggggacttcctgggctgaagagttggcaaggtcattaaacatatccctcaaaatgtgcaacagactgagtgatagtcagtgtcaggggaggagttcataaactaattttagaatactggtgattctgccctgagatgggccagcagcagggatgggagatcaaaagggtctcatagaaaaggtggatttgagggaaaaccaagactaattgccctctttcccctgggtgagatttctactaatattacgtctctattcttgtactgccattgctatgccaatctgttttctctttctgctaccatagcaagaacgtccagtgtcaacgacccctccaagccaagaccagcgcttggtagggactggacagggctgggggcccccagcaccggggtgaacggcaaggcagggctggtggcccccagcatcggggtgaacggcaaaggcagggttgggggcccccagcaccggggtgaatggcagaggcttcactgacacgggtgcagcccgtttccactggccccagtgcacccttagagatgcagagtcccgtgaagttgaacttgatgtcatagagttaagattgatttcctgattttttaaatttgatagccacaaaattctgcctattgttttacttcctggcctggctctaatgtgaaatgtcctgttttgatttcatgcctccaagttagagcggtagtctgttgtccatgggttgttaggtttggtgacattttggcattggcccaaggtttgcattcatttcctctagatgccacgatttaaaccatggctgttggaattccagtgttagggaagctgggaagtgaacgtgaacccattggaaagaatttggacgtgtgtgcagctggagctgctctgcccctttgccctggtcctcgggccccgggtcatggcttgtagcatgtgcaacagtagcatcagatgggccttactcgatgagaagacttggtttatagtttaactgctgcatcagtggctggaaaaagatactggccaggcctgcaagaagcagctctggctgtaaacctcttgctactttcccttgtttgtaatacttgagttctgtcagcctgttagtttggatgagttttatttgcggggaggagcaaatgcgcagtttcttgagatcataaagtaccatggagggagaaagtactgcttccgaagtccaagcttggagcaggcatctttctctcttggcttctatgtgctgttatcggttctattgtataaacttgtttgttcatatcaagacttatttttaaaggaagtaatgaaattggaaagactgaaatagttttcaaaacgtctgaacttttatgaatgaggatgcaaacacagtagtaggataaagtaccgtgaagtgggccccaggcatttgtttacagtgaaggcaggctggtgtttctttcctgtcaatgtgaaaggcacttgcgaagcacccagatggtggtcatgtcattgttattcgtatgctggaggttgccacatgagaagtggtcaaaaaagtttattggatacagatttgaggggatagttaacctatacaagaggacacatttgtgagcattttagaagcattagtttgcttaaaaattgtgtctaataattataatgcaatttctaattaatgaagcaaactcttaataacttctacctgcaatactttatttgcttatgaggggaagagtaagtacttaaaagcatatgttgcagtatttttagagtaacgtttgaaaattcaggcacatttagtttcacttttctcccttagtctaagtaatgttttctattagtttcacttttctcccttagcctaagtaatgttttctattactgtgagataaaaggaaatactaaaaattaagttattttacatggcatttggagaacaaaccgggtactttctcataaatggcaaagtcccctaggtatgttcagtttcttgttcccattgatggtcaacggagtgagtgagtgtgggattttctgtggcctcttacattgagattccctaaataatgtggtgttgtgcttaaggatgagggctttggggccagagggcctgagttcacatccctgctgctccacagtgcagcggtgggacccctgcaaggaattcgatctctcagttttctcatttttagtgtgaaaggaaaataaaacctggggaccccaattcctgatgccagaaggaaaaaaaaaacaagccgaaagctgagtcatgcaagaagctgcctttccttttctttctaagcaggagctacagataaaaggttaaatatccccacaggtagctagctactctgtgttcaccttatcttatgtaaagtgctggatgattacgtgattgacagttcccctgcctgctccttttcccttgcagcaggtggattaccatgctctccctcgttcctctccagcccacttttaatttttaaacactgaagccctcaacatcgtctttggagaaaagcacagaccacagactatttctgtgattctgtgttctcttcctccgggcatgtccacaactttggcaaaataaacttctcaatggatcgagaccagtcctagatactttttgggtcacagtagaatgggctaaataaccctgcccaccttagggcctctatggggattaaataagccagtgcatgtggagtacttagaagagttaagcaacaacttattatttggtattgttattactgatattacatttacaaagacatctcattttcattcaagttcattctgatacaactaggtgtacttcagatgccacttttccttgtttaccatgtttctgtcacatgattgtctcactcaggtgtttttaaaaaagtgtgtcacttaccctcccagtcctttcctgcatctccaggtctgaccgggatgttattttgcttctctgtttcacaggatgcacgctgctgttttatgagacctatgggaagaattccatggatcagagcagtgcccctcggtgtgctctgtttgcagaagacagcatagtgcagtctgttccagagcatcccaagaaagaaaatgtgttctgcctcagcaactcctttggagatgtctaccttttccaggtactgctggtactttgtaagtggaggtaatagcttatgtactgctagaataagaaggaacagaaaaggcaaaacttggaaatgaaattgaataaatacttagttaggctttggatttggccttaagcaacagatgttggcttccgctgactgccaagggcactgggccatcagcaatccagtcattcatccagagggcacttttcaggtgcctctgaagtcccaggctgtggcccatgagatgctcattgggacacaaagagaaaaaaatcatgatccctgtcctggagtagctggcgatctagtgagcgcaatggtcaagattcccagatttggggcttttaaaatgaagcttggagaatattgatgggagaggcttgggttcttgccacggatctcagtggatgtcaaaagttttcaggaaaaccctcatagacaaatgctatgaggtctcatttccctgtggaagtggtcttaggatcttaagattcaggttatctactgttagaattttcagtgactttttagccagtgagatgttgtagaacatggcggtactgagccatcggtattggggtcgggcttaggtttgaatcctggcacctttgttagcgttgagtttgtaagtgatcttggagcgcgtaccagacttctctgagctttgggcccttcaaccagtaggataatagtggcttacatgattgccgtaagagtaaatgacatcgtgtgtgtgttaaatgcttaataaattttaacttggtgattaatattaattcagaacaggtgagagtgagagctgggaagtgaagtgtgcttcttaaatgtcccccatctaaacccagcacttgacatacacacagtgttggccgtaggttacatctgactggaagtttcatggaaagcctcgtaaagcttgggtttagatctctcataaggatggtcctgggtgccctcagaagccctgcagagcaacagtgttctctaggctgactttgggagtctagaatgctcagaagtgctccctcacttacccagtgctgggttaagctccctgggcctttaattgtactgccattcccaacctgacttaacttactagagccagggcctgagatttgattttccttttcttaacagaaaggttgcttaaaaccttctatgatactttaaagcaaagtaatgaatttatgttagtctgaattgtaaggaaggtaaaaaaacaaacaacaacaacaaaaagttacattaaatctgcatggatttcttagggtcaagtgtgaaatgaatgttttattttgtgattcaggtaaaacatccttagttttgagagttttcccgcctgtgatcccagcactttggaggctgaggcaggaggatggcttgtggcgaggagtttgaaatcagcttggtcagcatagcgaggccccatctctacgaaagaacaataaaaaaattagccaggcatggtggtgcgcacctgtggtcccagctacttgggaggctgaggcttgaggatcatttgagctcaggaggtcaaggttacaatgagctatgattgtgccactgcactccagcccaggcgacagagtgagaccctgtcttagcaacaacaacaacagaattttcccaggtgttctgttttgtgatcccagaggccacttgaggtttgaccctgtgactcgaatgtgtgtggttatttctagacatcaagagaaatgaaagtacttgtcagcctgcttagaatcatacccatttgcccactttattcaaactttgcttattgtttttaaaatatttttcttttaaaaaatgtatcattattattattattatttgagatggagtcttgctctgttgcccaggctggagtacagtggtgtgatctcagctcactgcaacctctgcctccccggttcaagcaattcttgaattcctccctcagcttcctaagtagctgggattacaggtgcccgccgctatgcctggctaattttttttttttttttttttttgtatttttagtagaaactgtgtttcactatgttggccaggctggtttcgaactcctgacctcaagtgacctgctcgccttggccttccaaagagtgctaggattataggcgtgagccaccacgcctgtcctattattattttttaattgacatggggacttactgtgttccccaggctggtcttgaactcctggactcaaaagtcctgggattacaggcatgagccactgtgcccagccaaaaataaactatttttcttttatacaaatagtatgtggtctttgtgttagaagtcactgaaaaatagagaaaggaaaaaccttgatatattcaaagacaatagcattattttgtttccccccaatatacttttatttacattgttctttttttttttttgtattgaggccatactgtagatgtaattttatatccaggtttcaaaatttcatattctagtcctaatgtttactcattctgttaaaattccgaagacaagtatccttttatttatttatttatttatttatttttgagattgagtcttgccctgtcacccaggctggcgtgcagtggcacgatctcagctcactgcaacctccgccccctgggctcaagtgattctcctgtctcagcttcccgagtaggtgggatttcaggcatgcaccaccacacccggctaatttttgtgttttatttatttatttatttttgagacagagtctcactctgttacccaggctggagtgcagtagcgtgatcttggctgactgcaacctccgcctcccaggtcaaagtgattctcatgtctcagcctcccaagtagctgggcttacaggcatgcgccaccacgcccggctaatttttgtattttagtagagatgtggtttcaccatattggccaggctggtctcgaactcctgacctcaggtgatccacctgcttcagcctcccaaagtgctgggattacaggcgtgagccaccgtgcctggccaagcatccttttagagagtggcgtaatgtatcatgagtgtgtctcccctgttgttcttatcactcctgtgttgttggctagcactcgtttctggttttagttcctgtcctagtcagagctccatgatgctttctgctctgctcctaatgttctctgagtccctctgaacctgagttgaatggttgaatgtgtttttgaaattaagcagcttgtatgcagtgcaagtacttcttgggttttgtacatctaagcccagcctgccattttggagagcactttagtggtaaaatgattcgaaacaggctttctccctccctgtgtgtaggccaccagccagacagatctagaaaactgggtcactgctgtacactctgcttgtgcatccctttttgcaaagaagcatgggaaagaggacacgctgcggctgctgaagaaccagaccaaaaacctgcttcagaagatagacatggacagcaagatgaagaagatggcagagctgcagctgtccgtggtgagcgacccaaagaacaggaaagccatagagaaccaggtactgtttgtctacacctgagttttcttccattgctcatgtcacttgtgcagtgactgaacgcatgctgtcatcttggtggtatttcttggctcacatcttggtggtatttcttacaccctgggggaaataatttctgtggtttttcattttaggtacctaatgtttgccattttgtgacatgggtgatatgatatgctttatgacctttggcggctctatgtatatactgaaatattttgtgacccaaacttaattcctaatttgaatagtgccttctggccttgatgattcactcatatattgtcattttctgaacaaaatccatacaataaaaccactagaagattagacaggtaagattctaatacaatagctttggaaaacgtggtttggtgtaacagctgtttctgtgtctatggattgcaaaaaaacagtaatttttctggttataacagagaagcacgtaacgaaatgctttcttttctctgctgcggttccatattcatataataaatggctgcttcctatggcatttgcattttagagaagggaaaacagtttgaaaatttttatttccctttgctcagacaacctaaacacttagacaagtgttagtggaatttcgagcatccctatcttagtcaggtttcctaggagacagactttgatagtgatttagatgtaaaaagttttactgggaatgctctcagggacaacgccagcctggagtgagggagcaggatctgggagggacaagttgcattgtgatgcagcttgtcccacagcgagctgtggagctgggagggccattcagagctctgcatggaggcagggtggccggccttcgtcccctcaggccagcagggcaaggcagctcccctcaatagaggtgagttaccacgaggggatctgtgtgtgagctgggaaaaggaaagcaatgcctctgtcttgaagggggaatccgggtgattcactatagaatccactacagccccctccaaaaccagttgtcaaatgacctgggaacttgaatgaggaatgggatgaagatagatagtgagcaggttcttgcatttttcttcctttagttacttgttaagttattacagagaaaccagtttctttaggaaaaaaaatttcatggtaacacaacaatttagacatagtgtgacttattagaaaggaattttacatgtggtgttttatttaaattgcaaattaaataatacctctgtttatgtctgaatgtttaaccttgtttggaagttttttcatctgtgtatatatgaagaattcagcatgaggctgggcatggtggctgacgcctataatcccggcgctttgggaggccgaggtgggcagatcacctgaggtcaggagtttgagaccagcctggccaacgtggtgaaaccccatctctactaaaaatacaaaaattatctgggcacggtggtgggcgcctgtaattccagctactctggaagctgaggcaggagaatcgcttgaacctgggaggcagaggttgcagtgaaccaagattgtgcactgcactctagcctgggggaagagtgagactctgtataaaaaaaaaaaaagaattcagcatgagtaggaaaaaatttctgtctaaaaataggaaactgattaaaggcatgcattcaatgatacaccgagaatttggaataatgtatcaattggcaatagcaaaataaccaaataattccgacctctgcccctcattaatcttctcactctatctacctttgcttctccttttctcatatctcatgttgcctttctcccatctcagctctttccctcctgcttattttcccatctgcaaatactggtgtacctaatagatgcacctggcttaaagaaataaaaataattgtaaaatatggaccccgtttctaagaaattataatttagttagagagcaagccttatgaacatgaaactaaaggtcattctaaaatgatcgaagttaggtgacagctggtatagtcatcaaatattatgggagatcagagggttgaggttgtactgtgatcttgaggaaatgaagacttcctggaagaatatggtgttaaaaagttgttaagaggtgtgaaggatttccaggctggaagggtgttgggcgagcatggagagacaattggaagtgactgagtggtggcttggggctctggagcacactggagtcaaaggtttgggaagtgacaagagttggcagttaggttggataggcaatgaagctttttcagtctgtgtcttagtctggaacaaaatactgtaaagcgggtggcttataaacaagagcaatttatttctcagagttctgaaggctgagaagtccaagatcaagatgccggcagattcagtgtctggtgaggccctgctttctggtttctagaagcatcttcttaactgtattctagcatgacatgaggagcgagggatctttccgggccgcgttttataaggccatccatcctattcacgagggctcaccattatgactgtcgtgcgcagtggattaagcagtgaaggatgaaagacaccgtaacttaatgcttgaatcacacagtttgttggcacgcaaacagttcttaacagatattggtattttatccccattcacgctacacacaactcttgtttttcaccctgttaggaacaagtcggggatcttacatgaataggcacaggattggtcacagaagtcctcaggcatctgggaatagcttcccctggtatcaaggctggaatgttgaggctgaagcattcagtcaaggagatggcaagcctgactccgggtccctttctgagtggcagcatctcatcctcacgagtctgtgtctcagcagagcaggtcgagctgcctgagggcttctctttttatagtccctgtttggggatccacctgtgtctggttatcttgaaggttggtgcgccctagcatgtgatgtcgtctcaaattggaatatcccaatgcagttggtctaaacagatttgggcattctggcagacatctgcacttacaaactaactgtgataacatatttacactatacccataaattgcactccaaacaatgacctaatcattgccccttttaaaaaggccccacttcctaataccatcacctaaagcattaagatttcaacgtacatatttcggagggacacattcagcccatagtggtcttgtatgcaaggctcagatggtaaggtttattttatactctgctttcaggtggggggatacaggtttttaagctgaggacaaagcatgatgactgtagtgtctttggaagattaatcaggcagcagcttggaggacagagtggggcaaaaggtgtcaggcagtggagtggcactgtgctgggtgtatagatacaagggcctggtcccaagtgacacaagttcaacagtttacatggaaaatgtataacagggtacataattttctgtaattctatagaatcttttttttttctttttttttcttttttttttttgagacagagttttgctcttgatgcccaggctggattgcaatggtgtgatcttggctcatcttaacctccacctcccaggttcaagcgattcccatgcgtcagcctcctgagtagctgggattacaggcgcccgccaccacgcccggctaattttgtatttttaatagagacggggtttcaccatgttggtcaggctggtctcgaactctgaccttaggtgatccgcttgcctcagcctcccaaagtgctgggattacaggtgtaagccaccacggctaatctcaattttttagaatcttaaagacagtaacttacacccctgagcggaactgttgctcaaccaggatatgccatttaaactccaaagtacaaaatagttttaacgaggaagccaaaactgccaagaagaatgcaggaggtggaaggctttgggatccaacaagaacacagctgctgacattgctgagggagagctgcccccacgagcccagcttgcctcctctcaggccctgcctgcccctcttaaggggcctcaccctgctcacagccagggggcgttcagctcccgaggcagtgcagccgtacctccccgctctctgtctgtgtggaatgtaggttgggagtccatgtggaggtgatgggacagatcaaagagcctgaaggagacacggttatcccagagttttctttgtaccatgtctcatccatggtgctgattttccaggatccggcagccacagcctgtctatcctgagatgagacttgtggatccgagtgtctcagagtgttcagagcaccccagtcaaaaatctcatcctgaccataatcgtagtcgaagggatgcccagcttggagttttcaggtctttgggtagggtcagatgtttagggctagggagagaaaagggacatttggcaacactgagaggctcctggcctgttgtgtgtgtgtggtggtggtgggtgggggtttctctgtggccacaaggagtctaagcagacatttttttaaaaatttaaatttgcattaaatgtaattgtattcccttgtccatagtttgtaaatgtttaattgatgacatcatagttggtgctattctctgattaagaggggaggttacttgaacataaacccttacataaatccaggggtctggatggtcaggtggcctgaagagaaactgttttaaagaatgagggtaattatcacttgtggtccattatccattctttgacagaatcatcactttagttattttaagtgcacctttctaatgctactaatttttcatttttggttctcccctccccatagcccaggccctaaccccttcctgtgtcctccccacactcccttctcccctacacccttctcccaacccctgccgtacatgcactccctttctcatgttagtcttgtgagtttctggtaacagacaattgggattgattttagaaattcttgtccaggcacggtgactcacacctgtaatcccagtactttgggaggctgaggctggaggttcatttgaggccaggagctcaagatcaggtggggcaacacagcaagaccctatttctgaaaaagaaaaaaaaaagaaattctacctggaagtattctcctcaccgtattgcactctttgaggttatgatttagtcacatgttcctgaagggctttgtagtgtgtagcctgagttatgtttgctgtgcccgctgtccttgcatcctttgtcagcaggttgtaaaggagctgtttacgcttttttttttttttttttttgacagagtcttgctctgtcacccaggctggagggtagtggcgcaatctcagctcactgcaacctccacctgctggattcaagcaattctcctgcctcaacctcccgagtagctgggattacaggcacccaccactacgcccagctaatttttgtatttttagtagagatggggtttcaccatgttgaccaggctgttctcaaactcctgacctcaggtgatctgcctgcctcgacctcccaaactggtgggattacaggcgtgaaaccactatacctggccaagagctgtttactttttaccttcagacacaaagactgggaagcattaagcaggaacaagtacttgcttaaaattgcttttatgagatatttgacaaaaaaatgtaatgtgaagccacaaaggcaaaggtatttacagatcaagaccaatcaggacagggtctccaaaatattccctaagcatttagctttctctaaacttccttttaaaaatatctgtaaaagagcagtgctttatccacttagcattttaaaacctcaataaatatacatttatttatgtagcttcctccccagcggttttccctgaaaacctcagatgtagtcatttctagcctaaaaatagaatgtgcaatgtaggtgacatcatgcaacagaaattctctggaacaggttttcttcgaagtacgtgggtggagaagatcctttttgaaataaaaaggcactatcgcagttgtaacataccggctgagctacatacggtcagtggtgacatgctctggccgtgtcctgggcctcttgggtgtttctggggcaggatgatgcagctttcatttgagcatgtccaatgtggaccagatcacaccgccatccacacgccagatcgcctttgaagttcccagggaggaagagttgtaaattaagtccagttagtactttatttgcctttctgcttattatttcaaacaagtaaacaaggacaaaacctcaccacccttaggcagtcttggcattctcccagatggcatcccccatcctgcctcattatgtgcgatttccagggtagacaggcctgcttctgtggttaattaggctggggagggaggaggtggttggactaccaggggttgctgtggggaaggaggaagcacttgctggtagggttcagactgctctgggttttatgaaatgtgggcttcagtttaaatatttacttaaatacagttttaaaatcataaagaggacggattgcgtttggacaattggcaactggtgaagagaacaatgagaacaaggctttgaggaaaatacgaggatactgtggtgtatttctggatgtgtacagggggaagcagtttgaggaacaaaccactggagtgtagcatatttgtgaggggatttgagggagataaagtcagattgtggaggtggtgggtgaagatgtgaactttattcaataggcaatagggagatggtgaaagtgttattttttattttttattttttaaggcaggcaatagggagatggtgaaagtgttattttttattttttaaggcagagtcttgctgtgttgcccaggctggagtgcagtggcatggtcttggctcactgcaacctctgcctcctgagttcaagtgattctcgtccctcagcctcccaggcagctgcgattacaggcatgtgccactacgtcctggtaatttttgtattttagtagagatgggattggccatgctggtctcaaactcctgacctcaactgatccgcctgcctcagcctcccaaagtgctgggattacaggtgtgagccagtgtgcccagctggaagtgtttttattttctatttttttgaaacggagtctttctctgtcgcccaggctggaatgcagtggtgtgatctcggctcactgtagcctctgcctccagggttccagtgattctcctgccttagcctcctgggtagctgggattacaggcgtacgccaccacacccggcaaatttttgtattttttgtagagacggggttttgccatgttggccaggctggtctcgaactcctgacttcaggcaatctgcccgccttggcctcccaaagtgttgggattacaggcatgagccaccgctcccagcctggaaatgtttttgttaggagaataagaatgtttggtttagttaaatgagcgtttgttcggtgcatactctgggtcaggcaaatgtgcacagactggagactcaaagaagtcactgtctctgccctcagtgacagtggcactgctagagagagtgctagagccttcagtgacagtggcacctgctagagagaggtgacagacagttgagctctcagtctagcaggtgacagacagttgagcatacaatttcaacataacacagtgattcagtgcacgtggcattccagtgctgtggaagacagaaatgggaaatatagcctcatgtgcagtcatggaagaccctggaggagggaggccaagttgcttcttgaaaaatgaggagtttaccgggagaatagagaggggtcttccaggccaaggcacagtgggagcaaatgcagtgtggttttaggtaggtggtgagaggtagacaggggaagtaggactgtctgtcactctctcctcccggtaccactgcagaagcctccggtttcgcccttcgtctgatgcatcttccatacaacagccagactgggttgcatcggaaaagcacatctgggtcaggtgcagtggctcatgcctgtaatcccagcattttgggaggccaaggtgggcggatcacttgaggtcaggagttcaagactagcctggccaatgtggtgaaaccccgtctctactaaaaatacaaaaataattagccaggtgtcgtggcgcatacctgtaatcccagctactcgggaggctgaggcaggagaatcgcttgaacccaggaagcagaggtttccatgagctgagatcacaccattgcactccagcctgggcaacagagtgatatgtctcaaaataaataaataaataaataaagtaaaaaaataaaaagcacatgtgatcctgtgattgccagataaagtccctgataacctctccccaccttgacctttatctgcaactccctgagcccacccttctgctcctttctttgggtttttcctcaggcagagaggactcctgtgctgtgcacaaatgtgccctgctcccctccgccctcttcatctggctcaccccttctcgactgtcatgaagggtttaggggtcgcttcctccaaggcgctgtccttgatcgcccttttgcccactccatcagggagccccactctcctcccacagttctccatgtctgtgccactgctgtcatccatggctttgtcatgatttcttcgtgtgtaaggttgctcctgctataaaatacgtgctcctggaggaaccgtgtctgtttttttatctctgaaccctcgatgccttgcttgagttagtgaatgtgtggaagcacctctgtctcgtctgtccagggatgctgtcctctgtactgcaggaaacagagatcttctctgagtcagccaccaccccacttcccagtgttccaggccttcctgcttcacccccgtctaacagaacgcctccttttgccctgccttgttctcatgctccccttccttgttttatcagagcctctgccttaggccactatcatatgtgatttcacaataactctgcaaggtaaagatgtagatatagcacccgtttgttggatgagtaaatagacccttaggagaagtatatttcttttctttttctttcttttttttttttagaattaaaaatttttttaaaaaatagagacgaggtctcgctatgttgcccaggttggtctcgaactcctgggtgcaagcgatcctcctgtctcggcctctcaaagtgctgggattataggagtgagccactgcacccagacgagaagtacattttccgtataagtaccgtgcactaactgattgcgccactggagcaccaagaagtgcatttgctaatgtcacacagctggtaagtggtagagctgggatttggacacaaatctttgctcctaattcataggcgctactgctccgtaagacttgggtaaatcagatggtgctttgcttgctaactaaaccaggtgatgaattgttttgtgtggaatagaatccttgatttacttgtttttataacttggatttttcaggtcgatttgatgggaattacattgattataaaactgagtgaatttttgggtatgggaattatatctcaaaggaaaacagaacaaaaccgaatctctctactttagctggttgttctaaatactgttaaacttgagtgtcatctatgtcactagctggttcttctgtgaagataggttttagtatttggaaagcatggaacgggagtttttcagcttcttacaccaagaaagaaacatgaattatcttatgggacaaacctagtaataggcaaatgactactgcgattaaatgactaaatggcagaaaatatttttctaggactgctgggtgtggcaggaatgtacttgtcatcttttaaaaaaaaatcattattcatttgttatttttagcattaggcttcatccctctccctcccactttactacaggagaccataacctttctgagttcattaaatcagtaaagctgtgttagcaataaagaggaaaattttgcattgaatttgtgccaatgtttaaaaatgggagtgttcccctgtaattttgttattagtaacttcctttcacaatgaaagataatgaaaaccttctcagagtgagtttttttcagtcttgtcttttttatgttttgagcatgggcattaaaagaaacaaaagctcaatctatatagaagttatgttttttacttttttttttttgacagggtctcactctgttgcccaggctggagtgtgcagtggccctgtctcggctcactgcagcctcaacctcctgggctcaagctatcctcccacctctgcctcccacatagatggggctacaggtgtgcaccaaccacacctggctgagttttgtgtttttttatagagacggggtttcaccacgttgaccaggctgcaagtgtttttttttttctttttatatcatatcttgatgtttatctttaaataataaggaaacatctagaaacttatcagtatttaaagaatttaggaaaagggggtgggatgtcttggattaaaaggaactgattttaggcattctagtttttgatgttagaaaaaaatatctccagaaacaccttgataaatgtggtcaggtaatacattactattttggtgattattatcattgaactgtactgaatctctaaactaacatacataatagctaaaagattgtctttttttcctttaccctttaaaatatgtatctttgtctttcttttatgtcaccttctgaagaattgttataaaatgtttttctttcaagttaacattactttaaatttgggctggctttgaatgtcaaggctggtaggatattgaaatgtaaagtgttcaatatgaatagggccactgagtgagagtgtggtagtcttacctccttctctgtagaatacctgggggtatatgggcagacataaagtggacaggtaaaaatgtaaatgaaagttgctaaggtcactatgaggatagtgcacaggtatcttcctatgagtcagaagacctgggaatcaggggccccgttatagctacttgagagggtccctgtcccctacatgttgttcacatcagaatcggctttgggtctgctagtctggtagggtgagctttttacatgactggtcaaattgcttctcttctggacttaagtctcaactgctgagaaatgaaggtatggtaataccaagtcccttgcaatttcattgtgaatgttaacagcctttctaaatactataaggtctgttgtgagcctttgggtccagcacttgtacctcttcttccctctaaggaacccgagcttctgaatcaggggcctcaccgtacttttacttgaatactctttcaagttcctctctacaactttgctgagtctgtggaaagaaaagtcaaatatttcatattgattatttaaccacagatcttcatttaagctctggaactgattctttctataaagaaccatgaccttaaaaataagatgactatgatctttcaatatggaatagatacgtgagtaaagatggcttactctgccacaaagatctatagggatgaaggctgtatataagtcaggggtctccagagaaacagaaacagtaggatgtgtgtatacctgaagaggtgtgtgtgtatgtgtttgtgtagggagagaatgagagaaatttattataagaaataggctcatgcagttatggagaagagcaagtcccaagatctgcagggtaagtcagtaagctggagacctgggagagacaatggtatagttccagtctgagtctaaggcatgagaatgaagacagctgatggtgtagttctaggctgaagactggtaggctcaagattgaggaagagcccatgttttgttcaagtccaaagccaagggggaaaaaaagccagtgtcccagtttgaaggctgtcaggcaggaggagttctctcttacttgagggggtgtcagcctttttgtcctcttcaggtggtcaacagattggatgaggcccacccacattagggaaggcaatccgcattactcagtctacccatttaaatgttaatatctcccagaacatccttggagacacacccagaataatgtttgactaaatacctggtcaccccgtggcccaatcaagttggtacataatattaaccattacgcgggtggatcgctttgaactcaggagtttgagaccagcctgggcaacatagtaaaaccctgtctctacaaaaaaaatgcaaaaattagccaagcatggtggcatgcacttgtggtcttgagaggctgagttgggaggatcacttgagcgcaggaagcagaggttgcagtgagccaacaatgtaccactgcatccccagctggggtatcagagtgagaccatgtctcaaaacaaaaacaaaaacaaacaaacaaacaaaaaatcactccagtcaggataaggttaagaaggataaggaacattgttgaaatagagaagtcataaggttacttttcctttgcattttctactaaattaaattttaaatgaactttacagtgtacagtttattgagatactggttgtcttgaaacttaataagatacaatcaagacaacaaacgtcttgatttttataaggtctcctttgggctattggggtgtcccagccctgttgactttccaacaaacctaagcatctgggtccatgttctccctctgaattcacctgtattttgtcccaagatttgggtggagaggtctatgagtgctgaagattattaaagtgtttctgataaaactttatgattccctgtgtatccctgtgtgctcattcccgatctgagccggggtatcgggtctcactctgataaccccagctggggatgcagtggcacattgttggctcactgcaacctctgcttcctgtgctcaagtgatcctcccaactcagcctctcaagaccacaagtgcatgccaccatgcttggctaatttttgcatttttttgtagagacagggtttcaccatgttgcccaggctggtctcaaactgtctttacctctcagtactgctttgatgtgtagtcacataagtacattaaatagtgctgttaaaaatacttttaaaactacaggattcagtgcaaatacaagagattgtcttcttccccaacctgtggtgattggcatagacctgaattttattttattttgtctttttttttttttttctgagatggagtctcactctgttgcccaggctggagtgcagtggtgcgatctcagctcactgcagcctccacctccggggttcaagcaattctcctgcctcagcttcctgagtagctgggattacaggcgtgtgccaccacacctggctaatgtttttttttttttgtatttttagtagagatggggtttcaccatgttggtcaggctggtcttgaactcctgacctccaatgatctgcccgcatcggcctcccgaagtgctgggattacagacgtgagccatcactcccggccttttttgtctttttaatccaccatggattgcatgggcatctttaccttctggtatccagtgactcattcattttctttttctttcctttttttctttttggagacagtctcgctctgtcacccaggctggactgcaatggcgtgatctcaattcactgcagcctccacctcttgggttcaagagatcctcccacctcagcctctcaagtagctgggactacaggcatgcaccaccatgcctggctaatttctgtattttttgtagagacaggatttcgccatgttgcccaggctggtctcaaactcctgggctcaagcagtctgcccacctcggcctctccaagtgctgggattacaggcatgagccactgtgccttgccgactcattcattttctttcctcttatatcttcaccctccatacaaccttcagaaaatatctgataaactgttttacagtgaggcataaatgagtgtgataaactttaatgcattatccaatctagaaatatctacatattattagaagacaaaggaatccatctataattgtggactttcaggaatcatctggagagaagatgtttgggaaacagaactgagatgatagtttttactgaaccttaagtaaggtgtcagtttgtgcccatccatcactctgaaatctggaattctctaatatggcaggaccaggaagagacttgcagtttcaatttgaactgtcttgttagcgtagaacaggagtcatcagtaataaggccatgcaccagaatcccagaaggtgctcatgaaatgtaaactttcctaggcctcagacctaatggataaaatcttcaggcgtaggacctgggcatctgcatttttaaaagccaacaggtcattctgtccattcaaggctgataccagtaggccaccacgttgctaataggggtatacaggatcttgagtgaggttaaattctttatggatgttgacattgtttcaatgcaccttggaatgtcactgttttgctgacaaatgatgatgattaagaaattctttgtttagatcttgtgactgtttttctttcatgcagaaaagttgtgcagcgaccaacctaagaaatagctacagagaacttggaaaaggtctggggaatgcccagaatttgtaatacttgtctatggggagagactggagggggcagagtgtccagtgttggaaatccttcaaagtattatttatccagaatgaaggattcacctagaaagcttggtgtgaaaggctaggatctgtctgggtgctcagcaacatggcagaactagagatgcaactggtgcacctgaaataacctaactcttcacactgcatccttgattacaagcgttcacttacagaccttctcttgagtgttgagattgcgctcaacagcttttgaatcacagctttctgttcttctcgttcttctgctgagtccctgtgttggcaagtcacaagagcctctcttcacctattattaataacttatctttgcatgaaggtaatacttgtaggtaatgcattttatatctttgggagaaaggagagtggctcccagagtttggctgcatttctttaccaactcatgacttaagttttgaagaagttcatagtaacttctgtggtgtaaacagctgcatatactttaattttatttagatgtacagatggcagttattctccaagatacttacttaggagtatactcagtaaaattctatttgtccttatccctgaagtccatttgcttcttattgttttgagtcatttactcagaatgaacagaaacataaagtcattgcttttatttatctggcatctgtttgtgtgcagttcagttaatccagtttaggatcagggactgtaaatgtgaagggaaatgaagcaaagtgaaaaagctgacttgcaaattgcatcctgttttaagtcaggatggtttagagtgttggcattctccaaacaaacatcatgcctttttggcatgtcactgtattgggaccaccagctttttgtttttgtttttgtttggctatcctgatgaaatgaagtgctggatgacccagtgcattttgtttttttttttgagacggagtcttgcttggttgcccaggctggagtgcagtggcatgatcttggctcactgcaacctccgccttctaggtttaatccattctcctgcctcagcctccagagtagctgagattacaggtgcctggcaccacaccagctaatttttgtgttttttttttttcttttttttagtagagatggagtttcactgtgttggtcaggctggtctcaaatgcctgaccttcagtgatctgcctgcctcgctttccaaaggacccaatgcattttgatgggagggattgagatggggtgagcaggaaaggctaatttaaaccatgcagaccagccgaaactaattttttcttcaagtttgtgaaagggatcacattttcgttttaacctgtgaaaacttttaatttttatttaaatcacctctgtttttgctttaagatccagcaatgggagcagaatcttgagaaatttcacatggatctgttcaggatgcgctgctatctggccagcctacaaggtggggagttaccgaacccaaagagtctccttgcagccgccagccgcccctccaagctggccctcggcaggctgggcatcttgtctgtttcctctttccatgctctggtaagttcctgaggaaggctgtttctgcagcattcggggagggctgcggatgctccccctttcttcagcttgttgccatcggcacttgtggggcttgacccaacaactgacacctagaggccaggtcacccagaggccaggggcctggagatgaaggagaccagacgtcgtgctgtagagcccccggtttctctactgcttattctagagtccagcagctagtggacagttactgcatgctcatctctgcctttctgtgtattccaccatcaggaaagtgggatcctggagaaggggcaacagtggtgtgaagattaaaggatggattaaaggttgttttctctgtcctgcagagcgccccatcaggttttttgaagtcgtacccattttggtggcttctgtgtgttgtgttggctcagcctaggggtctgtagtggttttgctgacgctgctgcccaccatggagagagctgactgtcatgacttgtgttatccagatgagagtggtctatatgatggatgctttcctggtatttcagacatgcaggagcttttggcgatagtcagaatgcatttatagcaagcagagctcacttccttcattttttctgccactcaaatactaagcctttagattttttttaaactgtgttttacattaggtatgttctagagatgactctgctctccggaaaaggacactgtcactgacccagcgagggagaaacaagaagggaatattttcttcgttaaaagggctggacacactggccagaaaaggcaaggagaagagaccttctataactcaggtgagcttttcagcatgggaacagcagactagagtgaaattcctgaaacccctaattttcggcctgctatgaatcatcaatgttcattctctgttaagaatgaaatgaggcgaggtggggtggctcacgcctgtaattctagcacactgggagggcaaggcaggagggccacctgagcccaggacttcaagaccagcctgggcaacagagtgagaccccatctctacaaatagccgagtgtggtggtgtgcgcctatagtcccagctactcgggaagctgaattgggaagatcgcttgagcccgggaggttgaagctgcagtgagccatgattttgccactgtactccagcctgagtgacagagcgagaccccgtctcaaaaataaaaatgaaaataaaagttgattcaaaggaatcaactcttagcatgcacttttttttttaacccaacgaaactgcacaagttgccgtatctatcccggcacccctgaagaggtagtcacactgcgtgcagtgcttaagaacagaaaaaataagaataatcagaaaataatccacacttttccttccctctagtactaatatttactttctcatagattttatattaaaataaatggaaaattaataatcagaggagtggcagctcagttctgttgatagagctgtggattttgctcactaaatccttagaacatggccttggggttttgtcatcccattttagagacgagcagactgacacttgaagaggttacgtcacttaccttatcctgttcaccagcaccaaagggcagggccaggactagtttctgcctaagtccacggtcttgaaacactggaaaattgctagtgcttattttcccttggggaaaggtgactcttgcaacactttctttttcttttcttctcttttttttttttctttttttgagatggagtcttgctctgtcacccaggctggaatgtagtggtgtgatcttggctcgccgcaacctctgcctcctgggttcaagtgattatcctgcctcagcctcctgagtagctgggactataggtgcacaccaccatgcctggctaatttgtgtatttttagtagagacagggtttcacctgttggccaggctggttgtgaactcctgacctcaggtgatccacccacctgggcctcccagagtgctgattacaggcgtgagccaccgtgcctggcctcttctaacatttttattaaggaaaaatagtctaagcacatgttatgtgaaatgtggcccaagtatcgtaaattgttttcaaaacattttgaatatgtgtatttcatggtgcacctgtatttcatgatgcaggtgcatgataatggactttatcttgctgattgatatgttttaggattattctgtttcaaagctgttgaaaaaataagttatatgatgacctgatcattcaggtgaatagggaaattgtttgcaattaaatctgaagaagtttttgcttttattttcaatgagctgctgtttttctgattatattttcaatatcattggaaagagagtcacattttattggatctttgttttctaatttgtatatggctatttgataacgcttttgtgaattgggtaagtaaaagggccagtatcagttcctttgacttgtttaaaaccttaaaacaataaagttagaggtggtggagagtgggttggtagattaacagacagcagaatcacaggaaacttttcttatgtggccaccatgtttatatactcatatacaaaaataatatcagattttaaaattgtggttctacttgtaattaatttttttttcttttttgagacagagagtctctctgtcactcaggctggagtgcagtggcacgatcttggctcactgcaacctccacatcctgggttcaagcaattctcgtgcctcagcctcccaagtagctgggactacaggcttgagccaccacacgtggctaatttttatatttttagtagagacagggtttcaccatgttggccaggctggtctcaaacttctgggctcatgtgatccacctgcctctatctcccaaagtactgggattacaggtgtgagccactgtgaccagcctgtaatttaatttaatttaattgtaaagagtaatcttatttgttggttgtaatggaaatgtatttcctcattattgactgtagtcaactgcaaaccctttgctaatggtgggcctatgctttctttattttttaaaaattgtttttgtagaaatggggatgggagtggtctccctatgttgcccaggctagtctcaaatttctggcctcaatccatcttcccacctcaacctcccaaagtcctgggattacaggtctgagccataacaccgagcacttatgttttgtgaactgaacttctttgatggttaactaatgtccttaaggtattttaatcaagacagtatattcgatataaataataacttgataaataacttgcttattttttcttaggtgtagacattctgctaattagatatgagcctaatatggtttttacccagcatctgtggtaatttgttctcaacatagactttttgataaacaaaagcatttggtcgaacattttttgttttaaaaagatatgaaactaattacagtgtcagtatttatataactgaatgaagttgatttagtaggtatttctaagtgtttatattgtttttaatgttaattatgccattacaaaatttagaaggtgaaatttggaaaaggcaattgtttttaattcttctacccaaacaaaccacttttaacatttagctatattttcttccaagatttattctgtgcacattaaaaaaagtaggtatgagcttgattttgttggttctgtttcacaccttcagaaacatgtactttttggttaaaagcatatcaagaatgaatttatttatttatttatttatttatttgatacagtctcgtgctgttgcccaggctgcagtgcagtggcatgatctcagctcactgcaccctccgcctcccgggttcaagtgattctctgcctcagcctcctgagtagctgggaccacaggcgggtgccaccacatctggctaatttttgtatttttaatggagatgaggtttcactcttttggccaggctggtcttgaactcctgacctcaggtgatctacccacctcagcctcccaaagtgctgggattacaggccgacttaaataatagatgacataaaaaagtaaaacgtaactatgcgggaaataaaaactttaagtgtattagaataatgatacaaattgtgatatgaagctcttctaaaatgttatagaactttagtttttaaataatgaaaaagggtagctggcagatgaatattacagggccatttcattagtctttttcctcccccatctgtcagatatttgattcaagtggcagccatggattttctggaactcagctacctcaaaactccagtaactccagtgaggtaaactttgctatagatggccgccatcttgttttacatgaatgacacaaatgctaactttttctgtttttttttgtttgtttttgtttttgtttttgagacggagtctggctctgttgcccaggctggagtgcagtggcacgatcttggctcactgcaagcttcgcctcccgggttcatgccattctcctgcctcagcctcccgagtagctgggactacaggcgcccgccaccacgcccggctaattttttgtgtttttagtagacatggggtttcaccgtgttagccacgatggtctcgatctcctgaccttgtgatccacccacctcggcctcccaaagtgctgggatgacagggtgagccacagcacccggccacaaatgctaacttaagcgaggaatgctggttcagaatctttacatgaactccttgaaaatagatttataattaaaatggtcccagtaggtattctctaaagagatagtcttgaatgccaagcattttggaggtatctaacctcatgttaactccattttaaaattagtgacatgactagactgaagtcataataatatctttgatttatacatctctattcctcagcagtacttaccttcgtttgagagttcagtgaatacaaaattgcattttcctctcagggttgtcagggatcttcacatagatagtacattctatgctgtgtctctccaggcgccgtcaaggggagcctgagtaatgtctcctcatccctagaattgcttctgaccaaacaaatcctcagaatgatttctgaatgaaatcctagagcatgaaatcccagatgtgcctatgcctcttcctagtgcctttttcaaacccacaacatccccatgaagctgtgttatttaatttctcctccaccaaataattttttttttttcagatggagtctcactctgttgcccaggctggagtgcagtggcgtgatctcggctcactgaaacctctgcctcccaggttgaagcagttcttctgcctcagcctcctgagtagctgggattacaggcacctgccaccaaggctggctaatttttgtatttttagtagagatggggtttcactatgttggccaggctggtcttgaactcctgacgtcgcgatccacccacctcagtctcccaaagtgccgagattacaggcgtgagccactgcacccagccagttcttactctgcacttaccatctcttactgttagccactctgtcaagtgcgtatgtcatggctcccaggaaagcttgtaatcgatatagtttatatatgccctatttctattagatgtagtcatttaatggctgaggatgactgatttgtaataaaggcccataattttagggtcctatctcttccagcattatataacaatgtaaaattcttactttgaaagttaagaggcctggcatggtggctcgtgcctgtaatcccagaattttgggaggctgagtcaggtggatcatttgagactagcctgggcaacatggtgaaaccctgtctctatcaaaaatgcaaaaaattatccgagtgtagtggcttgctcctcggaggctgaggtgggaggattgcttgagcctgggaggcagaggttgcagtgagccaagatcgcaccactgcactctgacctgggtggcagagtaagaccccatccctgaaaaaagaaagttatgaaactatagcatcagtacacttcctattaacagagtttatgttggactttgaaaataaattttgctgatgtagccacttacagtgagaatttaagcttagtgcttaagatgggctcaaatcaacaggtcccatcgatgctctaaggagtgagaagaaactatgatttctgcatttgttttactcctatttgttttagctaagcattacttgtgatgtagggatactgaagaaattcctttcatttataggacaattttaatgcagcctctgtaatttctgtgctatcgtacccagataactagattcagatagaatggcagatagaactaagggtgtaatttgtttttttatatctctgggacttaaaattctgcctgagctggctaaataattaatatttcattttgctacttttcatctgctaatcattcttggagaatacttgtaacctgcacaaacctatttttatacaataagtacattacgcccatttctataacacagaaaggctgttgtgagggaggggccgtgtgcattttaaactatttcactctaattgatgcatcatataacagcccaacagtgagtcaccctaattcaaaatctgttaagtctggaataaagccagtcttacttgaacatttttttagaggacactttggcttgccaaaaatgaaagcttttcataacgaacgtctggatgagtaatagtgagtcttacacggcctttgaagggaggtgtttgtcatggagattgtgacaacaaagtccccactaaggctcagatggcggcaaccccagaagcttcattgcagaaattgtgacagcccctgggccttggccccttcttctggaaaattggcttggggtattccaactttctgtggcagtgagtgaatgcagtattgtcatcttagtcatgagctgtaaactgaaaaaaaaacctaaaaaaccccaaaaaaccccaaaaccaaaacaaaccccctaatattgttttcttaaatggaaaatatgaatgaaacagcttactcttcaccacagtatggtaatctgtttagagagaatattaatacacaaccctacatagcatatatatatgcatacagctagcgagctagctagatccatctttgtttttctttcatatcaaccgatgtgtgggcctcagtccaagaaggaaataaacactttctcttctatgacattttactgttgttaagaaaactgggagcgtgcaactcccttttgtgttttctcctcatctcccttgcaaatagactttccttttatcagccactgtggtggtttgggcccatttgtgacagccagattgtgattttgctactcacttcccttcagtgatccaagtagtaattacaagccatttgatccaaaagcatctgctgtgagaacacacggagtttcaattttttctccttgctgcatactgagcataagtaatttgacatgtggtttcaggaccattgatgtaataataataataataaatacttctgtggaatgccctccaaggagagctaaagtgatttgcagacgttcactagtcagtctggagtgactgtggctgcagcccagtgatgttcccgtgtcgtgatggccagttggagctgactgcaaggtgatctgagcagcagtggccagaacagtggcccagggctttggaacaaaggatgattctcaggaagttctttatagtggccatcgctgaaatgcagtagctactcccagtacagtataatgccctgatccagcctcagcttccaaaaaaaatctttacaatttatgtctttcaaatgcaattcctcccatcagtctcctaaccaccccacgaggctggcgtttttaacctcttttgaaggtgaaggaacagaagtgcagaggcactagataacagcccctaacaaggctgagatttgacctggattgccttgctattattgtattttttctgtctccatttgcattctcaggaccaggaaaccttgaagaggctagttggaaatatatatatatatatatatatatatatatatatatatatatatattttttttttttttttttttttttttctttgatgggaggaagtagagtaggaggcgtggtaggtgcgtaacagtcctggcaaaggtagccaaccgtggaattctgggtggttaaaaaggttaatttaacatagcagcatctttgacatgggtaacctggaaaaagagttttccagatggctccatttttaatgcttatttttaggattctctcttctttttatgaaaagaatattggagaatatttcatctggcttcctgaaactaaagcatgtgtattttcaacttggatagcattgaccttccttcagagaattaatccaactttccctccaaatgggcaaagcttacaacaacctaagagatctgtaagcaccaagtagctttttctttttctagttttaataaattaattttaaattcttggtgcttcctttgaataaccaggttttacttttcttgaactgtatacatttgtgagggttgtgtgtgtgtgtgtgtgtgtgtgtgtgtgtgtctgtctgtctgtctgcctaacacacaccaaaaattacatttaacttttcattgagggactctcttgagagggtcttactctttgatggccttggctttgataggcgtcttctcttctatggttcactagatcttgggtcaacagtgtagactcagaaaaccattgctcagagcagttgtagcacagcaccttgtttaatggattttaataggattatttcttttgtccttccatccttccatctatctgcacacttttctcttgtccagaacttattctccttcaataatctgttaatttttcttctcgaagcttccagagagcattaagaacttgacactatgtcaacagatttgagtaagatactgaaaacggacagcgtttacccttctgcctgtaatatgactgtgaatttctagttgtatccagctcagcactgaagttttgggtgtgtcctgggtgtgggacgcactgtgttaatggctgagggagaatgaggatgcagaagacaaagcctctgctggtattcatcttctcctggtgcgggacttagaagtgactctcctgtgagctgggctttgccaaatgctgtaccagggacataggagagtaaactcatctaagtgagaggacttgagggcagagaaaggagagataggagagaattcataagacaggggcattttaaaccaggttggagggtatatatggtttcagcactgactctacttgtaaggacggtacagcagagagaggagatggaagtgagcaccggtgtggagcaggagcatgccactcccttctggggaatgttccctgagccattctgttcaatgggaacatggtgtgtggcttagaataatggaaagtaatcaggagatttgggttgcacccattttatataaagggagttaactgccaggcgggcattctgtgtagtatagtggtggtgtgaaccagctcatcccagacttccacccttcagatccccggagtaccataggcactagttgtgtaaacttgggcaagtttctagaatttcctgagccatatttttcttgccttttccataggaagtgatgatggtgccttcctgagagggctggctgtgagtggtgagtgaactgatggcacatcaggagcttgtttcatttggtctcacgagatgcagtctttttttttttttgagatggagcctccctctgtcgcccaggctggagtgcagtggcacgatcttggctcactgcaacctctgcctcccaggttcaagctgttctcctgcctcagcctcctgagtagctggggctacagacgcgtgccaccatgcccggataatttttatttttagtagagatagggttttaccatgttggccaggctggtcttgaactcatgaccttaggtgatccactggcctcggcctcccaaagtgctggaattacagacgtgagccatggcgcccggccaagtgatacagtctttctctgattgtcagtaacggtgagaacaagagggtgtgaaggcacagtgttaatttgtactgctcatgttcctcccacacctgtttatccataattacgttcttcctgatctccaaaagtgcagcagtaaattaattgctctgtcaccctcagtgggagcctgtgacttcctccgggccttgttctttgtgatgtttcttactccacagtgacctctgctgggttttagtttgcttctcaacaagcctggtttcagaggtggggcctgcacctttaaggcagcatctgtttgttgctaagcaccgggttgaaatcactgcccagatgaaaagtacccgagagaatgaaccagggaaaaaaatgtgcctgtgtaagacaagagcctttagcagagagtgtccgggctggttcctggcatccctggctccttgcatctggtcctgtcttttcctttggcattggcacgtgtggggatgtgcattctggctgtgatcatccttccagaaaaatgtactgaaagcgacagatccaagacaaatccagaaatgtcacttcaaaattgagcaccatgttttcaaaaagatggcacagagagacagatttttcccttgctttcttcttttaaatttctttacgatgtctcttctagtttttaaatcctgcataggaggatcttttactttgtatttaaaaatgcatggaattcaaagtaaaatcacccattaatgataactttaaagtatgatgaatgatatataataatgtgatagtattgaatctacaggtgacattttctggtatgtaaggtgtttcacataagtgacctcttttgctcacaaaaacttaagtaacaagtaattttttcaatatgaattatattaataatatcctcttttacaaaacaggagctgaatcgtacgtagcaaggtaaatcttgtcctaggccacactttgctggtagagtctgtgacttttgatttcgaagccccaaatcttttctttactgctatgtgaatataagaacctacccagagagaaacatgtctacatcgcttaagaaatgtatgctatttttgttatgaattacaaaaggacgtattagcatgaagtcagcaattgttgtgatgatgtagttggcacactacacttttttgggaaaggcttcctgaaggtggtattctttgagatgattttccaacagtgtctatgtgtgagatagctgaaggatagagaaaagatttcccaggactatgggttaattttaaggaacaaatagatttctgtcagtgatgagtcaggctaaaattaaaaagaagaaacaaagacaaaaacacagatagtcttagaagagaaagcttgtgctggattaagtgcagttcagagtcaggatggcaggcagatgtcagtgaccatggacaaggtgtgtctggaattcagtgggaggtcagagagggattatggctgagatgcaggcttcacagtggcccttctcaaccatgatcccagagcagtaagcgtggatactcagcagcccttacatggattgcggtgttctttttttattttttgagacagactcttactctgttgcccaggctggagtgcagtggcatgatcttggctcactgcaacctctgcctcccaggttcaagcgattcttctgcctcagcttcccaagtagctgggactacaggcgcacgtcagcacacctggctaatttttgtatttttagtagagacgctgtttcaccatgttggccaggctggtctcgaactcctgacctcaggtgatccacccgccttggcctcccaaagtgctgggattacaggcgtgagccaccgttcccagccggattgtggtgttctaacttggcataagcggtcaattgacacagtggaaagaacacaggacaggcagtcactaactttcactctgcttcccatggctgcagtttcatctgataaaatgagtgaggaaacgttgtcagcctcagagggctgtgagaagccagtgatgtgaagcgtgtgagcgtttactctaaatactccgtaaatgaacaggacatttggccggtggtttccttcatttgttaatcaaatttgtctgcattttcttttggcatctacaaacaggtcgatgaacttctgcatatatatggttcaacagtagacggtgttccccgagacaatgcatgggaaatccagacttatgtccactttcaggacaatcacggagttactgtagggatcaagccagagcacagagtagaagatattttgactttggcatgcaaggtaacggattttgctgcagaaatatatttctgaatagaaataatcattaatgttgcaatcttatgccttctaaattcatgtgatattcaagggcccagtttccatgccagggaacatattagcatatttattagttaatatatttattagcatattcattaatttgcattctattccttgatctctttagaagaatgagttattaggtcatgatcccacacttccatgaagaacctgagctaatctactgaaattctatgtatactttgatatctagaataattatgaaatccgttgctatttaagttacttagagatggtgtgttataagaaggcggcataaactttgaggtaatttaatttaatcctaaatagttttatcggatttctccagattaaacacgaaacttgatatattcacagttgctttatggagattaatataagatgatgttttattcatttttcaaactgggtttcattcctgatctgagaagggagtttatggtaagtcttaaagagagccctctgagagagaatatattcagcaacatcagatcagaagcttttagaccaccaggtggtgcagtagagcttaaatagttttaagtttccagagaaaatacaatcaactatgttgaaatggtgaaaaaggcatatagagtttggcaacacttaatcatgtgcacttaataaatgtgaaaaatgtttaattttagtccccctttttcactttgacttgaaacattaggattctctacatttatatgtagtttatatccttaggaacttaatttccttttgctcccatatgtaacgtttttattcagaaaaccaacaatgttctataccaatgatatcctccattaaactgataattttctgagtaataaagggtatcagaagtagtgggtcagctgggagcagtggctcatgcctgtaatcccagcacttggggaggccgaggaggtcaggagatcgagaccatcctggctaacacggtgaaaccccgtctctactaaaaatacaaaaaattagctgggtgtggtggcgggcgcctgtagtcccagctactcgggaggcagaggcaggagaatggcgtcaacctgggaggtggagcttgccttaagccgagatggctccactgcaccccagcctgggcgacagagcaagactccgtctcaaattaaaaaaaaaaaaaaaaaaaaaaagatgtagtgggtcaatttgacccagttagagcataggcctgagataaatttctcactgttgaaaatatgcatgcgagagaaaatatgagtgtgtgtgcgtacacattttcgttttgaaagtttttggagtaggacattcttaagtctgtagatttgttaacattttacaaatttctgtactttagtaatgagaaacaaggttaggcttaacctaactaaagagatggcatttgctgagctgataagatttattttactgtcagatatgttctaccgtaatctcttaaaaatgcatctcttgcctttaatcataagcaatattgttcagcgaaaaccttcttaaaaataattgtcctcctttacttttttgcatacaagtatttatttatttatttatttatttgagttggagtcttgctgttatcacccagactggagtgcagtggtgctacctcagctcactgcaacctccacctcctgggttcaatcgattctcctgcctcagcctcccgagtagctagtattataggtgtgtgccactacacctggctaatttttgtatttttactatagtcgatgttttgctgtattggctaggctggtctccaactcctgacctcaagtgatccacccgccttggcctcccaaagtgctgggattacaggtgtgagccgctgcccctggcctgcatacaagtatttaaattcgagctcttatataggtttaaattcagcaaattatatgcagtattcttttagagatttctactttgatttttaataagcctgctaaccaatgatggatttagaaagagcatttaaaatctgaataactgtctttttctttatagatgaggcagttggaacccagccattatggcctacagcttcgaaaattagtagatgacaatgttgagtattgcatccctgcaccatatgaatatatgcaacaacaggtaagtgtgcactagctttaggaagggaaactgaaccacatctatggccctttgattttgaaaaatgtcatttttggggaaaattctgtttaaatttggcgtctagtttggaaacagtctctatataaacggtatcttaacagctttcttgttttatgaaaaatagtgtcaaagtaattttttgaggtatcataacatgagatcctctgattttgttgttttcaccttttgcaggtttatgatgaaatagaagtctttccactaaatgtttatgacgtgcagctcacgaagactgggagtgtgtgtgactttggtgagtgtaaggaatgcccctttcagggaattgtgttgttcatctttgcctactttgccccagcatctttggacttaattttttccccttacattcacattttcagaatatatgacagtagtttctgaacttcctttctcttccttcatttctatttattgatattagcaggtgacacagataggtattagtattagagggaaatgccaaagtaattaaatggaatgaatataaaattgatgggaatttgaaaatatagattaataacacaatgaatgtactgtgtgctggtgctgctctgagcagaccaactcatgattcatatgacagttgctttcatctctagtgtctttgctcttagttttctcttcccacctggaatgctccccttctttcctctttcttcccccatccctcctctctggtgacatgaatcctgctgtccttcaagaactaactcaaggtctttcttgaagaagccgtgtctgattgctttagctttacttccttctttcttccctgagtttaacagttgagggtcagctgggcgccgtggctcatgcctgtaatcccagcactttgggaggccaaggcgggcagatcacctgaggtcgggagttcgagaccagcctgaccaacatggagaaaccccctctctactaaaaatacaaaattagccaagcatggtggtacatgcctgtaatcccagctactcgggaggctgaggcaggagaatcgcttgaacctgggaggcagaggttgcagtgagccgtaagccaagattgcaccactgtactctagcctgggcgacaagagcgaaactccgtctcaaaacaaaacaaaacaaaaaaacagttaagggtcagtacttctgaagtcacttcatagcatcatttcctacatttctccttgattagataatgattggtaaatacttccatagaaacactgaatgattagataatgattggtaaatacctccatagaaacactgtttcttaccttgttaaatatatcgatacatgattttttccttaaaatgattcaaactaataataaagtttataatatgttaaaatgtcctttttaggatgccttcgttttttaaaaatttgtataatcttttctgacccccatgttatttttttattttttattttttttgagacatagtcttgctctgtcacccaggctggagtgcagtggcatgatctcggctcactgcaacctccgcctcctgggttcaagcaattctccctgcctcagcctcccaagtagctgggattacaggcaccgtgcttgccaccacacctggctaatttttgtatttttagtagagacggggtttcaccatgttggccaggctgctcttgaactcctggactcaagtgatccgcccacctcagcctcccaaagtgctgggattacaggcatgagccactgtgcccggaccccatgttatgttggtttttcctttgaagccctcttagccttttttctcctcctcttggccttcactgtgctttttgtggttgccatttgtgttcatctttgtattggaatggatgaatgaagacattgcaaagatactctctggtgagaccatattctaccagcagaagatactctctggtgagaccataatctgccaggctctgctggggtcacagcagagacctagggaacaggacattcttgctgtcctcaaagaactctccgtattaggggaccaagacatggaaacctgtgctcctcactgtggcatcacagagggggacactaagtcaggagccatgcattcagaagagggaaggtctgcctaggatttgcatgtagtcttatgtatttagggcaagcaccgtattcatccaagcattttttcaccttcttaaaatgctcaaccccaaacatagttgtttctcaacaattatttgttgtattgaactgaatttcatgtatttcagtgagagtatttttttgctgttaaatttgcctaaatttttaattgtggtaatagacatataacataaaatttatcgtcttgaccacttttaggtgtacagttttgtgatgttaagtacattcacaatgttgtgctaccatcatctatctctagaaatcttttcgtcttgtaaagctgaactctgtacccatttaacaccaattcctcatactgtccttcccccagcccctggcaaccaccagtttgttaatactttgtatctctcggaattcccctagcaaccaccattctattaatactttctacctctctgaagttgactgctctagctactcacgtaaatagtatcatactgtgttgtctatttgtgactgacatattttacttagcatattctcctcaaagttcacccaaattgtagcatatgccaagatatttttcctttttaagactgaatgatactccactgtatgcatagatcacattttgcttatccatccgtctattgacagacagttgggttatttccacctcttggctattgtgaattacgctgttatgcgtgtgggtgcatggtctcacctttggaataaaagttatgtttttatatttcttaagcctctcgtttgacatttgtctttttctgcccctgcaagatatttatactttcaaaatagctgtaatttcgactttctcaacatactgtacttatgagaaaagatgttcaaggagatactgccggtgtggttggagaaattcagtgtggtgggctgagacttgctttttccttttgttttcattcctagggtttgcagttacagcgcaggtggatgagcgtcagcatctcagccggatatttataagcgacgttcttcccgatggcctggcgtatggggaaggtccgtgtggcacaccgtgcccctgttgcctcttaatttgaaactgtgggatacagtctggctagtgaatgtttcttcttacagttttgtcagaaaaaggttgctcctggaattttaaagaaagtaaacgtaagagtttaattggaaatgcgaccaaacacagcggctcgctcgcataaacccagctgctcaggaggctgaggtgggaggatgggaggattgcttgagcccaggagcccaagaccagcctgggagacagagtgagactcctgcctccgtaaaaaaggacagagagagagaaaagaaagaaaatgcatatgcctatatatagagagagcatgtgtgtgtgtgtgtttaaaagagtaagtgtatacatatatatagacagagggaaggaggaagagagtgtgagacagacaggcggacacggatggaacaaagttaacatgggaacactagaaaaaacaacgaatgagtggttctcaggaggctgaggcacaagaatctcttgaaccggggagacagaggttgcagtgagctgagatctttcaaactgtttcttcgaatagtagctgtgagagagctaacatttgttttgctcttagtggcatctaaatactatacattttggccctttaattcttttttgtttttcttatttaaaagacgaagtcttgctatatagccccaggctggcctcaaactcctgggctcaagtgatcttcctgtctctgcctcctgattagctgggactacaggcacctgccactgtgcctggctggcactttctttgaagaaagcaacaaacaaaacagtccctacgagtacatggtttgagtttgcagccttctttcatctgaaaatatttctcacagtaatccctctctcttttttctgtttctccttcctttttctcagggctgagaaagggcaatgagatcatgaccttaaatggggaagctgtgtctgatcttgaccttaagcagatggaggccctgttttctgagaagagcgtcggactcactctgattgcccggcctccggacacaaaagcaaccctgtgtacatcctggtcagacagtgacctgttctccagggaccagaagagtctgctgccccctcctaaccagtcccaactgctggaggaattcctggataactttaaaaagaatacagccaatggtaaggctttgttctgtcttccttcttaactgctggtatcaacagccaatatttttaggctgtaattttgcttgcaaactcagattatttaagctgttcaaagaatgttttctaatttattagaagaacacagatgccaactggagtagattttatcaaaatttcatgcgttttagtaattatagcgctttcattaaaatagaaaataattatttttgcacaaaataacatttaaaaaaaaatcatggactctttaaaaatcacccataatgtttagtcttgtagttcctttgtgactgaaggcagatgaaagcctgcataaatgccaaagtggaaagatttttcttatttagttgaatctaaggcacaaccattttgcagtcttctgttgggctcttagaacagcccgtgcatttcagttcagttatatcttttgttaagtactactttattaataaacagcaaactttcttttttaaaatttatttttatttttatttttttttgagacagagtctcactctgtcacccaggctggagtgcagtggcacaatctcagctcactgcaagctctgtctcccgggttcaagagattctcgtgcctcagcctcctgagtagctgagactacaaacgtgtaccaccatgcctcgctaatttttgcatttttagtagaggtggggtttcagcatgttgcccagactggtctcaaactcctgacctcaggtgatctacccgcctcggtctcccagagtgctgggattacaggcatgagccaccgtgcctggccagtaaacagcaaacttttaatgtaggtcatgaattttaaaactttgtgaaggcctaaaaatgaaaaactgtgtgccagtttagttttctcacggtaagacttccatatgaggaaatcatttgaaggtctgaagttttgagttgatcattcatgtgtatttcatgtactgcagtcaagtaaattaggggctcggctagtactgaaaaccagtagtttcgctttatacctctggagagcccgggtcaagctccacaggagaccaagtgtggggtctttttcctgggagaacacagagcaatttttatacttaattacgataataatggatttccaattgaaatctctgcatgattaccaaaaatgaatgaaaaaacaccaaagagaagttgttaggattgatttaattataaaggaagtttattaggtcatttttggaattaaaaaatcagatggtaagatttgcgattcaataaggtatctcgtgctttctcctcctctcttggggctttcctctaatttaaaatgccattaaatggactattggcatataaaagtgaatgtcataaaacaaaaattatgatggaacttattaattacttgggtatattagggccatcattcagctaccctgggctgctgttatgggcctgagtattccatataatacatacatgtgtccatttgttggattcattactcttgagggatacattcactacctgtgttatgtctctatgtattttatcataataagaaattaccacagaggctataatacttttggtacttgcgggaatgaattcctgtagaaagtagagaaaggggcaaatttacctttttttttttttttttttttttgagacagtcttgctctgtcacccaggctggagtgcagtggcgcaatcttggcttagtgcaacctccacctcccggtttctagtgattcccttgcctcagcctctgaagtagctgggactacaggaacatgccaccacgcctggctaatttctgcgtttttaatagagatggggtttcaccatgttggccaggctggtcttgaactcctgacctcaagcgatccaccctcctcagcctcccaaagtgctgggattacaggtgtaagcaaccgcgcccggctgtttttcttttctttttaaatttttttttaaatagtaaggatcaagcaggtgagttaagccacttttatttatttatttatttatttatttatttatttatttatttatttattggcaaggaaacagaataaagaggcagtcctggatctgttaaatagctattctattactcatcttaggcagccattcggactgtctaatcctttacaaccaatgtctgtgtggacagagagcttagttagccaggcaggcacggtgcttgtccacatcacgtcctcctgatggaatcttgcaggttcttccactaccagcctagtgggagccactaaccctttcctggtgtcctggcaagactgtgctctgtgggtgtgacagtctcccaggcagcgccccgcccacctctgccctgagctttaccattcctcccctctcctaagctccaggtggctgttccatagtgatgtcgcctgtgctggaaaaaacagccccagcagactccttccccagacaccacaaacagaggcttttctttttcttttcgaggtagttgcgttgcttgtgaaggaagttacatgcctttgggcaaacatctcagaaggaagtcttccattttgaaggttgaggggaaaagaaaataagggtaggtgggtggattaaaagataaaagtgaaaaaagaccaggtctctcattcatatgcaacatctgaatgacaagagaagcctgtgtttgtggaaactctgagagatggcagggtgacaagcatacaggttttgagtcagacgtgggttcaggtcctgggctgccctatactggttttttgactcacccagggagttctgggctttggtggatgctaccccagcctctttaccctggtggaaacggttctgaggtgcagtctacacagctctgcagatgggccctggaatgagccccagctgtacacagcagcctcgctttcacacctcccatgggcttcctgcccttcttgcctcactgtccctaccccttcctttgggaatctcggggtcaccttccaaataaacttctgtactcaagtccttgactcagactctgcttttaggggagcccgaatgaagatgctgagcctcacttttctcatccagaggataatgtttctcccctgcccctgtggtccctgtgagtttgggggagttcctgtctgtggcatgttcagcccagcgtttcacttggcaggaattctgaaaacgtgcttctcctcctcctccctcgcttttgcagcttcctgttttattaaaaattaccttgatttacttttgcaatgaattagaaaacagtaatcccattttttaactaaaaaagttaaaatttacggaaatcaaaaatttaaatgactttgaaaaacagtttttaatacaactttgaattataacttagcagtggccggccatttgagagcctgcctttccctaaatttcactttcccttggcattgctagaaggcaaccatgtacttgaaaagaaggaaagttctgtttgcttttccagagaagccaatcctttgcttgctataaaaaccaaatggctggctctctgggaaagaagacctgtttttttaaaatagaaattataagaatatcagaaagtagatgaaaaggaaagccttaagcacttgtttgggcttatgttgcccttccaagcagaatatttatagccccctgtcgagcacttaaaatgtgtgggggaccctgggaacaagctacacagagttcagggctttcagtcatatcctgaagtttacgttgcttaacttttgtctcttgatcagtttcaagtgggaaaaaaaatctgtctctgtctatatctctatatctaatgaatcttttactgaaagaagtgttagtcacagtggcaggtcccaggaagctagggggttgcttgtgggttgctattaaggttctgcttttctagaaaagaagcatccttgcagtatttgacattcattgatactaataatgtttaggaaaatgggtctcaaacttcctagtgcccaagactcacctgctgagcttaatgaaaatgcagattccagggttttgctgtgggtgcacctcctgcaagaggcttggggcagtgcaaccccccctcccccaccccgccccctttttttttttttttttttttttgagatgaagttttgctcttgttgcccaggctggagtgcaatggtgcaatcttggctcaccgcaacctccacctcctggttcaagggattctcctgcctcagcctcccgagtagctgggattacaggcatgcaccaccacgcctggctaattttgtttttttagtagagacaaggtttctccatgttggtcaggctggtctcgaactcccaacctcgggtgatctgcccgcctcgacctcccaaagtgctgggattacacgtgtgagtcactgtgctcggccgcaagccccatttttaacttgcgcaggtgtggaaagcagccttggagagccagcctctctagcctgcattggctggagagcagccccagggctggcgtgagcactcccgctgccccttggccattagtctacaagaggtggcctgaactgaggcagtaggacttactgtttcctgaggccttctatgccgaggttttgaggatggaatgagataatgtgtgcaaagttcccggcacatgatctctgttgcgcatgtgtgttcttaggaattgtgtgtcccaaacctccaccattgtctttcctcgtgcgctcagaatgcaggcagtcgactcttagctcacctcgtttattgctgggcccgtgcttggaagacaccatgttccatttggcaaatcgcttacactgggaagcaaagaacttccagcattcaccagcttcactccactatgcctgtgatgctctgtgaggagcggaagagacaggaatatatggagaatcgttgagggttcagtatgaagttcctctgttgcctacaaaatgagtgaccatttgattttgcctagaagggcttaaatttctgttctagttattcacagtggagagaggaaatgtccgtaggctgtatttgacttgagcggaaatatcatctgtaaaaactttttatggagagaattaattttaccactggaattccccagagaggccagtgttatttcagagccaacaaggcaaccattgaagggattggacaggccagacctgtttatactgggatcctgttaatgccatacttgtgatttgtgtatgaaaatcccttttctagtgtttgccatcttttgaaacattccagcagcttttaagaaagtctcattgggcatagagtttctgaataaagtctttatgtaaacactgaacttgtcgcattaatgaattctccatctataaacagccattaatcctaccttgttaggattggaggtgtatttaataggggacaaaaatagaaaagacctatgttcctccttccatttagacgatgtaaatccaacacaggcttaccagatgatgaaggtaattgcagcctgaggttctttttttagcctccacgccccctttgaatcattctttttttaaatcgctgtgagtagcgttgagtctcaagctaccagaagccacttcgatgtaaatttgctctttggaatgaattgctcttgggaatgtatgtgtccattatatagcttctcaccagggaaaagcattatagagccagctctgatgtggcaaacccacttatttcctgtttatgagagtgagggcattttggcttccatagcctgtttaggatgactaacagcatttagctcagagaatgctctgtttgtgtgtaaaactgctattagtgagtctggctggctgataccccagatttccagatgtaaaaacatattagtgttcctaaagatgagtggtactttttttttttttaaatcagaaaacaatctgattgggaaatactggttttaccaggacacagaactttggtctcagaattacgagtttgttttgtctgtgctgaagatcggtttcatttccaccagtgtggaagtgagcgtgtggctttcttttagtggtggaaaaaattaagatcctggatactaatttccttataaaacttagttttgtttgattctctttttcttattctcagtcatttatttattcacttgtgtatttaacagataaccttttgttaaatgtcgaaggtacataaaggtgaattacacattatttcatactctcaagaagctcatagttgaattggaaaacacttgtaaatcctggctccaaagaaaaaaaaaattgcaatgaagagaattagaggtcagaggtgggatttccactaatttttctgttttacaagagcaaaggcacccagaagcaaggcacagggctctcagcatcagcatcagaggacagtttctagaagggtttgtgtttgatctcagcgctgcagttggacaggccatggacctggaggtgtgtggtggggggatttggtggagggaagggcctttcacatagagcaagcaagctggaagacagaggctgcatgtagaggtcacgggaagaaaggttggaaagtctattggggccagattgtagaaaaccctgaattccaggaatttataacgtatcgttgcatgtatctgaaaaaccaactagctaattaactaactaatgaatattgtattactacttccccctgccttctataaaatatagagaacttgtctgctcatttgatggccactggagtgtgtgtgtgacttgaaaagcttgcccctgcctgtcacctctctgatcccaccactctagcttcattcctttggatcttaaagtattgtcatgttgaatgatcagaagccccttataaaataaatattcagatgttttagaggaaagagtgaataaaggaacccctatatgttctctgtaaaacctaagtcttcctcagcactgggaagccgtctccactaaagtgtggtcctcaccggtcccctttaggggtgaggtagatggattaacatcctgctggcctgtgacagggatggctggtggggaggggacaccccatggcaaagaggaccaggcagtatgagggtcaggaggagagatgttaaataaacgttcccagcattttgagtaaaaatcagtcttggcttttctctccgaacattaactataaatacaactttcagataaaaatctacagaagttctctgaagcacactgtgtgaaatatctgttggctctgccacttttgatagacatttgagagtttgggatgccaggcaggtctcctatgaaggtagagtgagccggctctctgtgaagcagtagttctatgaaactattggctgctgagaagaggaaactttacagcctgttacataaggaaaaggaaaaaaaaaaagatctcactttcctgtcggtgttatgagtactggctgccaaatggtgcttgtttgtgtttctatttttttcctccttcttttgtaaggggcttgaaaatgaattctatttctcactttattcctgcctatgaaggaagtgagatcattgggaaggaccaagtatgaaaatcttctttttagctctcgtgtttagagataactgtattgtgacactatcttcgctttttcagattggtaatacatgcgcatggtacaaaatgccagcagtgtagaagggtaaacggtgacagctaagtccccctaagctacatcgggcagtggtgaagagcatggacaccatctgatgacctggttcaggtcctggctccagcctctcctactcactagctgtgtgaccttggacaagtcacttaacctgaaagctcagtttttccaagtgtaaaatggtctaggatttttgtaggagcaacggactagtatttggaaagcaccagatactgcctggcacgtagtaaatgccatgtaagtgtgtgttgaatacgcagatacattcctcctaccctgttcttagccatgcagtgtctcttccagaggtcatcattgttcttagtgtctttctcatcctggcctggagaattctaaatattggggaaaattggctgggcgcggtggctcatgcctgtaatcccaggactttgggaggctgaggcaggccaatcatttgagctcagcagttcaagaccagcctgtgcaacatggtgaaaccctgtctttactaaaaatacaaaaattagccaggcgttgtggcgcacacctgtagttcaagctatcactcgggaggctgaggcaggagaatcgcttgaacccaggaggtggaggttgtagtgagccaagattgcgccactgcattccagcctggatgacagagtgagactctgtctcataaaaaacaacaacaaaaaaaaaaaattggggaaaataatggggtatttttctgccttgtttttactccattgtcttagtacatggctatggtggagagaataatggcccaccccaaacatgtccacattcgaatccccagaacctgtgaatatggcaaaagggattttaaatttcaaaagactttgaagatatgattaagttaactatcttgagatgggggatggattttcatggattatgtggggggcccagtgtagtcacaggggtctttactggagggaggagggtcagaatcagagaagtaaatgtgatgagggagggagagagttgacagccacgagccaaggaatgcaggcagcctctagaatttggaaaagggatggaaagagtcctcccttacagcctccagatagaacacagccctgtggccttaatcttctgattttcagaactgtaaggtaataaactgagtttacatgtcaagcaccatgtttgatggcagaaatacaaacatgaaaaaaaaacaacacagttctggtattcggggtgccatggtctggaggcagacgtgtgtacagacagcagtcataatccactattgtcattactctagttttacagttcttggacttgtcggtctctttctggacgctttactgttaaaaattattgagggccctaaagagctttagttatgcgggccacatctatatctattgatattgactgtattagaaatgtaaactgagcaatgtccaaaatgtttgtttaacataacaatagtggatccatttttatgtaaacacaataaacattcttttaatgaaatgtctcctcaaaccaaaaaaaaaaaaaacttagtgagtagccttattttacatttttgcaaatttctttaatgtgcatcttaatagaagaaaactagattctcatatcagcatctacattcagtctgttgcagtgtattgctttggtggaagttatttaaagaaaattcattcttatacaggtacatgtagttggaaaagggaggagtattttgatactcctttcagacaactgtggatattctttcatgtgttcccaaactcagcaagtggccatttcttcaaggttggttgcaatgcggaacctgaggcattattggtggacttttcttatttggtagcattaaaattcattggcctatcttgtacttggaatagatcttttactcatgcgtgatttcataacatgcattgtttatttggaaatatggaatcactaagttatgtagatcttccaaatgtggacatttcatttcacagtattaaaaattactttcaggccagtcacggtggctcacacctgtaatcccaggattttgggaggccgaggtgggaggatggcttgaggccaggagattgagaccagcctgggcaatgtagtgagatcctatctctacaaaaaataaaaaattagctgggcatggtggcttgtgcctgtagtccaagctacttaggaggctgaggtgggaggattgcttgagtctgggaggttgaggcttcagtgagctgtggattgtgccaccgcactcagcctgggggacagagcgagaccttgtctcaaaaaaaaatgtcacactcagatctcattggaaaagtattgggaagctcacggtggcagatacaaattttccaaaattctgatttttgttggacagtttgaattatatctaccaataccgtcaggctcattttgttcattttaaagaaaatgtttttttctcacctttattttccaagtaaaaattgtggttcttgaaaaaagacagttagttccgctcccaacacagttgtacatatgtttttcctcaatgctacgattgtgcttgggtatgcagctgacgagttgtatgtgtgcttcctgaacatgttccaagggtggaggtttaggaaaattaccaatttttgctgctccattgaggacattcttaagtgaaactggcgcatttttaaatgtaagagtgtggcaatgaagagcgcaatggtgctgagcacagtttggtgttcctgccttatttgtgctgagacagcagcagatgctttgcaccatcagtgcacatgtcctcagagagcaaaaggcaaatgacatttgacatttgacatttttctgaaaataattttcaacttgtggactccctggaagggtcttggtgaccccaggagtctacagaccacacctggagaagggctgttccgatacatatggagcagcaacacagaggagcagaaaactcatgttccaggttgatcagggccactctccagggagggtctcacctttgttaacccctagggaatgagaaggtagatgagggggcatagagcgttccaggcgcagagaagccgggaggaggccggggctgtctagctgtggggaggtgtgtgagtaactcagatggttggagactcaggtgcaaatggggaagaggagaaggtagggtgagacaggtgagcagggccaggtgacaaagggtccacggagctgcgagcagcctggatgtaaagatccacagggaaaagatgatcagggtatggtgggtcagatttgtaggttagaaagacaggcagccccggtgccagccagggaagggcattgcagctgctgctagtcctctaagagatgaccaagggtggccaggcaccaatgggctgagaggtgggtggcacagcatggcaggcagtccctgcccttccctccctcagagcacataggtaggaggagatactctgtcctcctcctttacagggactctgtcttgtatttgtcaccaataaatcactgggcacataagtagagtcattcaacaaatatttgcttgaacatttgaacaaatgagtagaggatataggaacaacaagactcagaatatgagaaagaagaaaaccccaggtcttccgctttaaacatttcaacattgacatgatttggctgtgtccccacccaaatctcatcttgtagttcccttaatctccatgtgtcatgggagggaccaggtagaggtaattgaattatgggggcggtttcccccatgctgttctcatgatagtgagttctcattagatctgatcattttataaggggcttccccctttgctgggcactgattcttcttgctgccaccatgtgaagaaagacatgtttgcgtccccttccaccatgattgtaagtttcctgaggcctccgcagccctgcggaactgtgagtcaatgaaacctctttattttatctattacccagtctcaggtatgtctttattagcagtgtgagaatggattaatacaaacattaactttatttttcaacaagattctaaggcttaaggtgtgcaaaataaaacttgtaactaagaagggagctgtggctttgtttatagcttgagattgaatccgggtgcaaataatttgagaagtttttgccttcaaggtggaaaatgaacttctatacttaatcctgaattcaggcacataaattaggtccatgacatgagatttgcatttttttaccccatggtaggtacccatcgcctgtgaagatcacactgaggccaagctgagaaaccagtgatctctggagaaaaatatttttctctcattttacttttctctggtttatcaagtatttagttactgcctgttgtgtcaggcattgatctaggagggctagagataaacagtgaacacagcaggtaaaaaagcatccttgcccacgtggagcttacttgtattttagtgtgtggacatacagagtaagcgggaacctcacaattaataagttatataatgtattcacagatgataagtgtgacggaacaaaaattgatcagggtgggagggatggggagtaggggccaggctggttgcagttgtgcatagggcaggccggtagtgctcagggaacaatggacacctaggagcacaggcttgtgggaggtcagggatggggccacgtggccgtcagggggcaaagccttctaggctgagggaacaatcacatgtgccccgatgtggcctgtttttcggcaggtgtgcctggaagggcaagggaagagcagagcagtgagaggtgaggcccagaggaagtgtgaggccagatcaggctgacctcaaagaccattgtgaggtccatttattggagggaagggagaagccgttgcagagaaggaggagcagggaagtagtgacatgatctgacgagtgattggtaaggatcactgagtgttgctgaaaatggactgaaggaggcagtggtgcaacagaggctttgccgtcacccaggcgagaggtgagggggtggagtctgcttggggtggtggcagtggcagtagagccaacagagctcgcccagagactggaaggagagggatcagaggtgacccccaggttttggcgtgagcatccagaaagttggagtttccatcagttaaaataggaagatgggtgtggagcagctttggggaacgatgaggaattggtttgggaactccttgtgtttaacttctgttcatgttgaatatttcacctgcttccaaaaccgttttgaaatgaaaactcatctataaaattccataagaggtatcaaaattagcaacagaaagagaaaggggggaaattttaaaaggcatattggtctttcctctagattggatggtgttgggaagcgggagttactcaatgattgggaatcttaataatcttacctagaagatgctctaaatggtaaatgaatttacaatgaaaacgttatctataaaattccattaaattcatcaaaattagcaacataaagagaaagggaggaactttgagtgacacattacccctttaaagatgtccactcatagtgtaaggcaaacacatatttgtttataggagaataaatcaataggctttgaaatgcaaattgtagcacatcagttcctttcatttcagacaatttagttctgatctgttgtaccttataaatttatttctgccctaccatactcagctatgattatttataaattatccaatctcatataaatccatttatctgttatcctttcttgcatatggctgttaacatctttaacatgtcgtgggaaaatgtgacaaagttcaaattatcccattttgttacttgttggtagctctggagaaggttatttggaaaaaagcacatgaaattgttaacaaaattattgtgtatcttctgttaggagccctggccagctgccctggggagtgagcaggtgctattccacagtttctagagtggcaggatgccccctccttccagaagtctcccagtgggcttgtgccaaatctggacttcccagtgaagcacttggaaactgccgaatgaaaggacatgtgatcctccacattttaacatttttctttccaaacactagttattttctcctaaattgccatttgtgaatctaattctgtctttcatgtttcagttgatgaatggccatgccattcttttgtgaagtttaggcatcttcgcatagcagtattagcaacattatttgaacatttattgaattttgtcattattattttatacaaatgattgaggaaaaatgggggctgaaaatgttgataagaagcctagcttttctaagcttaattacccatgaccccgaaatgccagtcaccgcatgtgtccagccagcaagacattagctccatatggatgttctttgaccttgaatgtattggtctgttcttatgctgctaatacagacatacccgagactgagtaatttataaaagaaagaggtttaattgactcacagttctgcagggctggggaggcctcagaaaacttacaatcatggtggaaagggaagcaaacatgtccttcttcacatggcggcggcaagcagaagggccgaccaaaagggggaaagccccttgtgaaaccatcagatctcgtttgaactcgctgtcaccagaacagcatggaagtaaccatgcccaaggttaaattacctcccaccgggtccctcccaggacaggtggggattatgggaactacaattcaagatgagctttgggtgggaacacagccaaaccatatcactgagcaagtcagtatgtgttcactggggaaagaggagaaaattaatacatgtgctaggtctacttaaaaggtgcagcacaaatagaagttttatcattttttgggatctctgggagtagaagttcacagaacctgaatactcacctttcatgcttctcttttacaattgtagtctgtgagaagtgtggggctgcttgcatgtcacactggcggaatcttgggctcttcctcttttgaactctgaaggcattttgtctgtatggctgatatgaaagttgccttgcaatatcgctcactgtgtgcctgtcctaattaacctactactgacaatcccttgaaaacagggactttgaagagtgtaaaggatgtttcagacacagcagccagcacaattcttgataaaaatagcaggcattgagtaaatagctattgagtgaaaggaaggttgttagaaatctcttaatgaggccgggcgtggtggctcacgcctgtaatcccagcactttgggaagccgaggcgggtggatcacctgaggtcaggagttcgagaccagcctcaccaacatggagaaaccccatctttactaaaaatacaaaattagccaggcatggtggcgtatgcctgtaatcccagctactcggaaggctgaggcaggggaatcacttgaacccgggaggcagaggttgtggtgagccgagatcgtgccactgcactccagcctagacaacaagagcaaacaagagcaaatctcaaaaaaaaaaaaaaaaaaaaaaaatctcttaatgaaagttaaggcaacgttcttaagaatgaattatgggggataaaaggaatccttggaacacatcttgaggcttccatgatttcttctttataaatctgatgcaagggaatggtgccgagactttcttgagccgaggtctccatcagtggcacatgtgtggagggcaccctgggatggcccatggctgtggtggtggagaaccacatgccccagctctggagtcctactgcatatcctgggagtccacggagcctagctgctggctcacgtctgtgctgctctgcaattttaatgggctaattggtgcccatgacagttaatttgccagctaaaccaaaaccacaactaaaaaaggacagtaacttctttattttttttttttaattacaaaaaaagtttttaagacagagtctcgctttgtcacccaggcaaatggtgcgatctcggttcactgcaacctctgcctcccaggttcaagcgattctcctgcctcagcctcctgagtagctgggactacaggcacaaaccaccacacccagatgatttttgtattttttaaatagagacagggtttcaccatgttggccaggctggtctcgaactcctgacctcaggtgatctgcctacctcggcctcccaaagtgctgggattacaggtgtgagccaccgtgcccagcctgagaacagtaacttctatatcaccagtataggccaatagtgacagtgagttgtgttttaatttggggatagtaacatttgtaaaagactatgggtctcaaataaggtctcaaatggattctagttcctggctttttcgtctgtgaccatgggcaggttactataactattttcttgactcttaaaacaagggatgaggcaaaatagtttaaaattttttccttctctctctgaaattcttgtatttaacgtgattgaagtgacaatataagaactacaggagtgtacatttcctccaaaattttatgaagcgaaaaaagcaaagtaatggatcaaacattccattttggttttgcagccagtcccattccctccttaaatagagtcaggtcttgactgcggtagagaacgtgtttgttaaggcttcctaataatagcaggctgtctcaatataaagttcacaaagaaccttaaaaacatgaattatccctcacatcaccctgatggagcagagatgtgttattatcattttactttcacagctgggtaaatcaaggtatagagacacatcaagcctctggtagcttggacaaggtcatagtcagtggcacacacagatagaactgtgtcttcctgtttttccttccatgtagggaaaaatgtctggattttaactgcttttttttccttttaaagatttatctattaatatacatagagtaaaacccagttataatttgccttgcagtaaagcaaatttagatgtgatcggattgctgatagtccttgtcttctcatctggattcttatctgagggttgggactgatgatcagaaaggtcttgtgatcatctggggctttctcagttcagggaaaggtcagttatttacagtcatagcttcgctatctattcttgttccttttttgatggttcatacagattttcattaaccttgcaatcatgtggccatatatttcctgtgatttgtttctttggaaccctcttatggtggagttttgctgttaattctaatttctctcctgtaatatctaccctgacttccttatcttctttttaaaaaattgaatagaattaacatactatacaatttaccttttacagtgtaccattcagtggtttttagtatattcacaaaattgtgcaaccatcactaccgtctaattccacaatatttttattccctcaaaaaagaaacctgacacccatcagaagtcactcttcaaggccagggtcagtccctcacgcctgtaatcccagcactttgggaggctgaggtgggcggatcacaaggtcaagagatcgagaccatcctggccaatgtggtgaaaccctgtctctactaaaaatataaaaattagctgggcatggtggcgcacacctgttgtctcagctacttgggaggctgaggcaggagaatcacttgaacccaggaggcagaggttgcattgagccaagatcgtgccactgcacaccagcctggtgacagagcgagactctgtctcaaaaataaaataaaataaataaacaataaataaataaaaataaaaaaagaagtcactccttatcctccacgctccaacccccgctcctggcaactatgaatctactttctgtttctatggatttgcctattctgggcatttcatataaaaatgaaaatacaatgtgtaacctgtcatgtctggctcctttcacttagcataatgttttcaaggttcatccatgttgtagtatgaatcaattcttcattcctttttatggctgaataatattcaatttcgccttcttttaatccaagagaaccgtagcacttactgaaaagtgtcctcaaattttcttttttccgtagaaactttctctaatagaatctcatgtgtacttttgtctaggtttcttctcaaagtctttaaatagaactccagctaagtagttcctaagggctttgaacttaaattcaactttattaaaattcttggagtgtttgaagtacggtattgtctgttacatgcctgaaggtaagtaagtgtggcattggggtgtcctcccagtactagtgggtgtccgtttccttgcagtgccaagaccttggctgaagatctctctcgtcattgactgtgtatttttcactggggctcataaaaccccatgggaggctctgcaccttctttctttgggttaagcacgctgcctcagtcactgccatagcctgcctggcgaaggaagatatgggtacatctaaacgctctttttcgttgttctaagaaggagtattgcagtcagtgtggaggtggctggcagcacctttctactgtgagaacatctgccatgttcctttatgtattttttcccactctaaggacatttatcacaagacaattgaaacagatcctggcagcctgctattaagaaacatttactaccagcatttactttactgctctctgtttattgccggtgttagcttgcattgtcaaaaacatcaccaattggaatgtgacctcaggttaaatggacttggaagatttatgaatctttctagcacagtatttgtgctataatagaatttatttctttgcaagcttaacaataacattcagactgctgctttgaatttccctgacatgagtcataacaataaaaaaaaatgcaaagtcccagatatggtcagaagagaagactgatttttatctatattaagagtaggtaataataaatggtgatctctttgttaatggtgcagtttgggacttgactcacctttgaatgtggtcaactcaagagttactttttttttccctctcagttatttctattatttcatttaaatgctttgttttcattctctttcactgactgatgatcagaaatatttgcctggatggcacagtacagctaatgtcattagtgaaaggtggcacaaaccactgcattttaaagtaaaagtatgagtaaaattttggacaatctgtgttacttaaaaatatgcattgctatacaaagtttacaaatttaaatttatttagaagaaattgttttaaaagcaaggtctcactctgtcgcctaggctggagtgcaatggcacaatcacaagccactgcagcctctacctcctgggctcaagtgatcctcctgcctcagcctcctgagtggctgggactacaggtgtgcaccaccatacctggataactttttttttttttttttttaatagagatggagtctttccatgttgcccaggctggtcttgtgaactcctgaccgcaagcaatcctcctgccttggcctcccaaagttctcggattataggcatgaatcacctcactggccacaaagttaaatttaaaaggagagattctggctgggtgccatagctcacgcctgtaatcccagcactttgggaggctgaggtgggtggatcactcgaggttaggagtttgagaccatcctggccaacatggcaaaaccccatctctactaaaaatacaaaaaaaaaaaaaaaaaaaattagccggatgtggtggcatgcacccatagttccagctactcaggaggctgaggcacgagaattacacctgggaggcggaggtcgcagtgagctgagttcacgccactgcactccagcctgggtgacagagcaaaactctgtctcaaaaaaaaaaaaaaaaaaaaaagagaaagatttgcaaagattttctttgcaaatgttcaatgtgctgtttgtactgtgagaactggctgtgagcattaatgcagagttttgtaatagtgggtgaagcttgaagaattgaaaaaaagtcttaattttctatttacataatgctattatgcctaggctggcagctttgatttacccaaattttaatcttttcttaaaattacatttgtactttttttaaaaaacaaaagatacataaaatgaaggaattgaatagggtgatttctgagtttcttttctgatctaaaattctttgattctctacgagtttttcatttatggaattgcatagcataaattctgagaaactgaatagggaaactgagtaaatcaaatagattaatagcataattcaaataaagtacgttattttttctggatgtcagtagatagtagaatgtaagtattaaatgtcagagacgtgtaactctaatgccaaagtggattatgtagttgaaaacttaattaaaccatttattattcacttgtaactactttgacattattttttagatttttttcagtcttagaaaattattcttctgtagttttcacatcagaaggggtttctaaggattaatgatttaatcaactaaaaacattttttgagcctgagatgagagtcccactgaaatacacttcattgttatttggctgctatatttttaattgctttagtgagtatattttatctttctttgggaagtgagggaaactaatactcagagggtgcaaaatgctatgggttggatgcattttgcatcctctgatgccacttgattctcttagaggtaaagttgaggtcctggccacggggaggggcagaggcaattctcagaggtggtggcgctgaccaccaggtgacattttggaagtttgtgtttctgtttttggtcatcataatgattccagggatggtgacgtttggtagttgggacatggttgctggacatccggcagtgatcacgttaatcccatacattgcacattgttcgactggaccttaatggaggttaaaaaacatgcatataattatctgagctaggaattacctcgattttacaaagaaatgcaaattattttttccccacagctataggtacttggaattttctgggaagatggcaacccaataaataaaggaagtacatcctttgttttgctcagaactttgccaagagttttgtcattttggaaaatcatgtccctgatggtcataccaccaagacacactggcattggtctctggtgaagcttgggacaaggcctgtagagccagtggctgacagcttcctcacggcttctggagaggttctggtgccatttacatatggagtataattcaaacaaagtattcaaaccatagtttttaattataaattactttccgtttatttttctttttgtcttatttttagggtagtatattgcttttggagaaactatgaaggtagattatattaagaatgatttttatttcaggatagtaaaagtatatattatcaaaaaggaccctttggatatgagagtattaaaaatcaatgtactataatatatgctttgaagcatgaaaaacatattttaaaaacaattttcattctcatgcccgatacttttagtctatttcaaatgaatcctcagtccgcatattgaagcacggctttttccgatgcggtgactgctgtcttagttcattcgtgctcctgtaaagaatagcacacactgggtaattttaaaacaaatttacaggctcagagtcctagaggctgggaagtccagtgtcaaggtgccattaggtttggtgattctgattccaggatggcaccttgaacgctgcgtcctcattgtggctgaaggtggaagggtaaacagtggaagagaacagagccactcctgagagccctttttatcatagcattaatattcatgagtcatgggtagagccctcatgacctaaacacctcccagtaagtctacctcccaacaccattgcattgagaattaagtttccaacatgtgaattctgggggatacattcaaactatagcaactaccattattaatttctaaaaaaaaaaaaaaaaaaaaaaaaaaaaaaaaaaaaaagtcatcttgtacctttgtacctaagaagagaaaacaaatgttctcctgtcactttgcatttcttgtttttggctatggattaatatcatgttgaaattttaaatttaatttctctttaattgctgttccggagaactggggaggcactctcagactttggggtggagtggttcttagatcactttttctaggaaccagttgtctgtcctcaggaggccccatcctggctgctggaaaggcaggggaactcttccctacctgtccttacaatcaggagctgcctggtgtctccagggtctgctggcggccacctggtgggtgtccagggactacaaagaactttcttgcctagtctcttgctgcctggttgagtagggaggaggctgccagcaagactgggattatgggatggcatcagccagatgaaccatacgtagctgcctgaggagagtcaggcttccttaggattaagctgcaggtgggatgctggcagggacaccaccacgcacgccaggccttctcccaagctttccattgctgcccgtttccaagaattcccccttgagcctatcacagtgagcacctagatctattggtgctttctgggcaacaggaaaaagaaatggcaaaacccacacgtttgcatattaactgtgctaggttggatttggaaatgatgtaactgtacattttgaattcagattacgagctgtgtgggtgagacaaccttaacttcaatatttcctgatatttctgtttttaagttggtacccaggatgtccctttaacaaatgttttgccctttcgttgtaaaggatctggggttgccagtgacttggctgacagtggtgctaatgggccaggtactgacgcacagttcaggaggaagctgaatgaccaggtgtctcaaacctaaagccagatgtgttccccagttgtctgtaaggagctataggctgtgcggaagtgtagggaggcaggcattttccgtggtagcctgcctggactgtcatccttgtccacagcatggtttttttgttgttttgagatggaatctcgctctgtcgcccaggctggagtgcagtggtgtgatctcagctcactgcaacctccacctcccgggttcaagtgattctcctgcctcagcctggggtacaggcacccaccaccaggcccggctaattttttgtatttttagtagagatggggtttcaccatgttagccaggatggtctcgatctcctgacctcgtgatctgcccccctcagcctcctaaagtgctgggattacaggtgtgaaccactgtgcccagcccacagcatgttgattaaaggagagagatggccgagcctggtctcgtgattgctctggccgtggcaccttgtacttggtggatgcacagtgtctggcacccatgggaattaagggtaaataaattaaatgacacatccaaattgaggggaccagactgtaacttgggacattgcagctctgctggctcaactgctgagtagaagctcttgttggctgtgctaaatgttagattttttcaaattgctagacctctgccccaaactgttaatttccacgagaaatgtgatgagaaagacaaaagggtatattaaccagatacaaatagataactcttgacttgaatttataattgatttgcagtcatattggccagaggctttttctggagtgagtctgaacatctgtactgtgcaatgctgagttcagggtgggcaggaagcaagtgcttattactctctgataaggacaaagaacccctaaaacatgttgcactgtatatgtcctgatgaggctcttccaggtgggaagccagattttcgcctgggaggggcaggatatacttactccctttagcagctggtgctcaggatgtgggcagaatataagggggctatgtataggcatttggcacccaggacaggatgcctgtttcaaacagctttgtaaataagcattcggattttaccagcctccactctttttaaagccagtcttctattcttccagaatgtacttttatctcatgtctcttctataaagagcactaagggcaccctccttttacggggatacaggtcctggtgaaattggaggctcccagagctggggatggcagctgtggacactgtccagctcggattctcctgtgctccgtcatgtccaggacagtgttggcacattgctggtggctgcagggactctgtatgcacagatgcattccacctgggggaaacttgggcagtagaacaccgctgagatttcctgtcttggcggatctcaggaactgtccacagctgccttctcttctcagatccccagggccagcctcagtgggagctggttcctttgggccatcctatccaagcctgtgcctcagagaaaatccggtggcacccaaagtttccttgaagttaaggggctctagggggcctaagggagcctcactgattcaaagctaagcctttatcctggagtgagcagggttctgacaggaaggggtcagtattctcttaccaggtacacgttgccccctttctcatgcttacctgaaacgaatctcttcttccctaagtgaatgagtacctccttgtctcttttataagaagcgaacagtggttcggggagttttcagtgtttaagttccaaaatctttgaagagattgactcagatgactcaggattcacttggcacccgcttttgacatcagccatgctatattttcactagcatccatctggcatcttgggctccaaagctccttatgcccttgccacagctgagttcttggtgggactcaaggtcttgttcatctttgtatccctagtacttagaacatgcctgatgtacagcaggggctgtgaaatccccatcatcagtgaatgtgcatgtggatcatatgtcctatttcctgtacttgatgtaactctttggaaataccaagtcttcttatttacaaggtaaaggcagcactaatgcaaatttgattctgtaacctaggtaatgcacttttacattgtatggcttctgtgacatgactcttttttgacggccttatacttctttttaaattctctatgaaaagaaaggtacctctcttgagaatcaccccctcctgtacccttatgcactgatgtttccatggttctctcctcggtcctcttgatgtcatccacccccttggcttcactgctatggagtgatagtctgatgacttccaaatccatgtctctgtgaaggcctttctgggctttggactctggactccccgaccactgaaaatctcccactgcatggcccacatgtgtctcagactcagcattgcagaagctaagcttgttatccccacttctccccttgccgcattccccatctacccagtcacctaggacatagaaaccaggcgtctccctcgatgcctctcttttctgtatcttcttatatttaataagtgacaaagaggggacccgtagaatctacctcctcaaatgctcaaccatcccttttttctgttgctctcttctgtgatcttctggtccttacaccttgtacctgtgatgtcactgtgactttcttgtcctccatccatccgtccatcgaggacactcttccatctctgccccactctgtgcagccacactcggcaagttccctgatggtgcccggctcctcctagcattggcctttactcaggacacttccagtcctggaatcccctctccccgctgcccaccccgccttgtcatcttcagcttgaaagtcaaataaatattccttcgacataaaggctttgctcaagtgtctgctctcctttgaagtgttttaagggcccagggagaattaacttgcttcctgagtgtccccactcagcagcctgtgggctttcctcatatcatctgtgacccttggttgcactcatctctctgcctccccctccctcaccaactgcctctccccagattagaagcagcccgcgagagcatttcactcctttttgcatccccagctcctagcaccgtgcctggaaaacagctgctactcaagaagtatgtgttgagcgcatgaacggggagatacacttaggctggatacagtaggattgagggctgctgttcttttgtgacttacctagattggtctcccttaagccaaggtatacacatcagagaaaggaggcagtcttaaaggacagcagtgggtcacttgtggttgagggtctcatcttacttcccgtgcagttagcttgttggtgaggggactgcctctgtgttgtggcattaggggactagaggaggcaggcccaagtctgcttgcttgtcatggctactcaaaatttccccagggacccttcatgcctttcgggtcagcactgccttccctaggctaagttaactctgcaaccaacaacagtgaggtatgaccgagattatctgtctggtccttacctggatgagattagggtgtcggaagaggtaatggaagaaaaaaattggagctgcagaattctgtagatcattatatgttttccggaggccttcccctatcttagaagtgagtgcctgtgtagtggttggtaatatcagcatgaaccagctactggcattcttgtctcccagctgtcccaacctccaggggttcccctagcttctaaaggttctccagaaaccatcttccctgcccccatcatgctgggcagtttctttgtttgcaagtctatccaagcctcttgggcctagatcagctcagattgatttcttgttgtacctaactgggatcagaaaccatctggtttcacctagttgaggggacattctatcaaatacaagaattacaatgaaaacttgtgttatgttttgatagaggctggtctttctgtctctattggagaagagtgctgaggatgggatgtgtgcttccagttgtaggctggaaaactatgtgttctacttatttcatattatttaaattttttaatgttttaatttttaatttacttaaattttaaattttcatttttattatttttatattttaattattaccccctccccttccttcccctcctctttctttttctttcctttcttgatagggtctcattctgtcatccaggctggattgcagtggcacgattactgctcactgccgcctcaaactcctgggctcaagccatcctcctgcctcagccgtccaagtagctgggattatagccgcataccaccatgcctgattgtgtgtgtgtttttttttttcaatttctcgtagagacactatgtagtctcactatgttgcccagggtggtctcgaactcctggtcttaagtgattctctcgccttggcctcccacaggcctgagattacgggcatgagccaccacacctggcccatattatttcttagcctttactctggaagttaataagggtttactgatcctcttgggactttcaagttaggatgaaattgtggttgatgccagcacaagaaacatgcttgtaaatgagcaagttgtagattggaataagtataatattccatcattggtttccaagattccctggtaattttgccttcacttagccaaaaacagggaaataccaacaaagttgttgctgtttgattgtaggtccaaataaattagttaagaccagagcttaggggagcatagttcacacaacaacgagaagagtgacaaggtatttaggtcattattttgattggtctctttcgaccaaaacaggcagatgttgccttttcaattagcaagaccctagatctgtttcagaagcccatctgtatgcgtaattgtaacctcagtgtcattcaggactgctctgtactgcctcctaggttgttttcttctttcctttctccatgtgagcctttaaaccgggtgttattattctctgcaaatggccaaactcatatatgtttttgtcattttttatgcagatttcagcaacgtccctgatatcacaacaggtctgaaaaggagtcagacagatggcactctggatcaggtttcccacagggagaaaatggagcagacattcagggtaagatactggcccaaatcgcaaaccaagaaccaggcaggcgagtgttagttcccacctttacctaaggtggggaaaggagatggagttacctatctctaggtccagcagttgatacaaacatacatatatatgttaaggatacagcttccttatttatgtatttttttgaagtgaagtactactaatcggaaccatttgctctagccagaactcctccatgacttctggtatgccatcaaagagcagtgcacactctgctgttcatatattgtgctggctttgcttagcaattttgacaaggaaaaccttgtcaaaaggtgttaattactaatctctttctttcttacttttttttttttggctgaagataaattatttttggaatgttgtcattttgtgtgataaaacgtatataacataaaatatgccttttttactattttcaagtgtatgcctctctgtggcattaagtatattcacattggtttgcaaccaccaccaccatctagaactttttcatcattccagacagaaactctgtaccccttaaacaataactctctatttcccctgctttcaactccctcataacttctattccactttctgtctcatttgccaatttctaggtgccccatatattggtggaatcacaatatttgtccttttgtttctggcttatttcacttaacatatgtcttctgggttaatccaggttgtggcatgtgtcagactttcattcttttttatggctgagtaatattccattatacggatacaccacattttgtttattcattcatctgttgatagacacttggattattgctgctgttgtggataatgctggagtgaatgttggtgtaagagttatctgcgtgaatccttgttttcaggccaaggagtggaattgccaggtcatgtggtgattctctgtttagctttttgaggaacagcccatggtctcccacaatgctgcactatttgacattcccagcggcaatgcaggaggcttctacttcatccacatccttggcagcatttgttacattccattcctttcctgcatttttaactgtttgttgtcagctaccctttcagaaatggtctgattgacataatctgtgttaatatccagtccagttttaatcgattttgaaattataagtcttctgtatttgtttttgtcttaaatacaaaataagaatggaagaaatagaagcaatgataggcatttaaatgaaagttataaagtggaacgatggctcggttgggtttagactaacactatcacaagattcttggggtatcacttcaccagccggaaacctctgtggccaagggtgcttttgcccaagttttgctcgggcccactaggcccactcggcccactcgacctggcaggctgtgctcaacttgcactactggcctgcatcccatgcctgccaagagtgagcagagtggtgaggggtgtgtcagtgagcgcagtggtgaagggtgtgtcagtgagcacgtgtggggtctggccaccacacacaggcaggaatgctggctgtggtggggcaggcagcagctgcaggctctagcacgggcgccggttccctgtgaagctacggctggatcacacatattacaagcagtttccatggcctgcatcagtacctggaagcttggagatgccaggaaccgctgagccccaaagagggtggcatagccctggttctgggaactcctaggtctgggctccctgaagggctgcagctcttctctcctcctcttttctctccttgtcacctgtaatgtggcgagcaaggggcgtgttttggccctgtttgtgttgtagctctttcagccctgccgttaggcaggtcccgaattcttgtcccatgaccaggaagaaggaggtatgcgggcaaggggagggtgagcaaggtgaagaggagctttattgagctgtagaacagctcagaggaaacccacagtgggtagcttctctctgcaggctggttgtcccatagagtgttcacctctcagcagagagcagaccctggagtgggtagctcctctccacagctggtagtactaatgtctgcttagctttaagcagagaggagaccctggagtagctcctctcctcagctggttgtctcattgtctctttgagtctggctgagtccagggctcagaggggtggaaatgtgcactgattggtccatagtggccatgagcagacccagaaaaagctccataagttcccactctggtctgtgggactggcagcccagcccccagacttcaggccttccccggcttgaaagtggggcttttctggggacccactcctttccacccaggagcctgtctgcgtcctgccactcttcctggtgcccaggctgtttgtgccaaagggtgcctgcaggccagggccgagctgccctcagtcccctccttggcctgcctcccatgctcattggtgcccaaagtacagcagggggctggcatgtcagcgctgccctgaacgtgtccacacatggctgggttgcagcagtgcctgggcttggactcaactttgctccaagagcagagcgggcaccaggagtagggagaaaccaggcagtgggagcaggctactttcgagcctgtgggggcaatgggtccttcctaggcccctgagagtgcagagatgtctgggtccacagtcgcggctacgtggctgcagcagtacccgggagggcggggctccttcctgctcctggcccccaagaacacagggatgtctgggtcagaagccacggctgggcagtcacagctgtgcccgaggagcacgaggctcccgccctgccacttcaggattgggtggggcttccacattctcagctcctgctggctccatggaacgcacagcgctggccgtgcctcccccggtgcagccggcatcatcgcagtgactgttccagatgggccaccgctgccatcaagaccaccaggagccaggcacatggcacatcctttggaggaaccatgtggcataccttttgggggttggtgacatcccctgtgtgtgagggaccaggttagagcctgccagcttcagaacggatgcttctggttccgaagcagctggtttgatgaagcagctatgggctctcagcctcccctctcttctccctttcacttcctcactacctgctctcttctcccgttttccatgcaccttcttccaaatttctcctccctctcctcctcattcctcatgcaaagcaaatgctcagctgccttcgctggcctggttatgtcccaggatgcaagttattttacaaaactgaaattcatcagcatttttagtccttctactttgttctatctctagtgggttatttaattttgggaacccaatatcatatctaatgttcattagctttttaatgaagcagtggatcctagagcatcaaatagatgtgttttgatagccttgtcttaaattatttttaaatcttattttaataatacaatagatatggggtctcactatgttgctgaggctggtctcaaactcctgggctcaagagatcctactgccccggcctcctgaagtactggaattacaggtgtgagtcactgtgcctggcctgacttaaaattttttagaaaatcaaatcctcctgaaacactgatagagcaaggccatgtatttaaaagttaagtgtgcctgtgggggccctggcacaggatggtagcttgggggactctcacttaacaccgtgagggataacgacttctcgtctcttatgatctgcttgagttacacatcagagctcttaagaaggaaattgaattttttcccaaagtttatcttaagattcagcaaaatagatatgcaaaaagttagcacgttaaggccattgccaactctgttatttaacaatgcctatggtaactaagcaaaacatttacaaagtgaacattggagcatcagaaatttagaagaggagagaaagctgcaatcaggttgaaattggggccgtctgagcttcaattttcattgttaaaagtggagaaaggagaaagcaaataataacatcaacgaacacagaagaaaaaattttattgaaagaatatgagcatgttaagcatttgctgtaaaatccctctcaagtctaacgtagttatcaccttacctttttaagatatgaagatttccatgtataatgatagatttcagtgcattttttaaaatctttggtaaatacctagcagttactcagtttccctgttctttgtttcttgggaaagaagaatcagtggccaccaaaagtaaaaactgtggtggacattagtgaaaagaaaaagaaaatttcaaatttaaggatcacatttttttttctgttccgtggtttttttaaaaaaaaattttaaattttttttttttttttggaaacatcgtgttatatctaaagcaatcctcttctggattttttttttattgttttaaattttgttttattttatttttttgagacaagttctcaccctgttgtgcagcctggagtgcagtggtgtgatctcgactcactgctgccttgacctcctgggctcaaatgatcctcccacctcagcctcctaagtagctgggaccacaggtgcctgccaccatgcccggataattttgtttattttttgtagagactaggtctcactgtgttgcccagtctggtctcaaactcctgggctggagcaatactcccgcctcagcctcccaatgtgctgggattacaggtgtgagtcaccgtacccagtcctcttctatttttgaagtggtgatgtgggaggtgtctggtgaatgcctagtgtgtgctgggagtggattttttgggactccccccgccccaccccctgtgccatgtcctcagaaggtggtctcttctcagggagaagatctgcctctgttttctgggcttcctgccctagcccaactggtcttctcaggggtcattaacttcttttcagattagaccctggttgaacctgggctgttggggatattttactaacaactattctagacattagaataaagaataatttcccttgaaaatcaaatgaagcctggtttgatgaagcacagctgtacccagggcttttgacagccccgcaatttctgcaaatggttcctaattgattggcttcttctctgtaagggtgcctattactgtcatagctctttgtgtgaccctgtcagcctctcctgtagggggggatttttttccccagtattgttagcaattagcatgtgctattgtaatagtttggagtttgaaagaaatatacaatgtccctttgggtgaggaggttgaaagagtttttggtttgttctgggaacttaaggtatattaagcagtccccacagacatgctgcctgcactccacctgctgagctggctctgaggctcaggagacgtggccctctgtggtcccattgtctccacgtctgtggtaacccggtgcctttctagagcaggcaggctcccggcatgggtggaaacagagcagggggccagcttcccccaatcaccggtgctgctgtggaggaagagcttggtggcgctaggacgtccttgtgaatgtgacttggaagagcagtttgggatttttttcattgcctggggatgagagggagagacaacgtgtgtcttacacatctcccaacagccgacttagatgtgatccgttctcccagagggagcaggtttctttgaacttttcctttttatgtacagcatgtaagtaaacaagggctttgattttcatgggtaaagattttgatccaaatgtaggcatgcttgcacggtttccttttcttgattgaaagttgattttgctctaaaaatgtctaaagactgatatgcagatgagaagagatgcctttctccccagaagggattctgacagtgatctttacatgctttttacagctaaggataagagaacttcttttggatacccgttctgtggcgctgtcactgttcctttctcattccaaaatctttaacttcatctccgaaatagttctttctttttgaaatataaagatatcagaaaggcctaggcaaatatttactctacaaaatatgcttgaaaagacagggaggaataatttgaatatagcaattaattgtatgcttgtaaaatttccttggagtatagcacatattaatacttatattgggtttaatactgtaaaagaaaattcacaaacatgaaacccattttctacaaggtaagcagagtttttaatttagttattcttgatgaaataatttttcggctttgtggaagaattttatgtaatcacctagtgtcgctttggcagggattatttttgccgtttgtaggcgttgtgttgatagaacagagagcattgagaatctggagatacacagcgtgacaactgtgtgttgtgctctttgcaatttaatcttgtttaagatataattgatatattttgtcctgtttattttttctaggcagaaaaaaaagaacgtgcactagtggctatggtttttagtgtacagcgtgaacaaaacttgcatttagtatttaatttctgctcacccacttggcttaaccttttgagtttttttttgtcacatgaattgcttttaagagcttgcctatctaagaagctgaaggaaaagaaaaaattattggaccacatgatttgctttccagcattcttggagttttcgtcttcctttggtgtatacttgcctgcattattgcaagatctttttggttatgtttttgttaggcagtcaagctaaaagataacttatttataaaccgtagtctttctccatggttgctattcaatagatgaatagaatcatgatccttttcttaaaaccaaacatgcctatttctaaatgcaagttatgtgactaaattcctattttaatgcacggagagatggcctcctcaaggcaaacgctttgtccctgaaaaatggtttggggtgtggcagtctccagcaggaagacaataatctgtcacaaagacctaattccaggtagccctttcttggaggcagtggtatgttggaaagaactcgacctgatgcttaaacctgaatttgtattcccatccaccatgccttatcattatgtgacctggggcaagttacccaacctttgtaagcctgtgtgtcctcctctatgaataaacataacaccaccaccaacccagtgttgtcaaaggaatcacgtgagattatgtccaactaggagcactggaagcaggggagagaggattaggctgtaagctgccccttcctggtgcgtctcccatgtatacgtgtgtgtgtgaaggttttccctgttgctcacctaatggcctcttgagctgagattcgatgtcaggtaggaaactgaacaaatagatgagcacctcaataaaatgctgttgaaagtaagacgtgcatgctttgaccatctcagctgcccacccgtgttcttgaccatctcagccatccacccgtgttctcgaccatctcagccgcccacccgtgttcttgaccatctcagccgcccacccgtgttcttgaccatctcagccgtgttcttgaccatctcagccgcccacccgtgttcttgaccatctcagccgcccacccgtgttcttgaccatctcagccgtgttcttgaccatctcagccgcccacccgtgttcttgaccatctcagccgcccacccgtgttcttgaccatctcagctgcccacctatattctcgaagttagtgtcagtggtcaacttctcccgaaccgtcccatgagatgaaaatgaactagaaaccgaaagctgtaagaattgggtcctctttgttgtctgcatggagacaaagtctgctcaccgtgtagctgcttttttttaatgtatagtgttgtaaatggatgagcttttccaaagggttgcttcaagtgaccaaataaaaatagtgtatgttagatctgcctttccctttagcaggagtaggctgtgaacaccgagatgcttagtgaagcctgagcggctctgccagccgaggagggcttgcagactttgcccctcctggaagagaggcggcaaggacacagatcaccaggggtcagagttgggcggagtgtggcaccagcccatatgccttattctgcctctctaacgccacacttccttggcagagacttggaggcaagtttgtggacttgtttgaaatgactgtgctgtttttgttggagtctcaaaggccatttgatctctttgtagtgagttggatttttttttaaaaaatttcctattttccgtgctccagagtatttgtgccctgctcttcttggtctatccttggtcattagggtggatgtgtcaggcagatgccaaccccttgctgggtgtggcaggaagacggtggctatagaagacattactgtggcataaagcacacagagacctgttcttttctttgccagggataacttacacgctctgttcaacagggttggcaatgtcacttacgtgtcaacaggaaaaacaggaaaaaaaaaaagagtggtattgagaatccaaaagacagcgttccaagcaagtggctgcctggaaggccctttggcaatggagagcttgtcctgtagagagggatgaacaacagagcgtggcaggaaggcagtgggaagaaacttgctggtgacctttctcgccatttcttgcaactggcccttcccgtcagctgggctgattcctcctgccaagtgggtccttggacagaggcaaactaaaaagtgggcagtggggctgttggcatggtctgtgctgtgggctaactggggccaaagagaaattgccagcaacaggaagttgcctgatgagtcctcagctggctgtgcctttgccaggcaggcttttaaaactcagacatggggtgttgagttattgaacgagactttggctggggctcagagtctgcctgcagctgtggcagagggcctgtgttttctctattaaacatggaatacacgtatgtctaggagcagagtatcatgcaaggcagggggacttgagcctggcgaggctggtctggaggcctggcgggctgcacagtaagaaccccaggagccctgggccagcctggccccaccagtgcttgtgtctcctgatcctgatctggaaagtaaggatgatggcacctagcacacagtgaggttggaaggatgcagggaggtcaccaattgcccttcttcccctttcctttctgtctttggatcactgaggcactttcgtcagcacaactggcttcccagcctctttttttttggcagagaagagtttaatgaaaaaatagggatttgcattacaaactagggacaaaaagaagacatcgttttaaacttgaagttatagaaaataatcaagcgtgtcttacctctttttaaaattattattatactttaagttctgggatacatgtgcagaatgtgcaggtttgttacataggtatacatgtgccacgctggtttgctgcacccatcaacccatcatctaccttaggtatttctcctgacgctatccgtctcctagctccccacctccactacaggccccggtgtgtgatgttcccctccctgtgtccatggttctcattgttcagcttccacttacgagacatgtggtgtttggttctttcccctgctgttttctgtgccacagtactttcctacctgccttcctctgtccctgctttcttcttttccagacttttctctttcatcttgtttttttttttttttgaaaaaaaaaaaaacaaaaaaaaacacaagttattattcagagtcatcttcagaatcacaaaataaagaagtaaaaaagagaagttttagagagcagcgctgtgagagctgcagtgtgaatcactgcgctggggtgggctggaggatcagggcctgtcaggtggaatgctggctctgaaattaacttgctgaagagataatgacactcccgttcctcatcctgctgggacagtgatgcacaggaaagtgacttggagactactcagagctgaggccacacaaagatttgactgagcagagatgctgatcttcacctaatgctttatttgccacgtttatttctgatacaggcttctcctttttctctccattgaaacagcgggtgccatggttttgctctcatcctgtctgagatgacacttgaagtgggatatgtttgaccttttcaaggcaaacagaaagccaagttcaaggagtcatcagccagctccctgcaacttaggtggtcgtaagggacctcttgccagagctgcttgaggtctcccctttaattttgtccacctggatgacagtgaagatggggttgaacggcaagtgtcccatgtctgtcctctttcttccatcttccctctccatgcccctcagccctctatttccagatctttatttcctttctgggcttctgaattagagatggagctatggagaccttgatataattttgctttctgtgggagaagaaagcaggaagtttgatttctcaggccaaactagcctcagtgtaaataccatttgcaggttcttgcctattcttcttcttatttatttatttatttttgtttttttgagagggagtctcactttgttgcccaggctggagtgcagtggcgcgatcttggttcactgtagcctctgcctcccgggttcaagcaattcttatgcctcagcctcctcagtacctgggaccacaggtgcacgccaccatgcccagctaatttttgtatttttactagagacggggtttcactatgttagccaggctggtctcaaactcctgacctcaggtgatccacactcttcagcctcccaaagtgttgggattacaggcgtgagccaccacacccggcctgttcttgcctattctttggggaagccacctcgacatggggtacactcggagtaagaacacatgggttgggtgggcgtggctcacgcctgtagtcccagcactttgggaggttgaggctggtggatcacttgaggccaggagctcaagaccagcctggccaacatggtgtgaccctatctctactaaaaatacaaaaattagataggcattgtggctcgttcctgtaatcccagctactcgggaggctgaggcatgagaactgcttaagcccaggaggcagaggttgcagtgagccaagactgcaccactgtactccaacctggatgacagagcaagactctgtttcaaaaacaaaaaacaaacaaaaaaaaaaaacacaaaaaaaaccatgggttttttgccctaagtcttacactgaggagccgtttcttcatccttgggtaagttgtcaaacttccctatctgtgaaactcaagggtccgtctgaccagctgtcctgccctgatgtctctccctgtctgtctttctgcctgaatgcctgatccaaagcagctttctgctagatatccctttttatccccatgaatatggagagctgcttagaagaagaatcttagcagaaccctattagaatttgcttcggtcgtttattgtccttcatgcatttcattgaagctaaaacctgtaagatttttggaggcttctcaggtaatggtatgcgaaggtcaggatggttagataccgtatttccagatgctctctgctcttttatgcacttacgttatttaggaacttatttcaagcagaccatttgagaatctgaggaaagctatgggtccccagaagattgcttatgcacatacgttagaaattgcagacaattccagggagctccccagtcttacgatgtttattcacagctttccctgttaggaatttatgaaccgtcagtttgtgatccttactttgagtaaacatctgaatagcctagcctgtgtcttaatattattgatattgcagaatcagttatcaagtacctgcaatatgaacagcactgtgtttatatagtcaagtgatattttgaactttgtttttatcttagtctaattgcttgggtgagattagctattaatgctttatttttttaatgtgctaagagatgttgaggaacgttaaataaataacaacccctagatggcaaataaattattaggttgagaccagaatagattatattgatgatggtggttagacatccccagatttttttttctttttttttttttttttactctgcacttcaatggatgcaaacccaggttgttaaacaccaatcgcagcattacgtgctgggatgttttggcattttgaaagttttattttctatcattagtgaacaaaatgggtttttttttggagtaagaattttaacattttgatcccaaaccaaacttttatggatctctttagtaaaataaatagctgtctgatggactaggaggggtgttttttatgctcagcgtaagggacgctcaggtggctgtggctcctgtgttccccggcaagggcgttgccagtgaatttcacccttcccctttccatgtcagcaaattagctaagcccttgttgtcgttcgccctttttcttttaaagaagtaataggcacaattactatctaattttggcttgccactgtgtgggtgcctggaatctcatccgatctttaatatttacccaggggggtgggtgtagtgtcgcattattcattcactcattaaatccccttcaccgaggcctgctcagatgcttgccattgttcaaagttctgaaatcgtcacctggctgccttctgtcaatattcttgcgtagagattgtagtccaatgaaaaccttgtactgagtgaaagaagatgtgtttgagtttcaaggcattttctgtgcctttcatgactcatagcagattctcaccttgtgataaagttccggctccacagtggtggctgcttttgcttttgcaaaagtaagttgtgagaaattgttctgagtcattttgcaatttcctctatagactcagctaagagtagatgtgtgtgtcatgagtagatgtgtctggagttgagggaggaggggtcatggaaaaactctgcctggaagtgcttcatccaggtacacatgatggtattttcaccatctcaaacactagcttctaactgctgaaggttaagatgggatcattcgttttgtaaatccgtctcctgctgtcttgataataacatgaagaaaagggcaagaaaaacatggatgtgtcattagtatggaaggaaggaggagaatggaggtttgttttaaaggcacccccaattctctttccctctttcatcctttcgttggttcttgccccttccacaccccgactgtgtttgttcagcctccagcgcatgctgccgcctctgctattcacctgcctttgcgctctctcattctttgctgccacctgagtcctctggtgttttcagaaaacagctggcagaggaggaggctctgagatgtgcagttgcttagaaggttctggcctggcatctgcacagcggggatttcatcaccaactgctcagaaaccacaaatgctgcatgcctggaggagtcctgccatcttcctaccttgcatgccactctcagctggttttgggattttctatttatttgtttgtttgtttgtttgagatgggtctcgctctgtcacccaagctggagtgaaatggtgcgatcttggctgactgcaacctttgccttccaggttcaagcagttctcccacctcagcctcgcatgtagctgggattacaggcatgcacaactgcacacagctaatttttgtatttttggtagagatggggttttgacatgttgtccaggcttgtctcgaactcctgacttcagatgatccacccacctcggcctcccaaagtgctgggattacaggcatgagccaatgcactcagctgggatttttaagagtttattcccttcttggttcattcaggcatagataaagggcagtctgagggcccgggtgacacacccatcaggacaggttggtgctctgccttcctctcatttgagcaccgaggtcttgaatttggggcttatacagatgagttaccaagatggggaaaggtggaccatcaagcagtaatacaacgtgaggcttacaggtaacttctaagtgtggggctttaaagaaagtctctgttcacattctgtcaccctcactctgtctcttccatctttttcttgcctgagtgtcctggttctgctgccttctctagatccccagctcttctcaccaccagggatacctggctttggttcccatgtatttattgatttctatttttaagaagtttgatcaaaactgtcaagttatttattgaaaatgatagttgtcttagtttaaatcttattccatttctgttagaagtcagtgtagattatagagtggtaaagtctcagataaatacttatataaataaagataggtattgttccatataagattatcattattttgagaacctgttgatgagggtgccagatgtgactgttgcattactcaaatccagcaaaaaacactgaacaaaaaccataattaaaggggcacacagggtatctgtgctcactttaaggcaagtagcccttggcagtacccctgcttaattaaggttgccaggatattaacatgtaattgatgttttatatacttataactttcctcccagaagctacaatttttttgaaaccagattccaagcattgttttaagccaatattagaagagaaagtgtagggctttctaagcatgaagaggatgtgatttcagacgaaatcatagcacctggaccctgtctccctgcccccatcccattcttcataagcgatgaaaagcatctttgatccatgaaacctgaaaaagcagccatcagtagaagtaagtgtgacggctgaaggtgtcataagatactaatgtaccagtggggaatgggatgcaaggctgctcagcctcagtagcccccttggctggctgagcatctttgtgggctccgcttttaagtggaaacaaaagattgctgatggtaggttgggtgtggtggctcacgcctgtaatcccagtactttgggaggccgaggcaggtggatcacttgaggtcaggagtttgagaccagcctgaccaacatggtgaaaccccatctctactaaaaaaaattagctgggtatggtggtgcacgcctgtaatcccagctactcaggagcctgaggcaggagaatcacttgaacccaggaggcggaggttgcagtgagcagagatcgtgccactgcactccagcctgagcaacaagagtgaaactgcatctcgggtgggggcggggggcagggaagaaaaaaagattgcagatggtgaaatttaaatgcttaaaaaaatctttaagaactcataatttgcctgcaacaaattcaggtggtgacatagtccctttcattcccccaagtcagagcccgtgcccctgtgtgtctgtccccatcagtgaaactggggcttggtttcttctggagaagaataatccagggcaagtcaagctgtttgttttgcgcccctgtctctgttgctgagttgctgtcaccttgagttggctctgactgtcccgtggcgaaggccatcccaaacagcacatttgcagtatgtgctcggagagtgggatacataagaaacaggagagttaactagaaggattttccctcctgctctactaagttggaaaggaaagtagatgtttgtctcttaatttgctgttgcacaaagtgaaaagatacttggaccagaattgctggagctttccatgcactcacagtgggctttggaaaaatcattcactcccttgaatccttatttgttaagaaagtgggattccatttccacaactgtttcatggctgtgaggtgaaataaagactaggcatgcggaatggctttgtaaactgcaggggtgctgagtcagtctgcggagacttagcccatggcgaatacaatgtgttttaaatacatcacttcatttaaacccgttttccccacaaccctattgaacagatattaccagccccatttagcatgagaaaactcaaattcagagatgtcaactagcaggccagtgtgtcctaggcagtgactgtaccacggatcgcgcccagccctgccagcttctaaagcacttcttcccatgacaccacactgcctcgtaaggagaatatggcactgcgtgtagaagaaaggggagaaaactgtatttaagtatcagactcatggcatatgggtgtatttactcttcaattgatttaaaggtagagcgactgtatttgtgaaattgcaaggtacgatgttagaaatctggacacgactttttggttctttagcttaatttacaaagttggttacacccccgtcgacaagaggaatctgtgaggatatagagatccaaggcttatgttccaaaagcaggtagactgtgacagctggagagagccagcagaggatgcagcctcctcagcagtctagaagcacatctaagatgcccaaggagtgtcggcaaggaactggaatgggcgcaaccgaattattttctgagcatcttagaactattatcagagcagagtgcttggtctgtacctgggagccaggtgctgctctattttttgtttcgttttctaggttaaggcagccgggaacccacatggattacaactagaaagaaaatcaatttctagggagccagagaaagggaggaagggcttagtgaagggagagtctgggctcaggtagttgggcagagctgtcctaagcaaagctgggtggacacagcctgaactgctaagcctaagtatgtgggatctcccccttcgagtatgcgactgaattttgtcctcagttttctgtaggatagactttacctgcccaggaaattggtggctaacggagatttgtcagagctctagtctgtcaagaatttggttatagttgctgttattgacacattttgtcttcaaataaagtgataaagataatctttttggcgctttattgtccaatcatgaatatataaaaagaaaaaagtctcaactcaatacggtctcagagtatgtaacactgaagacctttcctggctgggcatgatggctcatgtctgttatcccaaaacttggagaggctgttaatcagaagcaaagccatatctttctttccgggtgaaaaatgggttagagaaaatgcagttcctggcagaggaggcatacattagacagattagccttaagggtagcattgaaactcccagaattttatgtgaaagaggtggctggttgtgtagaaatgctgccctggcccttgaaacttccttggcagagagaacatcttattcattcctgaattccgaccaaactcctgttaaataaggaaaccgagcagaaggcaggcagcgaggacacacaagcccgacgctcctcctgttcccaccgctctggcaccagctgctcagttgctccgtcctggggagcaggggtcctccctgtgactctggtctgggaagccccacagcagtgaccatggcgcttcctctctccagcatgcagctctgacctgccttcctgggcatgccccctaggcactcaggatttgccacttgggacatgcacatgctctctgccttctcaggaaagtatgtccgcatttcctccagacagcgggtggccactgcccacctcctccctctctgaccatgactggtgctgctcattccagccctggccttctgcacgcctcccctcgttgttactcttcccatagccctcgccactttattgagatactgagttttgttgtcactgtgcctgttgcctctttctgccttttatccctacacccagaacagagcctggcagacaggaggtgcccagtaagaaactgctgatgagatgaatttgactgttcttgcccttcctttggggcactcgggaaatttattcttccatacttgtaaaaatagaagaacttgagacattgaatgccctgtgcaaattataactttcattgagccctggcctttgtggaatccttgtactatgctaagtatttttacactgaatgctcttgaccaccctttaaatgtgacccctgcttttataggcaagtaaactaagtcatggagcagttagccatgatcacacagctggtcatggccatggccaagaaaggtttgttataactccagagcctgtgtgcctaagtctcctgtcttgaaagaagtaattgttgaagaaaagcttagtctcaagcacattctgaggcccttggtgtgagtttcacacttacagtgggattgtgaaagggggcagagcccaggtgtattaattcattttcataccactgtgaagaaatacccgagactgggtaatatataaagaaaaagaagtttaatggactcacagttccacatgactggggaggcctcacaatcatgggggagggtgaaggaggagcaaagtcacatcttacatggcggcaggcaagagagcgtgtgcaggggaactgccctttataaaaccatcagatctcgtgagacttattcactatcacgagtacagcatgggagaaacccacccccatgattcaattacctcccactgggtccctcccatgacacatgggaatcattacaattcaaggtgagatttgggtggggacacagagccaaaccatatcaccaggtgacacctgtaccaccgagagtacaaatccaccacatagcccatcatgctgtcacctgtaagctgtgtgtccagtaggcaacaggggctgctgaactcacctccaggtgggtctcctccacccactcctgctctcccctgagctcgtctccttcacagaaagttcaccacctcatgcccctcgtctttgtggtgtccacagttcctaactcgcacctgccagaccctgcctctctgtcctgccttgggccacagttacactggccttcaattcctgacacactctgtgcttcccccagccccaagctgtgcacagtttagctgactttaaccctggctccagtgttagctgttcctgtccttgcttcaaccagagtagctctctctgttgtgtttccgtaggaccccccactttcggcactggtcacctttgaatgacttgcttaaagcttgtcttcccagccagactcaaggagtgatttgttcatcaaagtgtctttatggaagcagaatgtcttatcaggccttttctgcctcaaataattttttttaagtggtaggaaaagattccattaaaaattgtaaaaattcaaccgctataaaaaaatgagaaaactcagataagccaaaagattaaaataacttgaaaggcagtgttaaccactgcatttattatacatgtagttcaattttataaaaatctatgcatacatatttatataagtaaatatacataaaattacttttaaattactttaaaatggcagagctactttttttttttttttgagatggagtctcgctctgtcacccaggctggagtacagtggaacgatcttggctcactgcaacctctgcctcccgggttcaagcagtcctcccaactcaggtcctgagtagctgggattacaggtgtgtgccaccaagcctggctaattttttttttttttgtatttttagtagagatggggtttcaccatgttggccaggctggtctcagactcctgacatcaagtgatccgcccaccttggcctcccagagtgctgggattataggcgtgagccactgcacccggccctactttcttcccttaccagtaaatcacgtccttctcttctggtcagcagatgttggtctctggcatcactggcagctgctgcatatggctcctcttcatactgcaatttctttaggtgactgtttactttcacagtttatgttctcattctgcccaggaaatagaacctttggaaatggaactgtctagtctagaagacaaataatatggggctctttggagcagcatttcttcctcctttttgtaccattttgataaatataaaaatttcatacaatttccctggagtatttagtgtatcactataaaatgaatggtttgtcctcaactttaaatgtctctagtcatcttgaacctgttttttaactcccaccacaccctgccaaggggctgacgtgctgcccttttccttctccactccacggagcatgccggtccaggagaaactggatgtggtgttgccctctatcagcctgtgggccctgccagcttccccccaagcactaaatagagttcagccctgaaatcctgacctggctgcagtggggtagcccagggtagctgcagctggatgtgcagaccaggagccccttgttcccactgtgcagtccagatgtgcaggatccacctccactcaagagcatcatctgtgttgggcatggtggcttgcgcctgtaatcccagtattttgggaggacgtggcaggtggatcacctgaggtcaggagtttgagatcagcctgaccaacatgatgaaactgaaaccctgtctctactaaaaatacaaagattagccaggcttggtggcacgcacctgtaatcccagctacgtgggaggctgaggcaggagaattgcttgaacctgggaggcagacattgcactgagccgagatcgtgccactgcactcccgcctgggtgatagagtgagactctgtctcaaaaacaaaaacaaaaacaaaaaaaaacaaaaactggggaagtagtcattcagccctctgtggtccttccagattccatccttgccagtgatatttggggataatactagatctttctgtaagttagacagtgacttttacgaagttcagagtgagttgagaaaaagtccttcgtgcaatttttagtgttttttttttcccgttttcctaaagggaacttttctgacttaatgaatttgcttgaatatgacagctgacagtgtcattgcgctctgagattatttagtagtgcagcctccccatgccttccagacaatgaactgggaatattgtaagtgctcagtgtatgagaacgcaaaccatataaaccacaccctttctggggcttgactttccttaaggataactgaccgtttgtcccaggcctaaatgtattttgtattttttctagcattctatttcggtgcaggaggagcagcagaaccctagttcttctgactgatgtcctggtttggggaaactctgaggacatgagacttggattcagtccaggctgatggctcagcacagagtgggtcaggattcagtccaggcctatggctcaacacagagtgggtcggcatgcggagggagagggatctcccgccagggatctgccgaaagatcatactgcaaagtgacgggaccagctcaccgaacagcgtggcagtctctttcctagtagctttctatgttggttacgtctgttacggatcctcccccaacatacttttcctctaaagcaggaattgaaatgtagtacacactgcaaatgctgtccttcatccttgtttctgtatgccacattaccccaaattacgcagcacttttaaaccttttttcttagactgaaagtgttttctgagcccaagcaacacaaacaggtgcctttgacaagagtttgcagtacccagaatccctaaatgaggccacagctgcaccctgagccaggaaaggcgggcacgtagctcagcttctgatgcagtggactcctgccacgtatttcatgcagtagctacaaaatttcaggcatagtcttgaaatagttctgggtaatgtgatgtacctaccccgtagtagtttaaagattccaaaacgcacaggaaagttgaaaggcctcaggctgtgatgtctctgaataagacaaaagagaatatcaaagttgttgtgatcaagggaacagatttcacaaactgtcatcaagaggaggccatcatggtatttttctaatgaaaagtattgcactgaacccaggttagaaggttcatctgagtgactcagagcttggtttgacaaagactctgtccttcaaagaccgtcaaagagggtctgggcgagctgcttgatcgtcctaagcagttttcttgccactcctaagaaatgggtttatgggctccttgaaaatagacaagaaaatgtccttatccatacattaaaacacaaataactgcttagacgtctgcctgaattcagagctcttgagtgggatgctcctcatctataaataagataaaatcattttcaagcagggatcaaccttagtataacattaaaaacctgaactaaaggcccggcatggtggctcacgcctataatcccagcagtttggtgggaggatcgctggagttcaggagtttgagaccagcctgggcaacatagtgagaccctcccttctctactaaaaatcaaaagaattagctgggtatggtggcatgcgcctggagttccagctgcttaggaggctgaggtgggagggttgcttaatttcaggagtttgaggctgcagtgagctatgattgtaccacagcactccagcctgggtggcagagtgagaccctgtctcaaaaaaacaaaacaaaaacaatttgagagaaaattttttttgggggggggttggggttcaatatcattgcttttccagatagcataatttttggaaaaaatgtttttatttaatctttttatgacttcttaaagaaaatattggtttcatgctcttttatgaaagctgaggcctgtgatggacccaagtttgtagcattgattgctacaaactggaaaaaaccaatctgaggcccccatttcaagtgcccgtgttttttattctgcatatgcacatcctgttaggccactgaatcctcacactcccagccctaagttatgatcatctgtcttttgcttttatttatttacttttagagatagagcctcactctgtcactcagtggtgtcatcataactcactgtaaccttgaactcctgcctcagcatcgttagtggctgggaccacaggcatgtgccaccacagccagctaatctttttatcttttgtaaagatgggtttccctatgttgtccaggatagtcttgacctcctgggctcaagccatcctcctgacttagccttctgagtagctgggaccataggcgtgtgccaccatggccggctaatttttttttatcttttgtagcgatgggtttcccttatgttgttcaggctggtcttgaactcctgggctcaagtgatccacctgcctcattctcctaaagtgttgggattacaggcatgagccactgtgccagaccagtcttttgcttttaaagcagcattcctggggtgggggtggaataggctcaatagatgtcccagttgtctgcatatgagctgtttctgcctctctaagcagaggtggtctccagaggcaggtggctgcatccctagaacacctggggccaggagagccctgaccacatgggaggcagaggcagcaggaggcgtgaggaactagattgctttgcctgtgctctgctaaatacctgggagtggcaggggctgtgcggacagctagagaggggaacagagctagagacggagcacagctagagatggagcacagctagagacagagcacagctagagaggggaacagagctagagatggagcagagctagagaggggaacgggccctgtgccatttaaggtctcgctgaagcctccttgcccctcagctggaaagccctggagagtcatggtaaagctgcaatgctggcatgttctgtgagaaacctcccaactgtgccttgtgcacagcagctgctcggcaaacacgagtttccttttcttcttgacccaaacggcaattttagcagttacttgatggaataggcattcctgctgccttttcatcaggaaggacactgaagacttagaatcgagacttgcccaggagtgcacagaaggctgggggttgagcctggactgcagcccaggccttctgactctcatctgtgcttttcaggcctatcaccatatatgcatgtgaagatatcccagcccagataatcactattcctataaagtgctgatcaggttcacccagaatgtccctctaatgtttgtaaacatcacgaacagtgggtgaactgaaatgtaatcacccaagtgactccttcagctacaatctgaaaagacacacttataattactcttctccttttgggggccctgcctccttttggtcccaagtaatcctcaccaactcccttagacaacagctaaaatgttaagtgtacaaaaggtggctttctagcacttgaacacttaattgtggtactttaagaagtaaatctgctatgaaaaatctcagctaacattcactttttgggagttaatcttaccagaaaagttcataaagtgaattctgtttttctaaaatggcaagatactttatttgtaagatctcgttactttaacactgcattgttaggtgtgatttttgacatcccagtgaagcaaagccataatctcaccagatgccatttaacttatgatgtattttatcagatcttattttatacagtatattcaagcttaatatagattctatagccctgggaactgttagttttcaggactgcagaattatattgtctgagcttgtggtgcaaatcccagtacagagatttcaaatcagtgagtcttggagtccgagtattatcatcgtgaacattttagctcacttcataggaggccacaaccagaacaccagagtcatggctgtgattccgtcaatttcctgtagcccgtgagctctgtccacatacctcagtggggaccctgggacaggtgatcccactggagccagcaccactcccagaaatccaagcagaacgcgagctgtatgaagagtagaccagcagttctcatgcaggccacacattagcaacacctgggggagtttttttaagaaacacccatgacagccaggcatggtggctcatgcctgtaatcccagcactttgggaggctgaggtgggcagatcacctgaggtcaggagtttaagaccagcctggccaacatggcaaaaccccatctctactaaaaatacaaaaattagccaggtgtggtggtgggcacttgtaatcccagctacttgggaggctgaggcaggagaattgcttgcacccgggaggcagaggttgcagtgagctgagatcgtgccactgcactccagcctgggtgacagagcaagactctgtctcaaaaaaataaaataaaagagcaagtcatatcttacgtggatggcagcaggcaaagagagcttgtgcagagaaactcctgtttttaaaatcatcagatcttgtgagatctattcactattacaagaacagcatgggaaaggcccacccccatgattcaatcatctcccactgggcccctcccacaatacatgagaattatttatgggagctacaagatgggatttaggtggggacacagagccaaaccataccattttgccctggcccctcccaaatctcatatcttcacatttgaaaaccaatcatgccttcccaacagtcccccaaagtctcaactcatttcagcattaactgaaaggtctacagtctaaaatctcatcccagagaaggcaagtcccttccacctatgagcctgtaaaatcaaaagcaagttagttactttctagatacaatgggggtacaggcattgggtaaatacagccattccaaatgggagaaattggccaaaataaaggggctccaggccccatgcaattccgaaatccagcaggacagtgaaatcttaaagctccaaaatgatctcctttgactccatgtctcacatccaggtcacactgatgcaagaggtgggttctcatggtcttgggtagctctgtccctgtggctttaaaggatatagcctccctcctggctgccttcacaggctggtgttgagtatctacagctttgccaggcacagggtgcaagatgtcagtggatctgggctctggaggatggtggccctcttctcacaactccactaggcggtgccccagtagggactctgtgtggggctccaaccccacatttcccttctgcactgccctagtggaggttctccatgagagccctgcccctgcagcaaacttctgcctggacatccaggcatttccatacattctctgaaatctaggtggaggttctgaaaccccaattcttggacttatgtgcactggcaggctcaacaccacatggaagctgtcaaggcttgagacttgcaccctctgaagccatggctcaagctctgtgttggctcctttcagccatggttggagtggctgggactcagggcaccaattccctgggcggaacacagcatggggaccctgggcttggcccaggaaaccactttttcctcctaggcctccaggcctgtgatgggaagggctgccaagacctctgacatgccctggagacattttcatcattgtcttggggattaacattcagtccctctttacttatgcaaatgtctgcagccagcttagatttctcttcagaaaatgggattttctttgctattgcattgtcaggctacaaattttccaaagttttatgctctgcctcctctataaggctgaatgcctttaccagcactcaagtcacatcttgaatgctttgctgtttagaaatttcttctcccagataccttaaatcatctctcaagttcaaagttccacagatctctagggcaggggcaaaatgccgccaagctgttggctaaaacataacaagggtcagctttgctccagttcccaacaagttcctcatctccatctgagaccacctcagcctggaccttattattcatttcactatcagcatctttgtcaaacccattcaacaagtctctaggaagttccaaacttttccacactttcctgtcttcttctgagccctccaaactgttccaacctctgcctgttacccagctctgaagttgcctccacgttttcagttatgttttcagcagtgcccccgactcaaaagagaagcgattctactgaaggagctcagccatctgggagttcccatggcagacatctgttagggtctcacccttacttgccccttgaggtaggcctggaacgttactgggctccttttcccactgcacctttggcacattctctggttctcccttggagcaggctccctccaggacatgttacaaccctttcaccgaagccttcctggacaaccgattctaaaatgctgcctctattcatttaatgtttattataactcttcatttgttccacagaagtctttgttgattccagattgccttaggctatgctttggggtttccagccttggtgagtcttacctctttgtgtaggaactgtttctacttctttggagaaaagcaggccctcaattgatgaccactgaattgaactgaaagactagccagagatcaatgttgagttttaatgtggattgtatatttccatcatatgacaacactgtgttggtgggggttggggcatagaacagagagggcagttgagagtggcctctttttattttggggtgcttcagtttgtcaagagacagactgtataaaaagcatgcatcaggctaccaagtttgaccaacatgcttgtgtaagctttctgcaatatccaaggaaagaaaatgaattatgtgaatattaagagatgctcctgagaagttcagcttcttacccaagacagagatggatagaggtcaggcatgaaggcatttaagctgaaaaaaggagagttttttagttgacagtcagaaagttgctggctgttaatggatgccagtcatttgtgttgggactcagctgcgttgttcagtaagaatttcagtgcagcagaggtgggccgagtacctcctgtgctggccagtgagctggctgctggcggagatgtgaaagaaagaagccaccctgccctcactgggcttccagatggggaggtggtgaagtggggtggagatgtgagggtggaatggaaagaatgagaagtaaaaggacactttgtaatctgaccctgctccagcaactgtggaagcgtttcacctgtgaggctttccagccaaagtctggtggatacagataggctgtctttgagaaggcggaagcacatggtgcttctgtctgaataggagcttgtgccaaaggccagtggtccccccagatggtcatgttccttcttgtctcttcatctatgtgattcctttcccatgactgggagcgagtatttcctctgagcccacattccctaggcctggccctggctccctgctaagaccagcttagctccctcctcgcagaggtttcctctggggctggttgatccctggcctctcatcctcgccaggccttatgtgtcctctgctccctgcctgtgcgctctgcagggctctgcacccctttagggtgagggtgttaccatcttcatctgcttctactccattactagcatgtgcaccagctcaagagtttctcactcataattctacttgccacaagactgtggagctgagcggttagactggagggcagaactcctggcccactgtggccaggtcgtcctgtaattgctcttgggctgtgcctctcttgagtctctccgggctgttctgtgtgggagatggaaaactggattaggccaaccattgaggggactgggtgggcctgttgaggccatctgctcttgttgctccctagaaagccataacttcttgatttcagagctacctcaccttgactgcagagggttagccctaggcaatgactctgtaatttcaggtccaaagatacatctaacagctgatgtgacaatggagagcctcgtgtgtaaacactgaacatgagtgtgggcgcacatcttccttactcagatccgaaatgatagccagaggggtttgaggtgaatgaaaccctttgccctacacagaggcccctctgagatccctgctgagcacagacggagacacttggtgcccttgggggcagcggatactatcagggagaggcccgtgcattattttccacctcttgtcctctctcagagtgctgagcagatcactgcactgtgcaggagttttaacgacagtcaggccaacggcatggaaggaccgcgggagaatcaggatcctcctccgaggtctctggcccgccacctgtctgatgcagaccgcctccgcaaagtcatccaggagcttgtggacacagagaagtcctacgtgaaggtaagggaagagctggcatttatgcattcgtgcctctttgatgatggcaagtggtatgctggcagaggtccccagatcacctctgcccaggacacctgccactccccagggggggacacctgctccttgaatcagtgaattgctcaaggaagggaggggaagagtgagagggtggaagagctgaggagactcagaaaaaaattagatccttggcttattttgttaccaaggtagctttcactatggaaacagatgttctggtttgtcatttgcaatctgtgggaagggagtctgtactggtttagtataaggggagagagatcactttaggtgatgaggaacttgggaacaatctgtacatacgtgacggctgatccaggccccacagtcttggcggtggcccgggccagccctgcctggtggttgtcatcgtgtagaactgggacgcacacactggggagtggtcagcacgtgggaatatccttgcaccattatgaaggggcagttgccgagtatcttgagtacccgaagaattcatttatccatctcataagcccccagtcagtggtttgagaaagattttatgaagaatactggagcctggggagcagagttcttttgctttgtttcctggagctttggtaccatttgaagctcgcttcatttgtcagttactgaagcagcgcggcacggtgcggtgggctgagggtccaggcccggctttgcctccctctggctgtatggtggatggcccccttcaactcccttatttggggtctgagacactcggtcccccttctctaaatgtcttccaactctgacgtgctgggtccatgaattaaggcttggcacacacgtgcggctattaccttgctctgcaagacagatctgagcttcccccttttgttgatgtcgctgttttaccaggacttcacctaaggccctattcacaggtagcttcccaaagccccttcttttggcctcagaggggagaaaggaaagttaggagagatgacagtttagtttcattttccattatgtcttgtcctgcatccagggtgtggagatgaagtgaacagccaggctgttcagactcaagttctgaataatcccatctccacagtcacctttttccaagtcgctgtgtggcgctgtagatattttggaagcttcagagcccttctgacatcttgagaatagtcatggagctcttgccccaagagttaagggcagagttgagaggagaatcgatgtccctttttggtaatagtgttgttagaatttcctgttaggccacgctgtactgggagggtcatttcagtgacaggctggcagagtactcagatggtgtcatgggtgaagtagacaaggaccgactctcccttctctctgcaagaaacctgcactttgttttcttagggcccccctgggttgcagccctttgccccccgcagctctgcgcggacctgattttgctgtccaggaagtcctcccaggcagcaccagcctgtgaggcatgactgccaggccccaacaccctcggacaaaataacccacacttggcacctgttgtgattcacacacacaccaccgtttcttcatttcttttttgttgctgacgtttaacacagaatcttgttgttttttaacctggatcccctgcatgctccttgaaatttttgacatctatgtgttccctgagatatgattcagtaacttccatcatctcccttctctgagcggtctggcgtggaatatggtgagggaaggccagggaggtttttatggtgaaagcatccgtgtcacaggccttgccttttgctctctgaactaaggccagaaagttctggggatgctttgggctttataaagctctgggtcttaggttcccctcttgggaagtgagggagttattatagctgactttgcagtcaactgcttctagtattttaggactcaaaattcttcagaataaaagagaaatcttttctatcactgaactatatcctggtcttgccttcaaattattattattattattttggagatggagtctcgctctgtcacccaggctggagtgcagtggcatgatcttggctcactgcaacctccacctcctgagttcaagagattctcctgcctcagcttcctgagtagctgggactacaggcacccgccaccacacccagctattttttttttttcttttttttagtagaaacagggtttcaccatgttggcttggctggtcttgaactcctgacctcaggtgatccacccgcctctgcctcccaaagtgctgggattacaggcatgagacaccatgcctggctttggcttcaaattattaaacaaaatctttcgctcatgggttttgtaactgcagtctactcccactatactgtcctgctggaacctcgtttgcaagacagccaaatatggcttagagtttagccattagagctgcagctctgtgggagttttttattgcctttgaatatgtgagtttgagattctgtgaatcagtcaaccccaaagttgaagggctccccagaacttgaccctcccagctccatgctggacctctcactgtgctccctgaggcagaagaggccaggagctggggtgcacctgacaccagtgccacccagacgcccttcctctgcagggaagtgagtgcccctgctgcagtggcctgaagaaagggtgtttctgtcaccaagacacttacctaagcagagggaatgatcgagctgtaaaggtgtggaatccagctgttgcctgtattgtgatattaaactctttgaattaggtgagcaataatcactacttttggggtcaggaatttcaacaaaggctgggtgtggtggctcacgcctgtaatgctagcactttgggaggccaaggcaggaggatcacctgaggtcaggagttcgagaccagcctgaccaacatggtgaaaccctgcccctactaaaaatacaaaaattagctgagtgtggtggagcacacctgtagtcccagctatgtgggaggctgaggcaggggaatctcttgaacccaggaggcagaggttgcagtgagctgagatcatgccactgcactccagcctgggtgacagagcaagactccgtctcaaaaaaaaaaaaaaaaaaaaaaaaaaaaaaagaatttcaacaaggcataaacttcattatcctgatgggagccttgggagctgctgccaggttgctgctacccaaatctcatgggtattttggagactaaagcgttgaagacactttcttctattttctttcaggatttgagctgcctctttgaattatacttggagccacttcagaatgagacctttcttacccaagatgaggtaaataaaatcaccttccttctgtccagtgatccacaggttagtctctgtttgccttttagcagaactcctatgagagtatctctgttgatcccaaaagaacatcccaagacttaacggtcttctgagagtcccaggcatagcctcctcctaaaccactgctgtggcctcggctgcatgacccagtggcagagtgtttacaaaggcagagggacggttatggtctttttgaggtagaagagagtgtgatcagaaattccttttcaatacatacctttgtaatgtgaaaccacataattagttctactgacttacatttttcttaatttgaattctgagaattttacatccacttaaaaatttactgtagtaatagagaattatgggggatggagctgtgaaactttctatgtataagccatatcccataatgaatgtgctgtcttcttaaaggatttactttctgtctgcttttccgtgaagaatttccttgtgatttatttgtgggcctaagagttagcgtggtgtcctgaacttcatggctaatcccctcatttcaaatcctgatcttcacatagatggagtcactttttggaagtttgccagagatgcttgagtttcagaaggtgtttctggagaccctggaggatgggatttcagcatcatctgactttaacaccctagaaaccccctcacagtttagagtaagtatctcagatttaggcttaaagtaaaaatacgtggctatggtacgtatttctctcatgagaattctctcatgagaaagaatttcttgtcctgtgactattgactatttattgtcctgtgactatttccttgcaccgttttcctctgtcaggtggtaaaggaaggctgtatatatttttttttcctggcgcaggtgcttttggtagtcagaagtccagcagcacctcccgcctggttgttgaccacgtacgtgctcttttctcagctgctgtgaaggatatccaaggtggttgcttctgaaaccagagctcctaccctgtgcccaatccttcttccccgtggtcatgtggatctgggattaagagaataggtttctaattgctgggctcaagccctctcttctatgaagcaccagtgctccatagcatccgtgtaagccgcagtgtggcaggaagcccctccaaggggacctggaaccatacagacagcatcactctccccaagcaatgcagagtcggctttattagtgaacctctctcagattgtttatatcccaccttgtcagctgtatttttgtagaactttctttgtttcttgtccttggattgcacactgtcagtaggctctgccgctggaaactttgcagtcaagctagatacctgccaggggagcgcctgggctgttccccacctcctgtgtggatggagcaggtttgaacttctccaaggcattagtgctatggaatctgacagaagccatggggccgtcaaatgccataagccagcacgcattgattaaaccatgtctgatttgactttcccctctgcccttctagaaattactgttttcccttggaggctctttcctttattacgcggaccactttaaactgtacagtggattctgtgctaaccatatcaaagtacagaaggttctggagcgaggtaagttgcttatgccttttatagtttttttttttttttgcatttttaactgttagtaaagggtaaatctgtatttaacaagtagagagtaagtacaattttgatgtattaaggtccatccttgaccttgacagtggcaaatattaaagggaaaggtttctgtttctgtcagttaattagtagctgggaacaagtatgcctaagagcagagatgttgctttgccatgtgtcactttgctgtcagttacatctggattcttttcttgccaaattcctttctctaaaaacttgcaaccccaaaccctagatgggagtagaaagaaatgcatgctatggtgtttttttttttttccttgttaatcttcttaagcctgaggagccacaacagcctaccacgaaactcacaagaagtgtgtcagctgaaagtaaagtctctctggtgcaactggaaagagctcacatttcccaaaggttgctcttcggtgtttctctctgcgtgggcctggagggcatctggaggtttatcctgacgcccttagtgctcattcatgtccacggatgcagctctgccattggattttaatccagaacgtcatgatatcccagaagaaaagccccacatttaaaaagtggggtcttagagtgcttcaaatgagcaagacccagcccaaatccatcttctccagttgctttagacagttgctgaactctgttgccatttcctcccacaaacaccctctttttaattaaatttaattaattaattttaaaaatgtaaaaatgttcgtagaaatgggtctcactgtgttgcccaggctggtctcaagctcctggcctcaagtgatcctcctatctaggcctcccaaagtgctgggattataggcatgagccaccacgcctggcccacaagcacctttgtattgacagtctgtagtacagtgaaagcataccaatgtacttgtcaatacatattgacagtcagtgcagtacagtgaaagcataccaatggcttgctccattcctcctttgtcataaagaagaggggtcctgtcaccacctacttggcctggtaatcacattcaaaatggtattgcatctcctagaatgttgtagattttgatcttacaacacaatcccaaataagggtgtatcttccttcagagtagctgcattccaagcaactgggcatccagtgccaactggtggaatccaagtagcactggtgtatccgctggtacccaaaccaaatgcacctggattcctacacacacccttcatggcactcagacaaaggggcagttttcactgccagagagggtcctactgccatgcctgttggaagggagctgtggctctaggtatgcgaaaggtgaatctgcttggagctgtggagtgaaggctgtaggctgcaggctgtggtgcctgtcaccttactttacaggagaaaagacactgctttccagataacccttaagtgtacagaatacaaataagcaacaactagagtgaggccagtgggaaaaacactggtttattttcctttatgaaatttttgtgggtatggtgtagggtctggataacattgcttaatggcttttttgatgttgttttttttgagatggagtctcactttgttgcctaggctggagtgcagtggcgcgatcttggctcactgcaccctccacctcaggagttcaggtgattctcctccctcagcctcctgagtagctgggattagaggcgcccaccaccacgcccggcgaatttttgtatttttagtagagacgggtttcaccatgttggccaggctggtctcgaactcgtgacctcaggtgatctgcccgcctcagcctcccaaagtgctgggattacgggcgtgagccaccgcacctggccacgcttcatggcttttaatgaattgtttgaaactcactttttaggccacctataacaatatttctcatgggtatgcatgaaatgtgtctttaaagtcagacattcctgcattttgagtcagtgttagtctttggggcgcagcctgcattccatcctcggaagctcccagcactccagggctctgtcagggctgtgaggcggaatcccacgctgacagctgggtgcctgacccactgatgtgttggggttttcattaaagaatggcattaggaggactatagaaatagatgatctataaatgttaaaagagaaatgaagaatttaattcaccccactgtgctcttctgaggtcttttatccatctgcttgtagctaaaactgacaaagccttcaaggcttttctggacgcccggaaccccaccaagcagcattcctccacgctggagtcctacctcatcaagccggttcagagagtgctcaagtacccgctgctgctcaaggagctggtgtccctgacggaccaggagagcgaggagcactaccacctgacgggtgaggcggcggcggcacctccgggcgagggcctgcacagggcggcgaggggctgccagccgtgccctgggcctgacagctcacctcttccccgcctagtggcacgtcctaagtcacttttcagttctgcgatggttaatcttaggtttcacgtgaatatgtgaaactagctaggcgtctgggcactcctttagagcttacaaaatacttgggtagaaatgatctcatccgggtagcgccatactcctcctatgcagggatgattctgtcttcactctcaaaataagtaaattacctcaggtcacgtggctgtgaaacagtgccgctggaactgaaaatcaggcctattttcctaccacttggttaagttttgtggggttcgctgcccgagctgctggtcagatttgttgggtgaggctccaccttgtggagatctctgagcagagctcggcttcaaaaccaaactcccaatgatgggttatgctttcaagtcgctactggtgtgttactgtttgaacctctgaaattactggcctgagacacaatttatcaaaaacacaaagccttgcagtttgatagtaaatagaggatccttaaagaggggctttatttgggttggagatagtgatttgttcatatgttgaaactaggaggtccaattaaaccataggtgataaaatttatggggagagagaggcttattaacactttagtattactgaataataaatactgagaagagcgtaaattaaactggctttttttccatgacaagcatactttggtatcaaaatcaacaagaggaaagcatttttgtatgacagttaacttctataagtaaataatacaaattatgttcagcattcatactatgtaaaaacttcattttgtattaagatgatctttagaagggtttgatttaaaaaacttccttccaaacttccctccagttagaattaaaatgctgaattgggagaaaaaaaagtataaagaatactgaatttagaagtgacctaaaattttgctttttggcttttataaaataatgtatctctcatattccctcgcggaaagttatgaacatataccatatataaatgcaaacaattgttctgtcagtcagtcatgtactggggtgtttttaagttccatttaaacctagatccgggttcccagaagggcaagccaaactcgagagctggtgccctaagcccagtcaggcttgggtttgaagcctggctccattcttgtgttttcctctctggaactctggcagaatatcctgcactcacttttctcatctgtaaaatgggatggtttagtctttgagttattgcgggcactaaatgagatgattcacagaaatcacctgtcgtgatccttgctaagtagaaagtgctccagaaatgtcagttgttgttattagtgatacttttcactgatactctgtctcatttcaaaaagaatttgaagtaggagataattttgctgttcttcattctaagggctgggctacagtgggctgttgtgacttattctgaatgtaatgctcctgctagtgggtactggtctggaatcctgagttgaatcttgactccattcattattactgttggatagaatctaaaacaaataacagttatgaaataaatatgatttcatatcttgcagaagcactaaaggcaatggagaaagtagcgagccacatcaatgagatgcagaagatctatgaggattatgggaccgtgtttgaccagctagtagctgagcagagcggaacagagaaggaggtccgtgagacatctgcaccctgggagcctagtgcatgtggtgtggggtctgtaggtgaccttctagataggctgccctgttaggactttcctggaggagaaaatgcctaagatttttcttgataacaatgtgtctaatgaactacacaatttacatatagacatatcataaaattcattacactggtttaaaatataaccttatgtcacgttcacattgtctggaacatccatggagggtgagagctggcagagggtggggtggagaaaggacatgggaactggcatgtggagtctggggcttttcctttttgattttgcctttttttttttttttttttaacatcaaatattggtggttacctgcttacttataaaactagtccaagcaggatttgacattttctgtatttttcctttttatctgattgcttaatttagaatcttgtgcttctcaagccagcatgcaggaagtagcatagtttagggagaaaatggcaggaacaggaaaggactggagatcagtccttcactctggccagtttcaatgctggtgctcttttatcagcagcccgaatggagctcagaggtgatggatgtactagatcccaggggaaagcttacaaaaggcactctggaagaaccacggacactggtagagttcatcttatggaaactgagttggtcacaaggcatgtctcacctacatgtgcgtgcactggagcaaaatgccttcacctttatgttattcatcagacacttgggtgcttaactcatattttcaaaagctccaccgtttaaggccccatgtttacaggtatcataaaaattaaaccagctgtgcttgcattttagcaatgactgtgtgtacatcactatctaacaagagatcatctagcctgggatttccgtatcttccttacctcctgtttttacaatctaggtaacagaactttcgatgggagagcttctgatgcactctacggtttcctggttgaatccatttctgtctctaggaaaagctagaaaggaccttgagctcacagtatttggttagtattccattcagaagaatgcagactgaacagaggctgggattacggaagaacttcactagccgcaccagtccagctcactcctgagctccaggagtcagaattgctataatggttggggacttaacagggccagcccccaactatttgaaactccggcatcgctctgcatcctcattatcttgttctcccttctgctgcttggctcaggccaagtgttacaggaacagatccctgcggctattttgaaacctgctatctttttctttttctttttctgagacgaggttttgctcttgttgcccaggctggagtgcaatggtgtgatctctgctcactgcaacctccacctcccaggttcaagctattcccctgcctaagcctcctgagtagctgggattacaggtgctcgccaccacgcccggctgatttttgtatttttagtagagatggggtttcaccatgctggccagactggtctcgaactcctgacctcaggtgatccacctgcctcagcctcctggagtgctgggattacaggcattagccaccgtgcctggccagaaacctgctatcttaatagtctgctgtatttcaaatgttttaattctgagagttgggagaacaagtgacagtatattgtcactgagatgaacacagtgtcctcagctttcaataaaacaaagagtttaaaaaagccaagatcaacttctaatagtagcttttaaataagcaggtgcttctgcatagttcaaatatgagcgaaagggaagtaccatttattcactcatgttggcagagtgaggtcttagagactcatacgtttggagagtgttactctgttaagacgttcagctctagtttaaccttggaagagtttgcataaaataaagactttctttctcttttcctttctttagtttttaagagagccgtcatactggtttataaagaaaactgcaaactgaaaaagaaattggtaaggcaaaaattcattttaatttaagctaccttttcatagctgtatcttcctattaacgttgaactgaaaagcccactgagcaccaaggctgggctgactgatactgcttactctgagggtaactaaccccatcacatactgagagcgtttctgagtctccccatgaaagatgtctgttttaaaagaagatatacagctgggcacggtggctcatgcctgtaatctcagcactttgggaggctgaggcttgagcccaggaatttgagaccagcctggccaacatggtgaaaccctgcctctaccaaaaatacaagtaactgggtgtggtagcacgtgcctgtagtcccagctactcgggaggctgaggcaggaggatcaattgagcccaggaggtggaagctgcagtgagccttgatcatgccactgcattccagcctgtgcgacagagtgagaccctgtcaataaatacataaataagtaaataaagtagataaatactcatatgggggcctacatagaacatcgacttttatatccctgaaaatggcccatgtttgttccataaacatagtctgtgaaactttggtttattttcaaatgccttttaccttcactcagaaaaaagcaaagcctagctgtggataccatatgccattggtttaccattcagaggcagcgtcagggcgtggaagctttggctgctgttcttgctttgagacctgtaactgcttctgaaccacaactctgcctccgcaccttccctagcatgtgaggtctttgagaactgggtgcgtagctgattgacttctgtgccctgaacacccacatggctgctcggagactcgcccacagggagaacataaacttctattcactgtgcacacatcctccctcagtgacagcttccctaacacttttcttggtgggccttcatgttacagccctcgaattcccggcctgcacacaactctactgacttggacccatttaaattccgctggttgatccccatctccgcgcttcaagtcagactggggaatccagcaggtaactgtttcgtgcagtatgatgccagaaaaagcattttagtagacttaactgtggaatgtaaattaagaaaggaccttggggataatttttggtgccttttattttatagacaaggaaaatgaggacaagagaggttgttttgatgttccttagcagacttctgggagaaactaaatgctggtggatagctttttctttgccaaatgcctttcattgtttccttattttccctatcaatagttttcaacattttcctttctgccttgataccctaaaatgtgttagaagaacaaagatccacaaatttatgtttttacaaatttagaatatagcagaaaattccttaaggttaggtagtactgtaggtgatataaaaagaaaaaaatctttgactctggaaaatgttcagagatccttccagagtaaccttgttttggtgacaggtatctggtgacagaagaggccagcaggctgagtcatgcagtgacctgctgggcttctgtttaacttttgtcagaagtgcttatgttttcgagaaaatgaccacatttggggcaggcctcttttacctcaagtaccccagctcctgttccttccaaggaaagggcaaaactgcaaaggaggttgaagaataggatccactgaatctcctcttccccagagaggggctccagagagagggtgaaggcagttcagatggaggaaaatctgcagcaggaaatgtaaaaagtaaccaaaaggcatttcagttcttgtaactgtgaaaatcatacatagaacaagccacagaagaaaatgagccaggactgggaatattagactttcttaactgatgagatttcaactttacaagtgttcttaaccacagcattttgggcaaagttgtagactcttgtttccatttccttttacatagggacagaaaataattccatatgggaactgatccatacgaagtcagaaatagaaggacggccagaaaccatctttcagttgtgttgcaggtatgactgacttccaaagattaaaaccaacagaaataacatagaattatgtctcttaagggaatttatatttagtgccctcctgaattttgatgatatcagggtcatactccccaccctccgaaaaaggcaactgaggccgctagtaggagactatgttgattaaataaatatcaaaatcttaagagtgatcaattctcacctccttctgtacgggaggccacatggcactgctgctgggtggctggctggcagcctggtccagcaggtgcaaggcacaggaacacaggcgggcgtggaatggaagcacgatgaacactgtggacacttctgctgttttctctccccccccacccagtgacagtgaaagcaaaaccaacattgttaaggtgattcgttctattctgagggagaacttcaggcgtcacataaagtgtgaattaccactggagaaaacgtgtaaggatcgcctggtacctcttaagaaccgagttcctgtttcggccaaattaggtgagaattttgctagccttgtgtttattcaacaaaatattatgagcttctgaaaaggatatatgctcttgtaacatagctgtgacttttcactttgtaagtcatcgaggtacctttatctccttttaagaaacctaaacatgcctcttgctcccagacgttctactgtaaaatacagccacccccaacccccagtcccttgtcttcctacccgctgacatagtccaaatgtacgattttgtttcttccactaagatgtgcatgggtccagggactttgttttcctcactgctgtattcccagtgctcagaacagtgccaggcatcctgaaggtcaatgctgaatgaagatcaagaaccttacacagagggtctccaccttctgatggttcaacctacaatttttcgactttaccgtggtgtgaaagtgacacacattcagtagaaatcgtacttcgagtacccagacaaccattctgttttttgcttctagtgcagcattcaatacatttcatgagatactcaacacttaattataaaacaggccttgtgttctgcccaaccataggctaatgtaagtgttctgagcacactgaaggcaggctaggctaagccgcagtggttagtaggtacattaaatgcattctcgactttccatattatcaacttaacaatgggttgattgggatgtaatgccatctaagttaaggggcctcttatactcgttcttaatcgatagggcaccaagtaagcatttcaaatcacgttgttctttctgcttgtttctaaaatttcagcttaagttttcagaaccttatttctacattaactattttgttattatctttcttgtttttaggcttagaaaatgtaaaacttcgctttttcatgtcaaatcagtgtgacctcttcagatctaccacatatttactattttctccattgtcaaaataaactggccatcaaaataacatgctgttattactttgtagaaacaccaaaactgagaactcccttccttctttcaatccaagagaacagaactacacacacacacacacacacctataacataaaatttcagaaagttgttttgaaattccagcagagacagttctcatatgagagataaagagcattttctaggctgggcatggtggctcatgcctgtaatcccagcactttgggaggccaaggcaggtggatcccttgagctcttgagaacaggagtttgagaccaacctgggcaacatggcaaaaccccatctctacaaaaaaaatataaaaattagccaggcgtgatcatgcgcacctatagtcccaactactcaggaggctgagatgggaggatcacttgagcccaggaggcggaggttgcagtgagcagagatcacaccactgcactccagcctgggtggcagagcaagacactgtctttaaaaaaaaagggggggggaggggcattttctacttttaattgagcagcaagggaaatccacaaggtgagaagatgcataggaatatggtgtgatcttcatgatcaaattacaaagcaccttagtgaaagaaaggagcctagatttattattaccaattaacttttcaacttactccttggcaaaataagaatcttagcccatgtagtagtttctagtgtctagttctatttacataattgagctctggtaatctaaaaatgctgaattgcctaacttacaactgtaaacctaagtcaaaaatgtccatgttttcagtagctacatttttgcctaattaccaggatagttgctaactgaagtcatatcataaaataaaatcttaatgttaaatcttacacaagctttgaggcaaacattacacattgtgtaacctgtttctgtatcacagcgaaatgtgtttttctcactgtagcttcatccaggtctttaaaagtcctgaagaattcctccagcaacgagtggaccggtgagactggcaagggaaccttgctggactctgacgagggcagcttgagcagcggcacccagagcagcggctgccccacggctgagggcaggcaggactccaagagcacttctcccgggaaatacccacaccccggcttggcagattttgccgacaatctcatcaaagagagtgacatcctgagcgatgaagatgatgaccaccgtcagactgtgaagcagggcagccctactaaagacatcgaaattcagttccagagactgaggatttccgaggacccagacgttcaccccgaggctgagcagcagcctggcccggagtcgggtgagggtcagaaaggaggagagcagcccaaactggtccgggggcacttctgccccattaaacgaaaagccaacagcaccaagagggacagaggaactttgctcaaggcgcagatccgtcaccagtcccttgacagtcagtctgaaaatgccaccatcgacctaaattctgttctagagcgagaattcagtgtccagagtttaacatctgttgtcagtgaggagtgtttttatgaaacagagagccacggaaaatcatagtatgattcaatccagatatgggttaaattcctcattttacttttaaactggtggtaaagtggaaattgcaaaaaaaaaaaaaaaaaaaaactgttcattcctgggttttgtgcagtatacattttcccacaaaatggttgtaaagatttaagttattttaatttattgtggatcagaaacctagatgaaactggtcagaatctgtaaattacttagtttatatccactttgagcaggtatcaaatgatttaggatccttaaaattacattctaataattaagttatgtggaaaaagtaaggctggggaagtcgtgattaatagttttcaaagggccattttttaaaatcctctgggcattttctttcagctgtttgttagtttttgctttatttaaagcatatttaagttattttaatgtggtttaggggcaaaatgtgcagatacttcatttttgtaagatagattgtaatagatgctgtttatactaaacatgtcataactatctatacagtatatattaaaagaaagcttgtactgtatcttatttgatgatatttattttctctgccaagctgtatagtaaaaggaaaataagtcaca

SEQ ID NO: 1819 - DNA, 127227 bp, Homo sapiens
actttagaagtaaatgtattttttattaaatcagaaaaagaaagatacagtttacatgactgtcagtcaatcatatgctactttgaattacattttaatagactcagggtcctatttactcctttgtacaggtattaaaaacaactcaggtatttgagaagtcttctgtaaatttttattaactgaggttatggggagggttttatcagagcacatcctgagaacattaggaatgacagacacacttgagataagtgtcagacggaacagatgaagcgagcccctcagccatctgagaaacattaataatgtaagatagcagagaccaaatctttgttagggatacagtattacaggataaaaatggggaccttgccgcccccttgtgttgcaaaataaccgtgcaacttcctttattttttatttattttttttttttaagttgtaatctttgccgttgtcactgagcctcaaaagcaattgttttcccaaatcattttaagccctccccagtcaatcttttccctctcatcaataacttacaaggaccctatttgaaaaacaacgcttattcattcctttttctataccccacacattccgttctaggaaattggcaaccacccaacacagcccgggttctccctccttgagatgtgaatttaaacaaatggattttcgtctcccttcttcaagcttagaggataagcacgcatttactacaacgcttaattccttctagcagcatttctcttctataacttacttgccactgcctttttttttttttgatagaatcttgctctgtcgcccagggtggagtgcaatggtgcaacttcggctcactgcaacctccacctcctgggtacaagcggttctcgtgcgttgggctcccgagtagctgggactacaggtgtgtgccaccatgcctggctaatttttgtatttttagtagagacggggtttcatgatgttggccaggctagtcttgaactcctgacctcaggtgatccacctgcctcggcctcccaaagtgctgagattacaggcgagagccaccacgcccggccaccactgccattttcatcacttaacccgaacacattcctctattccctccctttcctgcttggtgatcatcgactcttctgacccaactaggtgacctgctaaaccatctttactgttatttgccagaaaagactggaccagagacgtaaataatacacctcaatatacaacagctcgggcttaatttctaggcagaatttcatttgctggccatcagaagaatatatacatggagcgtgtttggggaggagatggagtaaggagaacacatcttggtggcaggagaacctggtgggaaccgtgctgatttgtttacttggatttgccaactggtccgatggatactgggtctgtttgcacttgagcatccaacatccgctttggtccctggagaaaaacagaaagacgtggcagcctattgaagctctgtaatgtcaacagcaacaatggccatttatgtagcacttactctgtgctaggtgttgggctaaattaatatatctcattcctcagtgctgggtaagagaatggtctccagtcagatgcccgggttcgatacccagttacatgactttctagctttgtgaaatcttggacaaattacttatcatctctttgcgctttggtttctttatctttaaaatggaaatgacaaacttatctcagagggttgttcccaagataaagtgagttcatgcttataatgtacttagtacctagggggtactaattctacctcactttagctccctccccagttaccatctaggttcaccaccctgttttattttcttcttttttttttattatacttttaagttctagggtacatgtgagcaatgtgcaggtttgttacatatgtatacatgtgccatgttggtgtgctgcacccattaactcgtcatgtaacattagatatatctcctaatgctatccttcccccaaccccccatcccaaaccctattttattctctctcagaacataccactctctgaaatgatcttattatctaatttatttgtctaacatctgtcttctacaccagattggaagctgcaaggattctgcgtgtctcagtgccttgcaggttcctagcacatggtacctagccttaacattgactgaatgtgggtgaaggaatgttgtcaggcagatacaattattttattttatttttttgagacaaagtcttactctgttgcctaggctgaagtacagtggtgggactatgttcactgtagccttgaagtcctgggctcaaatgatccccccacgtcagcctccccagtagcttggactacaggtgcacaccaccaaactcagctaattttaaaattttttttgtagagacggggtctcaatttgttgtccaggatggtcttgaactgctgggctcatgtgatccttctaccttggcctcccaaagtgatggagttacaggtgtaagccactatgcctagcctgagtactattattattattattactttaccgtttctgtcaagtataacttataagtagtaaagttaaccttttctgtatttggttctatgaggttagaccaacacaaatagccccctaaaaccaccatccaaatcaacatgtcacatggttctgtcccccctcagatctttcttgtgccttttgtggtcaaccgctccccaccgcagaccctggcaagcaccgatctgttttcatccctagagttctgcctttgccaggatgtcatatcatgggatcctagagtatacacagcccttcagactaacttctttcatgtagcatagtggatgtgcgattcatccaccttgctgcatggatcaattgtgggcctccttttatactataagacagtatagggtagtacagtataagatttatatattgtatacagtatatatatatatatacacacacacatagagagagtatagtatagagtagtataataacgtattgtagcatagtatatatagatagtatagtgtagtataaggtaatataggatagtataatatagggtagtgtatattttatagtatatatagtatacatatatagtatagtcaagtatggtaactatagcacagtatagtttagtccactgtatagtatagtaaataaagtatagcaaagcataatgtacaatatagtatgatatatacagaacactatagtatatagtataggaaagggaagtataatgtactatcacaaagtatgtatggtctagtatatgtacatagtgtcatatggtttaatgcagtagaatatacatgatatcgtataatatgtaatatagtatatagagtgtattatagcataataaatagagtgtagtttagtatacatgatgtatatagggcacatatatagtatatgtatatagtacatagactgtgtagtgccctgtataatctagcatagtatagtatattgtatttactacatagtgtagtgtaatttcatgtaatttaccaaggaatcagattgctggtctttgaacgccagacctgccacttcctagctgggtgactttggtcaaattgcttaaccctctacttaagccttaattttaccgttgataaaatgggaattcacagggtagttttgaagattaagtgttagtatatgcaatgtactttgaacaatctttgtcacacagtaagtgtgataaaagagttatgattatttttagtggtggtagttgaattcactacttcattcaacaacatatattgaggacctactgcagacaatacattgtgttattaatagttttggggcatcaagagatgaccaggacaccgtgaaataccaaaagcttgggctcaggagtcagctgtgggtttggggatgctccatccctttctggttgcatgacctctggccggtccctcaccgctgagagcctgctgcctcatctgtgtgaggtcttagactgccatcccacccggtcctcactgcagcccacgaggttgacgccactgtcgctctcaggctacagaggaggctgctgaagcccagcgagcccaagccacttcagtcaaattcctgccagtaagtggggtgccggcttctgtccccgatctctgaaccctgagctgggtaaaggccattccccaacccctccatttaccgtgcattgtaatcgcttgttgctgtgattagagcacaaactccccatggcacagcggtgcccgactcatctctgcacctttacaacccagggcaggggctaactaaataatactcacaaaatagcctttcctgactagttaaacctcacaagcattgctctaagggcattgtacactactgcccttcatcttcatgctaaccctgtgacgtcagcaccattcacttcattgatctggtatctgaaactcagcaagatgacaggtccaagctcactcagccactagatgagagctaggttcaagtccaggaacaagcttcttgcaagtgtctagagcctggtctcaggctggccacgggtggcagccatccatcctgcctctgtttgcccagcgtgccttgccgtggatcctggttcacccaggctccaccctgcccagtcaactcacctctattaaagcttacttccccgaggtttccatcctttaggttccatgagcttgatcttggggcttgatggactaaacagcaaactcagatggccaagtggctgccacgggcctgaactttgcaatagatgaacttgtacaagcattttcttcatttattaaaaaaaaattagatgctggcatttaaaaattaggtatttgctcttaaaaattctccacctttgttattttctcttgactaaatggacaggtcctgccacaatgggtctgcagtcccccaaggtaacatgtggctggtgctgaggaggggcaccccctttaggtgggcacctgcccttcaggtagccacagaccacacctgactcactggcctcatacatacacatgcccttctggcctcactgggactccaccttggaggccagagacataaatgcaacccctttcctgccttatataccaggactacacgtcacagttcacaaggccaaaccagacccattctcttacctgttctctctccagcccagtgaggtggacagtgattattattcaccctattttacagatgcagaaactgaggctccaagatgacctaggactaggtcatgcggtaacggcctggccactttgacttggaatctggccctcagctcacctgttgtccccggctctcttctgttcactgcccgctctttccaaccctcggtctcaggctccttgcagtgactgcgctgattgtcacaagcctcggttcagcccacaccagtgtggacagatgtcttcccttttcaagcctccatttgttcacctgctaaacctgcctgcagattgcgctgcacacaatctagcacttcaggggctcatgaaaatgggaaaggggaaggctgggaaagggccatcaaagaagtggtgcttaggggaagggagaaacccagtcttccatcaatcagaatagtttcacttttatcatatgtgtctgtgtgtgcgtatatgcatatatccgcacacacacacacacacacccaggttttgtgacattttcttttgtaaacaaaaaagtccctttgctcaaaaagaaaggaaaatgttttcaaacagttggactttgtgaatgccaagggcttccttccagttcttttcagatttttgaaaaccaagtgggttgctctcagttagaactcaagtagcatgatggagaaggaggaaaaaaggacctgactaacgaggacgtcactgtgagacaaagatcatgcagggatcggcctgcggtgtgtctcatttcctgtgggtaacaggcaccacaatagttctgtgggtggtgacaggctcggctgccagcattcccctcccaggaaggcggtcaggcaaccctggggaatgtgtccagcttgaaagtcttcgaggcttggtctttggaaagcggcagggaagcccccctccgtcctccatcattgctggaggccttgtgacactgggacgatgcaggacttggggtctagggggcctgagctgaatgctgcctctgtctctgacaacctgtggaatgttcagcaaaagacacagcttcttggaggcctggcttatgtgtctgggaggtgtggcagaagcagtcccagcctgaagggatgctgccatcctaaagagatgaggtctgtaaaggagtgtggtcccagaggagggactcggtgtctagaactgtaattagtgtctcaaacctgtccacttcttgtcacttcttcaggaatcaccaggccaatctccatcagctctcccaagaaatatgacctgtattaactagctcctaatgaccttcaacagccattctccaccacagcagcaaaataaaatcttcgaatgttatcaacaggggccaagacttcttacttaatatctgtgagtagcttccctgctcagataggattatgtctgcattccttgcacagcccgtacagcctgcatgaggaggtccccgcccacggctccaatcttacttccatcattctccccctaccctacctctccaccctcagcaaccacggccttgtttctcttcctgaaatgtactaagctcactaagctcattcccacccccgtgcctttgccagggctgtcccctcctcctggaagaaagagccttgctctcttcctgtctggcacctttaacctttcctgtctcatctcagatgtatctcctcagagacaattttgggatccaccgattaaaagtagcacaccccgcccccagacacactcaggcaaaagtagcacacacccccccatccatactcaggcaaactctatcgcgggaccttgtttatttccctcagtgatctcccagacctacaattttgttggcaaattttgtctttaattttgtaattttaacgttgtagttttaataattttaaccttgtttttaaacttatctactaatactttttagctgcatgcttccccttcgaatatgaacccctgatgtcagggaccctgtcccctttgtttgctgaatatacctccagcgcctagttcaaggcttggcacatgtttctgcaaagggccagttggcaaaaattttaagccttatgagccatgcagtctagtcaactagtcaacccaaccagtcaaccctagtcatgcaactagtcaaccctcatgtttttgtgtgaaagcagctagacaacatgtaaatgaatgaacatggcaatgttccaataaaaatttatttatagaaacaagggttgcatttttaatacccctggtctagctcactgccaggattctaaatattctacaaatatttgttaagtgaatgaccagattattagaaatcatctgaacttttccataccatctttctttttcagccttcgtacctattgtagaggctggcttctattaaaataattagaagccacagtgtaaatcattccctgggtggtgttcattttaaatgaatgaataaatcatgggttaaaaacgtgtaaactaagaccaggcatggtggctcatgcctgtaatcccagcactttgggaggctgaggcgggcggatcactcgagctcgggagttcgagaccagcttgagcaacatggagaaacccgtctctactaaaaatacaaaattagccaggcgtggtggcgcatgcctgtaatcccagctactcgggagactgaagcaagagaatcgcttgaacccgggatgcggaggttgcggtgagccgagattgcaccattgcactccagcctgggcaacaagagcgaaactccatctcaaaaaaacaaaagaagtaaactacaagaaatccaaatactttccccaacatctttcctggtcctttaggaacttgctactcaaagtgtgatccctggatcagcagcttttgtagcatcaatcaggagctttgtggcatcccaagttggaccccaaaactactcaatcagaatgtgtgttaatagatccctgggtgattcgtgtgcacagtacattttgagaagacttgcgttggcaaatccaatacagcctcacccacttgggtgaagtccttctctcagggctacaaactggcattcttgctttacatcaacatctgccttcctcacatcaatgaaaccactgcaaggactacatgattagtttgaagactgcactacacccagaaagaagaagctaataaggaactattacatcttgtgggataggagagagaagctatgagtgtgaatgtgctttagatggaatgcttaataaatatttttggaagaaaaatgaaagaaggaagaagggaaaaaaggaaggaaggaagggaagaaatttcagtggtttccatatgtaaatcaaatgattagtggatacccactttcagtgtctccattctcaaagtgggtattttttaaacatgcaagtagaaattgttaagtgtggttaaagttgagtacaatgttttatcgaagggtaacaatttcaagtaatgtattccaactttatatatcatattttggtatctattattttaatctcatccattcattcctttgtctatcaagcacctgctgtttatgcagtcctatttcaagtccttgagatacagccttgaacctgaaaggtggtgccctgccctcatggagctgggagtccagtggtgaagaggggcttccattttgtagaggagagtaaaataagcacatctaaaacacctccccaccagtctgcctaaaattgcaagcagtaaaaaaatttcctctgcatctagcagccattgattctatagtccatggagtaacacaattgtgcatttatacccctgttaaattaaataagcaggaggcctttagcctgaggcagtctccttactcccagtgtctatgtaacaaactgcaaccacatttagtaagtaaacaaaccaaaacctaccttatgagtatccttttttttgtaacaaatagccatgttgcagccaatcacaaatagctgagcttcagccaatcacaggcaaccaattgatcagaccattcccaaataaggcagacaactcatcacatcgtgaccaaataaggcaaacacctcattgtacccaatcagataagttttctactttgcttccatgtttggcctataaaatcttactgctcatgccactgggcagtgctctctgaacctctttgggttttgagtgctgcccaattcatgaactgttctttgctcacaacataaagtgtgtttaaatttgatttgtctaatttttttaacacgtcaaattggtataatataatgtaaataaaatcagccaataatgcattcattcattcattcattcaacaaatattacccagagcatctgctacgcacaagacactgaacaaaactgatgatgatgttgatggtgatgatgacgattacttctacatgctgattgctccctaggtctcaggcactgtgctaggtgactagatgcagtatctcacctgtttcatgaactctatgagttaggcatcattatgtatgaacagataaaaaatctggttcagagaggcaataatttgctcaaggtctcagcttgtaaaatggagaaggattgaacctgctggaagtcacatagcagttcaaaaaccctgagtgatagacccgggatcccagtgtgaagagccacatgtagaatttgaaaaactgactggggcagatggtgttggggaaggagagagcccagaaagaagaggcaaaaaaaatccacctaccaggcctttaaagaagcccccaagggactgctgccgcttctcaggtctcttttggagcttgtccccattctgcagtgagttcgtgtccaccgtggcctgctctgtgcactgggctggttctttggcttcctgcttgttgctcttctgcttgttcatctcggctgctgacttcttgtccttcgaggagccctctttacccttctgtggtgctcctgttggttcaggctctggcggtgtgatagtcttttctgtggagtctgatgtctacagcaatttcaaacaaagtacatttttagtggctgcaggacaactctcaatagcaagggaataaatatgttaaaacagagatgttcaaatgttgggtggtatctacattttcatgaatcctaggtgaaatgaatataaaaaaaggtaaaatgtgcacttatgaagtcatggtggggacatttatttagttatctaataattcattaatacattttatgctatcccagaaagcactctttatcccttattctggaaccagaacttggcttttccttggggaaacacccttcttcctcatctactccgtgtggtccaggcaaactatttccacctccagacaagagcatgtgacttaggcctgactaatcagagcattgtatatgattggccagctgtgattggctcagcatagccaaatgcagataacactggagctaatctcagagctttgctgaaatgagagagaggctggttccctttctgttagatctgaagctgtgaaaatgtaagactggagcttccagaaccaccaatatttctagggaaaatctccccgaaaaggaagccaacacagagaaaatcacagctgagaaatggagagagagagagagagagagagagagagagagagagagagggaccaggcattgatggtatcatgcgtgcctcctagatctagctgttcctggagcccttttatgcttaagccagctttgaaggggctactcccacttgcaaccacatgcgagtgttttcctggggatgcccattcttttcttcataattacatctaccctaatttttggtgtgaaattgtccttttgcttcatgaaatggtggtaaaagagatgattgttttattagtttggaatgtatatcgttttttgtcaaactgaaaggtttacaatcccacatgcttccaataatttgatgagatgaggctgtaaaatccaaaaatctagtaaatgcaggctggggtaagaataaccatgtggatatcttatttctccagctgcaaaagcaacaaaggtccaaaaaaatatttctccagtataagaaaagcaccagttcaagcaaggctggctttgatgttggggagaaaatttagagcaggggagactgaatgttacatgccctgtccaaagggcaacagttgctctgatccagccaagagataccacgtaggcttgcagccccagtgtggtcagagcttctgttgtttcaagacaaccttgaaattaaattttaaaaaatgcaaaatgtcaacttttaaatattgacttcaaaagttttaaagccctgattgtggcaactggcaaacacacttgacccaccggatacatgtgtataagcatgattcatgaagttatgtactgtacccaggtaaaaagttctacaacaaggtagcagctttgatggagaaggcatcaactgtaggagaactttcttttcacaccagtgaatcatgcacgccccttagaagtaagcgggaagacaaacagcagagactccccggtccagaaggcctccaccggtgctcttcagagggcagaagtccttggagaaagaagcaacaggcatccagtgtaccttgagaagctcttctgtaatatatgtcttgaacacttctggcagaccccaactgtcagagttgcagcaaatgctaagatatggatgtccaagtacaatagatatcccagagcagatactctccttagaatgaaacagaaactctcaccacaatgctcttcagaaaggccagaaaccagagatcccagttcaaatgccttgttaactgtttttgttgtgtagaagattttaagatgcagtgagtggctaagaactcagtgtctggagtcagaaggacctggtttgtttctaattccaccataaccttgctgtgtgaccaaggataaactgacctcctagtttcctcatctctatgggagcaataaaagaaatgacaccttatggtgctgtgagaattaaattagctaaaaatggaaaggacacaccagtgttctcaagtctgaatccaaggctccggaaaataaaattcccaattggattctgaaaacactcctaggtgggatgtttctagcttatttggatttgtatggatgtcattccaattttagaatcaccaagattattggcataattccttcactgtaaaattccagacaaaatataccatcatatttaagcttgtcttaaaagcttaaatatgaagagtatagtaaaaagcaatatatttcctgtttaaaaatgtaggataaaccaattattatggaaataaaaatacaaaaacatatttacagtcattaccgtccatttgtgagtgtgatatgggcaacattataagatggaaattccctatcagcagcataatagtaatagtaacatatagacactgttaacaatagagttgtgcccccaccccaacgcatatgttgaatccttaactcccaatgtgattatatttggaataggaagtaattaaggttaaacaaaggcatagggtggggccctgccccaataggattagtgtccttataagaagagacattggcaagcttattctctttctctctctgccgtgtaaggacacacaagcaagaaggtggccatttacaaaccaggaagagagtcctcaccaggaaccaaaccctgctgatttggttactccttaatcctatcctttccagccacaagaactgcaagaaaataaatttctgcttttaaagcaaccacctatggcattttgttatggcagcccgtgctgactaatacagtagctaacatgtattgagccctctataccagaaatgttctaagtgttttacatgtattgattcatctaagtatgacaaccccataaggaagtacttttcatagctcctttatatagatgaggaaactgaggtgctgacagatttggcaatttgcctaagtcacacagcaaaaaaaaaaaaaagtggctgagccaggatttgaaccagacagtttgagtctaccactcattcttgtagccacttctctatattgtcaaaactactagaagaatatttgatgccattttttgtggaggtgtatttttaaattaaaaaaagagtgcagctgcatgatcctatttaaaaaaaggaacacatgtagttataaatatgtcatagctatgtttctttagaataaagaaaataatgaaagcaaactgtgtgaccccccgactccatgtctttattctgttcaagacatagattctagtacttgccaaacaccatgcaaggtgatagagaaatagaagaaggagacttcttgctccacagacattccagacagacatgagaagaaacaggggagataaatgaattattacaatttgtgatgacgctatgaaataaaagaacaatatgtagttatgagaggcagatatggaaggtctttttgaagaggtgacatttatggcaaaaagtgaagggtgagaagagatttttaatgcagaaaagagggaagcacatgtgtgaaagttttttgataggataaagctgaggaactctagcttgttcatgcttgtgtctgcagaccccaacatagttcttggcatatagtaggtgcttaatcctgagatattaaatgagttggctgtggctgagaattttattgaaaagtatactgtgaagaagtgagaatacaccactaatcccaccaccaaactgagttcgaggtcacttacttggcagctggagtctttcccatttatttcttctgagtgggtgatccctccatcccctttcactgactaaaataacaaacagacaatggccttcagccacaagtacagtgacgtggagaatgcaagaaagttctgaaatggatgatctcagtcatttatcattgaggtttggggtcaagacaaatggaaggccaactggaaacatgttactcattggatatagagatttccatgcaatttctaaccagatctaattaaattcaagtgttggcctccaaaaataacaacaaaagtactaaatcctggaattaggcaattctgagataaatgatgacggttccaattaatgttggaagcaggagatagttgaacatattaaatgaagactgaatgaacaattgacccatgagtagccttccactgggaatatttaggctgtgggtgttttattgtttttttttttttctctccttgatagagatatgagttttgtttaatatttcattttccaccctttagcaccccctatagccagcaacaccagtgacagggataaaaggggttggacttgactccttaaactccacactctaagctaatggttctagaagtatgattccaggaccagcagcttcagcatcacctgggaacttgctagaaaggcaaattctggagacccaggctggatctaatcaatcagaagctttcagaggcagaggctcaatgatctgcattttaataagctctccaggtggtgctgaggattgtctgagtttgagtaccaccgctctcagcaagttggccatatacaggttcagactcatgctggggtctgtggttttaacggtgcatttagtaatgtcctatgcttagtgcctgatacctaagaaacctggtgataaaatgttcggttcttatcaacaacattgactcaggtctaattcccacacgtttgatcactgcttaatgtctcctcttcccagctaagggaggagtatagagagcagggtttcagccatatggggcaaagaggaagactccagattccactgttatttatggccatggctgttctcttagcagaccgtaagaatccacaacacatgcactaagaacagccagaaacattgaaagcactcaaatactttttgactgattaatattatgtatctttgttgtctgagctacggtgttcacattagagataatacaaattattatttatgaaggataatttttagtggagtgcttactaagtgctgggcattgtgctaaatgagataataacttgcattatttcatttattcattatgtcagaaccttaagatagtggaattactttatttttcagacaaggaaatggaagctcaaagatactagcatcaccatggaactagcaggtttgagtgccagtgttggacagcaggcaatgactccatattccacactctaaaccacctccccatactgcccctagaaggcaagaggcaccactcaatcaataaacgtttattgagcattcactgtatgaagttgctgaatgttagattaaacaaaatgataaaagcttggataagatggaggatgaccaaactcaaatgtggatgtttatgggatgtcccctcatcaggagtcaactgtgctcttctttatttttgatattattattgtttttaagagacagggtcccattctgtcactcaggctggagtacagcggcacaatcatcattaacagcagcttcaacctccatggtcaagcaatcctcctgcctcagcctcccagatagataggactacaggtgtacaccaccatgtccagctatttttttttttttttgagagagagtctcactctcttgcccaagctggagtgcagtggcatgatcttggctcactgcagcttctgcctcccaggttcaagaaattctcctgcttcagcctcccaagtagttgggactacaggcgcctgccaacacgccctgctaatttttgtatttttagtagagacagggtttcaccatgttggccaggctggtctcaaactcctgacctcaaatgatccacccgcctcggcctcccaaagtgttaggattacaggcgtgagccactgtgcttggcccagctattttttaaaaaatttttttgcagagacagagtctcactatgttgcccaggttggtctcgagctcctgggctcaagtgatcctccagccttggcctcccaaagcactgggattacagaagggttgtgctctttttaatatactgcttagtgtgaaagaggtggtgtctggaagttccgtgtactgaggaacatcattggtgcaggtttcactaagattgacaaacaaagatcagactgtcctctccataaaatttagatctgtctacatggaaagtgggtttttccttcctccgtgccttgtgcattgttctacaaaggccagtcttgcttgagaaggtttagaaaaagaaatgaactgttggctatttcttccctcctcataaccagctctgtcagccttcccatcacacccaaagctttggacacgtaaggatttcattcagcctccaaattcgggctgtgtcgtaagagcccttcctactcaagcccattcccaagtggcctttacactgtggctttggatcatatctgtcaacctttgggaatgttgagcagcaaaaaacaaacaaatgcacaaaatggctttttaggcaaaaaccgaatggacatgaagagtcacgcatgagcactccaccaccttctagagaataaagttctctcacttgccccctaggagacaggaattctaaacttcccgttagttgtttcaatttggcattcattagggactctgtcaatttaaggtttcaatttgctttctttccccccatttctttgagagcccttggagaagaattgggattgaatcagaaggctgtgttgacagcagctgatctcagctgacatcatgaatcatgaaaacagacctccaggctgtcagggagattactgcaacaaagttcaacttcttaaaaaaaaaaaaaaaaaaaaaaaaaaagagagagagagtatctcaaacttttcagtgatttttctttattgcttattttgaggcatgtaaagctgtatgtatgcaaaggtgactgaagtttgggtttacacttagaatcttattaaatccatctgaagtcacttctgtagcagcagttattattaataacaactgtttccttccttccttccttccttctttccttccttccttcctctcgtcctctctctctccctcacttccctccttttcttctacccttctttcttttttctttgcagagacaaatcagaataattcatgttgaactctgtattcaaaggaaccataaacatagaaacttattttttccagctgtcaaaaatagcaaagttactgtttaaagagactaaaattcttccagagactatttaatactttgaagaacagtttaaagactatgaagtaatttcagagattttccagtgtgatattgagcaactttcttcatggagttaatttttattcatgacagtcaaaggtgaagtatctcagggcattcagcctgcagtgttgagatggaatctacttgtggcattcacgccttgtatattaatgaaatcattttttatttctttcatcttgtcatgcattcctatagcttgatactctgaggaatgtttgaaccatctccaatgtatatcacttagctattcaaaaatctagcaaaagtgtttggtggtcagttcacatttctttgaagggaatgttaatgtattttgatggcaatataattcaaacacaattgacatttaaaagaaaaagaattgggctgaaaatttaatatatggtgactatatctgcaatattgtttatcagaccagtctcatgaaaacaaatccaagaatgggatctactgaaaatttctaggatcaacaaaggtaatggatctgagcttagtattttaccacaatgctcacttgaaatggaattggactagtcaggcaaaattccccagccaaggtaaattttgttttagtgacaaatatatttagaaaacctatgtgcaagctttaagtaagccatatattaattttcttctcctttcccttattgtcattttaggtaagtgcaacagctcaatgcatcaaaatggtacttccatagaacacattactaaagaaatcacaacaatggagcatgtggttgttctaccttcgtatcctttctgagaataccagctgcagaagcacaggaagcagcaattacacatgagtcaaagggtgagctttagaacaacaaaatgacaacaaaacaacaaactgagttggaattctggctctcccgcttaccagctcccggaccgtggaaaaatcccataaatactcactagtctctgtgtccttatgtccatcatggggcagagagagcacttgtttcctagagttctctattaataaatgagatactgcgtgcaaagtgcctagcagacaataaataaacggtagctctcattgttgttactgccgataactgaaaagtgctgaacgactacagagaccctcttagggtagaaaggaatgcaagtcattggtagggacaggaattgaccaaattaatgcttccttcagaaatctttccttaaagagcaaatcagtattaacattttaatgctcagagaagaatttcatatggaagactttcggttttctgttttgtaactaccgtcacagaccaccctctttccacctccaatagtacatttcaacagattttgttagacttactagattgaatgtaattaatttaaaaaaccctctgatttcatggctgcctcctcatttggacttttaatttacccattattaaagctcacagtatttctctaagcctgagaacattattccaacaaagattttcttacaaatctaatggtccaaagaaagatatgaggaggagtaaatgaaataaggtaggtgaaaatagtttggaggaggaaagcattttcaagtgtaaggtgttattaatattgacgaagtataaaactgtatctagatctaccacctttctggtttcatttgcctacctgctttgtggacacatgaatgcagtattctacccactcactttataaaaatacaccagcacttcaaatattcaatttcttgacatacagctgaattaatatgtataagaatcttttcctatttagggcatgacagatgtcttagatattcctcgcaattgtttaaaatcctgcaggagcccgcaggatttctgtgaagtgctacatctctatgtgttgaatgcactgttaggacttacatgattctgttttcctttccctaaaatatagttattttaaaaatgatacttttcctatttttatttatttatttaagacggagtctcgctctgtcgcccaggctggagtgcagtggcgcgatctcagctcactgcaagctctgcctcccggattcacgccattctcctgcctcagcctcctgagtagctgggactacaggcgcccgccaccatgcccggctagttttttgtatttttagtagagacagggtttcaccgtgttagccaggatggtctcgatctcctgacctcgtaatccacccgcctcggcctcccaaagtgctgggattacaggcgtgagccaccgcgcctggcctctatttttatttttatgagcagtaaatttctagagagaaaaagatctctagctggatgcagtggctcatgcctataatcccagcactttgggagtccgaggcgggtggatcacctgagatcaggagtttgagaccagcctggccaatatggtgaaaccctgtctcttctaaaaacacaaaattagccaggtgtgttggcatacgcttgtaatcccagctactcgggaggctgagacaggagactcacttgaactcgggaggcagaggttgcagcgggcagagattgtgccattgcactccagcctgggggacaaagcgagactgtctcaaaaagaaaaaaaaaagaaaaaggagggaaatgcaaaggatagaaagcagaaaatcaatgatttggtgaatcaaagcataggttttgcagctgagttctctcttccattaaatcaattatttaaacaaatcgatattttgctaacaatatccaaaatttgtctgaaacgtttatttatttggctcaacatccccaaccgctcaaaaaacccttagcgatgggccagatgttgtctctattttcaagctgttagggcaggttttttctttcctgcataaatccgaagactttgaatcagtttggaagctatgaacatgttactaaaaagtatttcctaagaatgattgctagagccaacttccagaaatctacccaatggggacattaacacatgtgcatagaagtaagtgtgtgaggatcttcatacaggcttgcgaagcagctgaaataacgtgggtgagacacttggtgtgtgctcactgaatatgaggatagagttaaaactaaatgtctgttttattctccgccgggggagactgcacctgtttacgctcactgttgtatcccttgtgcctggaacatagtggacactcaataattatttgttgaaaaagtgaatgcatgaaatgcaaaaagttgaaaacataccacatgtccatccattgagcaatggttaacctgagtatgataaatccagacaatatgattcaaataagttgttctaaagaatcaggcggttctctatcagggattgcaaactcaaatacccacagggaaagggccggtaacataaatgagtgagctagactgggtgtggcaatagggagtggtagggactttagtaagctggaaaactcttcatttgtttatttgaattaatcacagtataaatatagtgttgtaatgaaggcaaaacagaaaaaaagacgataattagaatacctggaattttaaagtaaattccaacaatcaggatttaaattttgcaaagataatgttcgtgttcccaggccttttcgtgggcaactggtaataagaacaatggacagcatggaatccaattctaagaatccattggggattgctggggaaaagtgtgtcctcacctaccttcatccctatcctatagcgaattgattccaaaggacgcttttcttttcaatttgtttccctcagaatttagacttacccattttctactgccaaaaacttttcccaaacagcatctaacagatagctctgggggataaatttaagtaatatgagacctcattagaatttaagaatttgttttagatggatgctgtgagtggtttagaggtttttttttttttcatgctttctttggagtttcttgtacttttccctgttttaaatgaaggagcttcatgttggttatttggaagagaccatcattctatttactgttttttttttctgtacctctcaattccatccagaaatggaaaagctgatcactctcaatattatgatgagatatttggggatcccatttgtaagttagatgagttgccggaaacaggccaaatgttcttttctttcctggcatcatgtaaaaattggttttaaaaaaaatctcaagtcttaatctccattttcactgccaaattgcagatcaaatggccaatgagatagatggggttttggccatatgggccgcccacaactgattctacactttttactccatgagaatataacaggaaaagaaaatgattcctgtcaacaatttctaacataattatttctaatatgcctcagttcccattggcaagggttttgttttgttttgttttgtgggctagatagaattccttaacaggttgagcctgtgaaattagagagttgctttctcaaaggattaaactccaaatactcctgaaaataaagtcacactataatgaaattcttgtttttcattaaaagagaattaaactaatgaccttttacatgcatttttgttttttgttctccaactgatttaggttttgttgcattatattatttaagctcctggctgtttagtcatttaatgtgcattgctttttataaacagtaaatatatctatcacattctttctattctacacaaattaaaagcatggctaattcatcaactaagttatatatttcactattggaatattatgttgtcatttccttatttaatttatctataagctagttttgtccaaatttgtgtcactcacgtcaccttcagaatttttgccatatctttatataacttggactatttgatacataatccttaaaatgcctgatattctttatgtaaacaaatgtaattcaaagaaaacctcatatcattaccataataagaaaagcagtatcattgaccaccaagagaaggaaactttaaaaataaataatagtaagcaataatagtaacttccagttagatgctgttgtatgccaaaatttggacgcaaccacaattaaaaggccgaaaaaaagaaatagatgttggcgtggaggtggtgaaaacggaacacttttacactgtaggtgggaatgtgaactagtacaaccactatagaaaacagtgtggagattccttaaaaaactaaaagtagatccactattcgatccagcaatcccactactgggtatctacccaaaggaaaataagtcattatctgaaaaagacacctgcacacacaggtttattgcagcacaattcacaattgcaaagatatggaaccaacctaagtgcccatcaaccaatgagtggataaagaaaatgtggcttatgtacaccatggaatactactcagccagaaaaaggaatgaaataatgtcttttgcagcaacttggatagagctggaggccattattctaagtgaagtaactcaggaatggaaaaccaaatactgtatgttctcactcataattgggggctaagctacgaggatgcaaaagcataaaaaatgatataatggactttggggactcaggggagaaggttgggagaagggtgagggataaaagactgcatactggctgtagtgcacactgctcgggtgacaggtgcactaaagtctcagaaatcacactaaagaactaatccatgtaatctcaaatcacttgtatgctcacaactattgaaataaaaaaaattccaacccaagggcacctctttttttgttaaaaagtgttagcaggcattaaagaagggttaaagaatattagcaataaactgagactttctgtatgattgaatcagaaggaagaaagggaattttctcactatgcaatccatattccattcacattccatacacaccagctacaattatgtctcctactacctgtggcatgagcccattgttcccagaagccgctctaggtatcttaggtttcctatactggaagtaaggggcttaccatttgtctgagaaacgccatcagagaggttcttggtttgctttcttctcttttgagtttcgcttctgtgggttcaggtgcagcatctccttcgttgaggtccactgtttgtaaggctgattctacttccttggactttataatctctactggtgactcacacaccacctggattattttgccaggtaataagaaaatgaaaaacaaaacattcccccaaaacatgttttacaaagtggggtccttgttgcccccctgtccacatagtagctacagttttgaatctatgaccatttctacacaggcacatcttggagaagtaatgcttatgttgtacaacgcaccaatttccaagctcaactgccacattgacatggaagtggcaaaatcccttccccaaggggaagaacagataagaggtcctttttggggactgtcattcagagcatgctcaatacccaatcaaatctagtaagcccacctctttaatctgccacgtaggtgaattacatttggcctgtctagaaaccaggaataatcattttcttaagagtccaacgttagagacggtaaccatgacagcttccagttctctttccagttcccctgcaactataaagaaactgtcctctttgtagaaaggagagtgtaaaaaccactgaatttaattgacttcctcattaagcgatatctaatttttccctagaacagtcatttgccatttcacttaattgaagtttatgctttcagaagaaaaatgaacttggcaagaaactgatggctaagttgttcgcggccctggccactgtacctagtgagctcgatttcctctgcctctgagtgtctgtggcggcttggatggaagggcccatctaccacactctgctctcaacttgtgttcttttgcagtgcctcactccatttgtacagggccccagtcacatctgggacagtttctgcatttgtgttgttccctgccacaggacagagtgaattggccaggagaggttttttaatttcctttgtttcctcaggcaggggctggcaaaatactaccaaatccagctcagtaactgtttctgtgtggctcctgggctaaggatagtctttaccttttaattttatttatttatttaagaaatgaggtcgtgctacgttgcccatgctggctttcaactcctgggctcgagtgatcctcctaccttggcctgccacgtagctgagactatcagcacacgcgaccacgcctgatggattttacgcatttaaagcgttggaagaaatattttaaaagataaaatgtatgggatggagaccacaaatggcctatgaagcctgaaatatttactatctggccctttaaaccacatggctttcatctgctgcctccctggaaagtaccatagagtcaaaggcatcttcccacttgtctttgctgggccagacccctagcttcttggagccttgttcttggtgtcagggggtaggggaaggggacttagttatttccaaaaatatcgtctgctgagaaactattttctttcccatcatacagaacataccattggtttgcaaaatgacccgaattttccaaatcgagaagaacccttagtctctgtattgccatttgattcagggagttgcccatcagtaaatcagcatgcagaacaccccaacatttggcaactaaatcacatttcttaagctaaattaaatttcttaagctactgacacaatttctagtattttcttttttgtaaacaaaaacggaagttggggggttacaaactcaaaagtcctcaggaggcaaggcagagaatatcagcatggattgaccagacctaagaccaaaagtagtgacagggatgatgacaaagtaaagtcaagctgtcccatctaaagatgttaaatgattaaaaatgctggattggccaaacaaaacctatttgtgaggaagggtctgctgctgggctgttggctttggaccccaatctatctttaggaaacgaggtggagactggagccatatcagagactgagaatggcaatagagcatggacatggatttccacattttgaactgatttaattcaatcgcatttccgaaaagtaagtgtgagccacaagagcccttcaggtgaggctgaaatataggcaatctaactcgtggtcatagaggacaagctccagaacaacttgctgggctctaaatcacatctatatccctcatctaagctcagtgcccaacatctctgtgcttttcgtgttctctgttctcggtgggaattgcatacacatcagaaagttgtctgcatattaaatcaggcaatacatgtcaagttcttagcaccatgcactcaattaatgctagtggttgttatttgtgttaatgttagagctatttagtccatgagcatgaattatctggattaggcaccatgcacatatccaatatttagagatgattatattaatagctacttcttgctatgcctggtattgtaccgggtgtttaatatttttttataaatagcatcaagatagttcgacagcttaggaaatataacattatccctattctatagataaagagtgaacaattgaatgatttggccagagtcttaccacagataaataggcattacaataaggatggcattttctgcggcaactcaatgtatctaatagtggcttaaccaatgaaaacatggaacaagaagttctggggttggttgagtggctccacaatatctctaacaactttggctctttgttcttggctccactattcttggcatgctagattttcatcattttatttgttacctcatggttaaaaaatagctgccacaattccagatatcacatcctcaatccaatgttctgagaaggaaggtcacagccaaagacttgcaccaaataaacatctgtattttgatcccctacctcagggtacctaaatttcatgggtcagagctaggccacttacccccaggctacttactagtgaagaaaatgagattactaacttagactaatcatgatcaaatactttgggggtataaagttggcaactttgcctaaaactaagggtagaagagtggagaaatagaaaatagctcttaagtagataaggaatagagtttgcgttcagaagtattctgtctttgaggcagtgagttctttcttcgtgtgcaaagacctggaggaaaaattactcataaataaaatgatcagattgtatggcaataactctgtaaatcaattctatttggatgccagtggttcccttgctgagcctttccaaatgttgagaggtatcaacccataaatcctaggccacaagtccattctccagaacacaactattgcagtaggtaaaaaaatatagtacttctggagacttccactacctttgaagtcaggccaagaagctggcttttagtagccaaggaaaatccactgacatccagtgtggaaatccagaacaatcttggctaaataaggatctgatttgcatatacagacataggaattcaatttttatttggataattttccaaatttctcctaggccagggctttggaaaaagttgtttcctatttagaacatatgaccgcatctgcacattttaattttggatatcatgaatggacataattaaagtcagatgtgcgctacattttagaattaaatcccccctgcttgatttctgtagaggatatggtagacattgcatgaagatggcaggtacatctaacattgacaatatacatttcagtgaagagtttccctttttgcctcaaattttataccacacttattcttgaaatttggttatacagtttttactagagctgtggcttttggaaattgatttatggcaaatagatttcgtccatttaaacttcatgcacaacgtcatattaacattaaaggtttttattttagaatattttaaagattattttgataggacttttaatgtgattgattacaaagacctcccacagatttttttttttctactcagtaactattctctctcatctgcttacacactctaattttgctttgggagagcaatctttcccatcttcaagactatgtaatttggattaagccaattaaaaaggtctaaaccaatcaacatggtcaagctccttgactgtggttggtttagaaatgacagcatgcggcaaattgtattatttctccaattatttaccctaccttcctgtaaatgaattacacacctgtgcccattgatgtgtgacttgctttagtaatggaacatgggtagaaatgacatataccatgcctgagcagaagctttaggatccgttgcatgattcacccatgccactattttctctctgcaacaagaactgcatgtccttattgaagggactgctgcttctctactgacctcagcaggaagaggccacatgggttagccaaagccaactgatagctggcttgtagcatgagtgagaaaagaaaaaataaaacaaacttctttgctattgagaagcactgtaatttgggacctggttgtcactgcaacacaacctggcaaaagctgacgaatacagcatgtgaatgcatttcagtcagtgaaacagaacaaactccaggacatgcagggttgctacttgacaaatagctcatttactttggactgagtgatgtgatgttggaaagctgagcatgtagccaggccaagaaggctgaacccaaggagagccctgaattaaattttatttgaaagcaatttaactttctagtaatgagagccagtaaaggccactttctttctaatccaggttgaattgggttttctttcacttgcaactgagagattacttattaagagagataaacaacagaagtacctgtttccatggtcttacaggttattggaaggaaagaaatttttttcattagaacattaactcaattaaccaatgggcaaaatattttttttattacaactgaaagattctatcatttcaagagttaaaaaaagatttatttctgataggaccagaagcacattctaggaaaagcactaaacttccacaggcttcaaaatccttatttttctttctgtgagaaactttgagaaatgttgacatcactctgttttttagttttttttaaatacaagtgggccttgcatccgttgatagattagttctggaaagttgtaggtagagaaattttaaagaataaactcaaccacattttagccagaagtcgttatttaaagcactcttgtaatatggttaatcatatctaattgtcctgttgtgaaggtgtagagcactatacattgttttgactaatgccttctctcttatttaagagaggaggaaattaaagctaactctgttttacacattccttcaatccacatggacactgagtcagctgtgagctgtatcatttcactaggaaagaaaatcaccgattactgggacatgctcactcactatgttgtctcttatttgctaatttgctaacaattactgcagaaggtggcaaacttttcctgcaaagtccctgccaatcagtgtttctgttgaaactactcaactctgttgcctagcaacaaagcagccatagatgatatgtaaaggaattagcatggctgtgttctaataaaactttatttctggacactgaatttgaattttgaattcacatcataaaatattctttttaaattttttttcaaccattcaagaatgtaaaaatcatttttagcttgtgggctgtatttggcccatgagctacagtttgctgatccctaaaattattgagttcctcctacatttcaggcactgaagtaagcacgttatagacatgatctccaattttcacaagaacccgaaagtgtaggtgatattattatcgccatttaacagatgagtaaactgaggctcaagaggtgtggcctgaagatgatgggatcaacgtcacaaccatcagtctcattccctccaagtgataggctgtcagaagatgaaatactgatgctgggagtggtggctcacgcctgtaatcccagcactttgagaggccaaggtgggcggatcacttgaggtcaggagtttgagaccagcctggccaagatggtgaaaccctgtgtctactaaaaatacaaaaattagccaggcatggtggcgcatgcctgtaatcccagctacttgggaggctgaggcaggagaatcacttgaacctgggtgggtggaggttgcagtgagccgagattgcgccactgcactccagcctgggtgaaaagagcaaaactctgtctcaagaaaacaaacaaacacacaaacagaaaaaaagaagatgaaatattgagccttaaaaatcaaaatgttgcttgcagtgttaagtcatttaaggcaatttttataatgcttctttattttatttaacaaatattttaccttattttatgtccctatcatcagtttttgtgttatcgtttggtgtcgataatttaacttttaattcctgtttatatttctatttaaaatttcacagtagaaaatagaatatctcctgtttgcctgttagagatcaactctgcattttagcatctgagctgcgggaaacacagggttccttaaacaagcaactacacacaaacatccaaaaagtttttctttagaaaactcagaacctcaaagctaacagatgctacagattttacgggcagcttttaaacttaaagttcgtagaaagaagtcttgtggagtcctccttgtaggttgcgggaatagaaactttgactttctataaaatagtaattcatgagaactttctggaatgatgagagacctgagctttgctgggctaagattggctcaagaaagaaaagaaggaaggaaggaaggaggaaggaaggaagggcagtaaaaccaacaaacagattttgagaggtgaagccagctggatgtcctgggtcgagtggagacttggagaacttttctgtctagctagagaattgtaaatgtaccaatcagcactctgtaaaaatgcaccaatcagtgctctgtgtctagctaaaggattgtaaatgcaccagtcagcactttgtgtctagcttaaggatgtaaatgcaccaatcagcactctgtaaaaacacaccaatcagtgctctgtgtctagcaaaaggattgtaaatgcaccaatcagcactctgtaaaatggaccaatcagcactctgtaaaatggaccaattagcaggatgtgggcggggtcaaataacggagtaaaagctggccaccccagccagcagccacaacccgcttgggtccccttccacgctgtggaagctttgttctttccctcttcacaataaatcttgctgctgctcactctttgggtctgtgccacctttaagagctgtaacactcactgcgaaggtctgtggcttctttcttgaagtcagcgagaccaagaacccaccggaaggaaccaactccggacacaatttcaagatttttcttccaataagaatcataacacagccattctaatttttattccacatcacagacaacatttcagaaacgtgtttggatgtttaacatctgttcagttcccataactaaataaaaataaaaacacacgccctatttatggcaagtaaataagggacacccagaacaagttttgctttggcaacatgataatgttcggtttctatctcaaggagctgtgaattcacttatccctacttataaaaatttcccaaagactgcgcacttctttcaaggcagagagctgttgttttgggtctgaaactcacgaggtcaatttattaatctccctggaagctacgtttttgtgatgttttatatagcaccatccctttcggggatgaatgaactgtcttgaaaattttgacaattcctctagaagattaaaagccaggaaaactgtgaggctcaacgtctctatctcagaggtagacccgtcaagtcagcgctctaacctgagaccgacattctcagcgtctgttgctgcaagatgttctcatgcctgatgcaactccctgccctgggtaccgcccaaagttagtaagaagctggatcaccatggaaataagagtgaacgagcagtcaaggtggaatgaagcagaaggcggagcatcattatccctcaaggaagcgcaaagctgttcttacgtgtagtagactctttcagcccctactgataacaattataaaaatttgtgccctgattttgcatttattttgcactgattcaatgagagttacaaaaattcatccaatgttatcctccatgcgtccctaatcacatacgggataagagagtctacaacaaacgaatcacactggcagcatgcaagaacacaggaccccagagctgaaaatgcccaattgtacaacatggcggaagatgagaatggaatgattctgccgtggtgtgtgtaacttacattctcctccgcacctgtggggactgagtcctctttaactgactaaaggaagataaaaacaaaagtgagagttaaaaggttacagaaaacaaaattgttacataaaagcaaagggttagttgggctcacagtcttggggtgcgttcggggacactgaattgcctaggtacacctccttctaaaaagaaaggagacttacaaaaatgaaaacggtatatatatatatatatagttatgtattttaaaatgcaacaaagagaaaattaaaacacagatgcagccaggatacaaatggagcaagcagaagcgttgtcacagaaaatgctaactgctgtaggtaagcaatgtacttgcctttatattttttagtagttgatgaaaagagagaaatgcaattaatcattcaatacagagtcactgttaggtaaaacaaagaagctactcaggaaaattctggtaataagtgcagagaaactcgttcaattgtccttttgagcaagcaggctttataatacaataggcagggtccaagccctaccctgaccatagcacaggggccagcagcaggggccgctgctttcgtcagccctcagtctaggccaagttcattaggtcaaagttcaatttgactaaaacatgtctgtggaaggctagagagctgcagtcctacatatccacattcaaacaccgttttactcccaggagtaattctggcatatacagtcctgccccaagtgggataggagttatcccgattctgtcaaaggtcaaagccacaatcattctatcagttagccaactttggagttcatttttgcatctttcttttggtggttcttaaacttctggatggatggtggtggatgttacagaccactttgagactcatttgatagatctggactctcctcccagagaaatgcacataaacaatatactttgcaaataatttcaggattcatagaccttctatgtctctcctcttggattacaagttaagaactctgtctatatccattttgttactaagtcctatttttttttttcctttaaggcatccaggggaggggaagacaggaagtgatatttacaaatgtatcttctgcactaggcatcttgcgttatatatcatctcacttaaagcaccccaaaatggtaagtattgtgatcctaacttacagagtaagaaatagaagttcagagaggtgaagccacttgttccagttaaacagctagaaagtggtggaaatggttttaatacatttattttacatctaaaagccaaattttcccctgctatgatgacttcaagggtcagaaacacattttttcggcaatcgtgtgaattcctttcttcacatacagaattattctctctagatgagatcttcagattgcataatttatttctagttatcttcttcccacagtgaagtttctctgggcacaaaaatgttcctaaaagagattgctgaatttctgaaagcttctgattatcaggaaattgtaatgtgttcagaagaaattagcagtagtgttactgtattaatccgttttacactgctataaagatatacctgagactgggtaatttataaaggaaagaggcataatggactcacagttccacatggctggggaggactcaggaaacttacaatcatggtggaaggggaaacaggcacatcttacatggtggcaggcaagagagagcgaagggagaagagccccttataaagccatcagatcttgtgaaaactcacttgctatcaagaggacagcatgggggaaacttcccccatgatccaatcacctcctatcaggtccctcctttgacacctggggattatggggattacaatttgagatgagatttgggtggggacacagccaaaccatatcagatactttcttgaaactgcacccctttttctctgagattagtcagacactggttaataccatgaacacgtaatgaaccaaatggtatctttaaagccagacctcctcaaggccggcccacaaaagtttcaggaatcattatactgtttatattagactgagaaaacccttccattatttaagaacagcacttctaggtttacataccctttttcctgtcccagtttattgcaacaagactagtttttatctttgattgcctgtgtctagaaagtttctggttgttcattgctcactatatttcagaagcaactgggaacttggagtagattccatcaccaatgtagatgatggtgaggaatagaaggggctgcttctgaacagattttttaaatcttcattatggtttcagacctccacatctttctgatgttttaagtctggcattataaatattgtctttttcaaaaggaattgctattttatatttttaaagtcagactacttagcaaagcactcattttgggaaataatccagttgagcatctctcaaacttcaatgattttcataccatgttctaattctttttttaatttatttatttattattattatactttaagttttagggtacatgtgcacaatgtgcaggttagttacatatgtatacatgtgccatgctggtgcgctgcacccactaactcgtcatctagcattaggtatatctcccaatgatatccctcccccctccccccaccccacaacagtccccagagtgtgatgttccccttcctgtgtccatgtgttctcattgttcaattcccacctatgagtgagaatatgcagtgtttggttttttgtggaatactatgcagccataaaaaatgatgagttcacatcctttatagggacatggatgaaattggaaatcatcattctcagtcaactatcgcaagaacaaaaaaccatgttctaattcttgacctgtccatgtaccacctctattcagttgatgtttttctttaaactgactctctttttacttaaatatatttttacttaatatttttttcttaaatatattttaaaagaaatgccttatcattacagcaaatgtcatatcaacatctttgctgtaaatagtagtacgtattaaaaagtacaatagataaaaaacatgcagtaagttctaattgtttttaagtctttctttaaaaaagagatcagcaggtgtttgtacagtaataaatgcctgtgaatatcaagaagagacttcttatagaatgaaaacaggagataaatgcactatgtaaaggattaaatgcttctcagattgtgtccaagagtcactctaaataattttgaactattcttgtacatttgcacactggcctgcaagtgtagccttctgttagtggttgttgaaatatccagttaaaataagaattcaaaaatggataataagagggcaggttctgatccccctttagtgtttgacacatgtaaaagaaaatctgctcagaacccaagtctagagtaccatacactgtggaatcaggtacaaattcagtgtttcagctatgcaatcttgagcaaattaatcacacttctctgcacctcagttcacttacccaaaggctgactgttagactatctactgctcatagcgttgttttaaggaaaaaataaaataaggcctgtgtagggaaaatcatggctgaagcacagctgtgactcactgaagcctggtggctggagtcaaacccacatggttcctcttggtacttacatgaagaccctcatttacatgggagttggagatcctggaaggtatgtttatgggggaggggtaggaacaactcaaaccatgtctggaattagggtacagtggtctataggcttttctacaagccagaatgtattgaagtagagcaaaaataaaggtttcaagaaatggaccctagcaagagaatttaccaggagcaataagaactccagaatcagcaacctccagggcttgtgggaaatagtggttctgggtagggtgctggtggctggtagaacaactcattccagctcagctactctcgaactggctgtctactggggagaaaaagggctgtatggatgcctacagtgggtcttgccaaatggggccactctggggtccaagcagctgcagcgggattctccttccagagctaagcacaacatggaaggaaaaggttttctgcctgctgccttgcaagagacaggtgaactctcgtgggcttgggagtcccaacagcagtgatgagtgggataaattggcacggatcatctccttggtggctgtggtggtggcagtggtgtggcttgggggtgaccacccagtagggacatatggcagcccaggctgattcatgatcacctatcttggattcctagaactatctggatgggatttgtgtgggcatggattcatgtatgttcagcattctatgaaaattgctgatatttattttgtttatgtaaagcacttagcacagtacctgcacatggtatattttcaattagcaacagcaatttttataaatgttgggaagaaatgacactggctagatctactagacctatttagaatttttcttgagtaattctatgttgcttttgaaatgttcttaagtctgcttgggccagatgtatgtttgctacggaaccccttataaacagacatttttaacactgctaactaataggttatattaggttccaaagttggaatggtgtaggggacaatgtgggtctcagttaaaatcttgatgacccaagtaccataacatagtgttatgttgacctttgaaaaccaaaaattctaggtcatactaacttcagcccattgtgccgttattttgagattcatattgtttatattttggactgcactagtgaacccacccagcttgtaaacttgataaatgttcttttaacttggtcgttgtccaagttaactgataaaaattttgaataaacagggctgaggccagattccagagggcttcccgaagacagctccttgcaatatgttttgttccttaataaatattctttgtcggcttgcattcctccagcttcttagcatgcattagatgcaattgcacagagctgaaaaaaatagtaatgctaatagagataatagtgatgacaacccacattatagggccactcttaggctattattgtcaggcagtgggttaagtgctttatgttgtattccaagctagtattcaaatggaaaccaatcttctttaatttctaggtctctattggaacatctaataaactgttgcttttactcaaacatcacatctgcctttggggcttgaggtgtgtctctactctccttgaaagctgactgatgtattatagcgtcctctttgagcatctttgagccaagcctggatctcacatttaacttgtatttgtattaggcatggtttccatgctcatacataaagacaaatgaaggcaacttctcccttctttctgtatgttctctatataacaggaagcctggagctagggagccaggaatatcatttttcaattcattattttctactgccaatgagtatgttgtggtggatgatccacagttgaggtccagcctcattaacagtgacaataaaaaatctagtttaaaatctacgggatcctgtttggacatttatattgctaagaatggggagctaaacagcagataacctatccatagaaactagaataacagagtttcctctcctttaaagagcaaattcaattcttaaggtttctttaaaagactttcatatggtaacacttaagccagcatttgccctgttcctagtgagtcttctaaaagcatcattttgatcatgtgacagctcttctgagtccattaacttcacagtagccctaagacattttctattaagcccagattggtcagcccatctttcaagtgcttccataattgcccagacatatgcccagactttcttaaccagaatccccatgggaaggtgttaaaatctgtatttgaaacaaatcacccaaatgattcagatacgttttttaagttcttaagtctattttgacgtacactgattgctcccttttctaaacaaccgtagcatttgttacctgtactccacagagtaatactaaattgcaaatttcgttgtttcagaatcgggttataattcactgaatatcagtcatttggcgttctttttttttttttttttactcgatcctcccaataaacacgaaagatagatgtcattggccaattttataactgaagaaactgaggctcaagagtttaagtgctccactaaaatttaaacagtcagtaactgtcagaactgagatttgataatgtctctgtggcttcagagtgcacattattttcccactccactctttgtctcccccaaaggaaagcagaaaagggatattttgaagatattccaaatatatcaattattaattacaaatacatgtgcgtgcgtgtgtgtgtgtgtgtgtgtgtatcatgttcctccaaatggatttcaaatcttttgatgctagcaaatgaattttatacttgttttgtacttaggtggtgttaacaccagaagccacacgtgggtgtttagtcatgaccactgattgttcatacttgaagaaatgatgacatcattcactgagcacatactatatattaggtgctttatatgtacaattattggtttcttataacaacactgtgagaaaaacacagtccttattttacagattagaaaggagggtctttgagtggtcaaccaatttgtccagggatacacagctcaacctttctgattctgttgtgtaagccttgccatacacaagaattatcaagactgtgtatcccaatcctcttattcaacaaatgaggaaaagaaactcaaatagtgtaaataacttatgtaaggtcacagagcaagtgagaatccaatttactcagaacaataaatggcatatttactccagttaactgcattttaaacacgtttttggaaagtacaacataatttgaaattggtttccttaaaggtatttttttattttataataataactactctagcaataaagactataaatcaaaacaacttatactttcatatccatagcctgttctgggaaaaattcatttctgctgtctgtaactacaggcttataaactttaaaatcaatatgtttgaaagcttttcaactaaaaatgagagaagaaagagaggttaggttagttatcagtgaaaatataagaaaatgtaagaatttcctagaatttccctttgcatttttcaaaactcttcaaaaatttacaagggtgattttataatcatagtctttgtaatttaacgaaaagaaaacaaaggtcctcattttgctttctgctagaatataagctttcttacaagaatataagctaggaaagggcagacatttgtttactgctactttttcaatgcctagtatttagcacaaactatatagcacaaaacaacttagcacaaataaagtacttagcacaaataaagtaattacaatattgttgaataagtaaaactttgacgaagagccttttcttctgattgggtgcaagaaggagagacacaggggatttggtttttgatttcttttaacttcatatttttaatgatatactaaataaagctaaatagtggctcaaaagacagtgagactgaaataaatgaaattctatcattagggagatgaatgtcaagttgtcctgacattgtttttcaaaggaatagcttgaacttcaaagaagaaccactgtatctcttgtagattccaaacattaaataagcacttgaggcaatagtttagcagctttctcaaactggacagtatagaaagataaagacgtcggcctggttagttcttcagccctcctgagcacggaggaaatagatgagaggtaacactgttcagtgggcacttttgtactaggtccagtgttggaggttttaccatcattatttcacttaatccttacttcatttgtattcatttgtatgacataggtactattatcatttgcatcttacaagtgaggaaacgaaagctcatagagacaaactgagactcaaagtcagagctgtctgatttcaaacttttagcttttacatcagtgtttctcaaactttagccactggcacaccacctatgtggtttttaccatattgtatcatctgtagcagccatggaagtgtgctgctcagattcctgcaagaaagacagccccacctgtcatgccttcagcttctgctcctctccctgggggctcctaccaatgactgggcacgacaggagtactgggccattcattccggtccagtgtgggcctctggaacaggcaatctgtactctatgattctccattggcttggtcaggactttcttagcaccaccttcagtttgaggctttctccacccacttctccttccttctctctctttcttgctagatggtcagaactctctgtagtctgaaggctctctgtacctagctctgccactcctacttctccttcacagatgtcttcctccaataaatctcttgcacgtcaattctgtcttggtgtctgcttcttggaggacccaaatttaccattatttatctactatcagaaccattatttatgtaatactgtctttttattagattcctttttaaacaaaatatgcttatttaaccttgagcaaaacatacgttaatctcaaatttaatgtgctaactctatttttcctaagacaccttgaatatgcatatgaatacatggtaattatttaactaaaattattcagatatgggccacttaagtcttctctcttgtctccaatatacacatatacctcacttggaaattgtttcttctattatattgctggtaaaagatattttaagataagtaatggtgggtgatgaagaaaaaggattacaacagaatgtgtcagctgacatcatccaaagtttttatgaaatagtgaagactgtgttctgggaagaacctggaaggaaggtttctgtatgacaggaagcaaacaggcaaggggccccgcatccagctggattctggacgacggagtaaagctgacaccacagtggcatctgcattcatcatctgctttgcatggtgtgccaagtgcgatagatgttttgatgaaattctgaagttagatttttccagctctatgaattccacccacaccctcatctccaacttcttgctcatcttttggccaaatttaaaacagacaaaagctctgcacatgtgtagcagctggggcttgctcagcaatgataattaaggaatagatctagaataactcagccccactctccctgtccttgcaccactcagacctcagatgggaacaaaatcagacagtggtttgacttttcctgtcatagagcacagtgtttgcctaccctggtggtgaactgatggacaccctaggtttctaaaaggatagtggagacctagtggctgataatgaatgattctgtctggctggggaggagtgaagacagacagcccctaggtagttcatcttgccagagtaagagtgctcaaagagaccaggaagaagtcagggttttaaaccatttcagaaggaaaatgaaatcatgaaataccacaaccctctgtcatgaaatgaagtcactcaaagaatgaaaaattctacttgttcatttccttttcttccccacgaaacacatgtttataacatgacaggcgtttcatttttcctaggaacacattagaaggcttctactcaatgggaagccgagtcattttgaagaagaagaaacaccttccatacattgttgagtacaacagttagcccaatagaaataagttctggagtcatccccgcccggacgactctctaacgcttgaaaatcagacttacctttttccaaaacagtttgcccagaggcagagaggtgggtcctgatttctccttggtgccttccttcgcaggttcaggggttgtcacggactgtgtgtgccccgatgggttgcatcctttggaattcttgccagccccttgggtctcctgggatgtaaagttggctttgtctgacttaaggtcagctgaagtggtgggtgacttttcagcaccctaaagagttaaaaaaaatggagggaaaacattcaaaatggtctcaaaattttaaaaatggaagatctctttttaataaacatgggctgaggttatacataatgttaattttcttctttatatttttctgtattttaaaaatttttactgtgaatgtggacttgtgttaaaatctcagaaaaagttaagatatttttctttcaaaaaataaacatagaagcattattaattatgtttatgtaagtaactcattaggaatcaaggtggtggtaagagaccctttgctgttagaatatggagttcttatttaggccactggtctccaaatggtttcaatcaagttcccatcagtaaaaacattttgaatttccaccttcaatacatgcatacttatttatgtatatattataaacatgcatcatcttactgatcaaaattagaaattaaaggagagttaaattaaatatagaacttctgaaatttttctccatactccactttggggatgactgagttagactataaagttagtaaaaggcaactaggctggaacttggtgaagggattttgaattggaagagtgtccacaaaccctatttcttcacttttaggtgcagccctacactccacaattaaaacttcttgaaatgttatccattcggtctttatttcctctcttcctctctcttccttcccttcttcccttcctccgcctccttccctctgtctttttctctctccctctgtccgtatctcctttctctctttctgtctctctctctgagcagctgcactgaagtccaattccaggacatctgatttcttcagcaagggggtgttaatttctatgctctgccacccactgagtcatgagataaaggaagagttgggagaattatagtcagaatttatcttgacatgagtgaatattggtactcataattttaacatcaggttcatctgacctaacctcttaatcctaaacatcttcattttatgattttttttgctctggatacttatgactcaatccctttaaattcccagggatgtaatatccttgaataaattttctgactaaaagaaaaaatatattgcaataaaaatggggtatgggccgggtgtggtggcccaacacttgtaatcccagcattttgggaggccgacgtgggaagatttcttgaggtcgggagttcaagaccagcctgggcaacatggtgaaaccctatctctacaaataataaaaaattagctgggcatggtggcttgcacctgtggtcccagctacttggaggctgaggcaggaggattgcttgagtccaggaggctgcagtgagccatgatcgtgccactgtactccagcctaggcaacagaacaagacaccatctcaaaaaaaatatagaatatggacaaattcagaaagtttgacagtattttttgatcctggaaagagtcttaaagcccatctgatccaatgcatgaattttcatggatggggaaactgaggccaatgatctgcccaacgctgaacaagggcacaacctggcctcaagtctgaacttctggctcctttctagagctcttcccaggcagcatattgcttctccaaaggatgtttgcaaataacatgaattttactatttgatgcaagacacaacatcttctttgctgaaatttttaatactaagaaggagtcatccattgagcagattctaagttcaagttaagataaagaactgacgtctggaaatgaattttgtgatagttgatactggaatagctccagttccatttaaaagtatacaaaatggcaaaatgttggaatttacaataacctttgcattttatagacagtgaagtcaaaatggctgagctcataagattctgcattacaaacgtcccaaacgctcttgagtacctggtgctattttagctctaaacggtaattaaattaaaggggactggttaaagggtaagtacccctcctcctaacacacacatgctaagtagcttgttttctttttcagaaaataagagaaagtattattcaataattcatttaaaatccactttgagtgtcctctatgagccatgatatgtactaagtgctggggttacatgtcctcaaggagaggatgacagtaaataattccacaaataaatgtaaaatttcaactgtaataagtgctactgagtggggaggcgatttgaggctattcctctcaatcccataaaaagctaaatcaaggagtttgatccactcatgaaaatcagggaagacttcactgagaaaaggatggttgtgctttgatctgaagggtgactgaaaattaaccagagaagggaagaagagagttttccacgcacagggaacaactgccctaaggtccttcggcaagtatcggagcaaagagtggccaagcgtggctacttcaacaacaacctctccttctgctttcctgggagaatctccatttgcccagtggtccattttagaccaagaatccaggggttggggctgacctcatccccatctctaagaaagggctctggttgctttaagccaatcatcaatctgccgaagtcattagaagggcggctccatggccccacgctattttggtgtaacttctgtggcttggctttgtaccttttctaaatgctgtgttatttttctggctcaagggttccctttgatgtgcatttagcccacttactcagagtcacatagaggttacaaaaaacaaggtccccaggtcctggagtgccagaatttacctgggacagctccagtttacctaatgcattacatacttggccgttttcaccgctcagccaccaccctttctctctctgcttagtctccctggaccactgttgcatcttgaagacataatttccaactttaaacttttatttgatgacaagaataaaaggtaacagtgacagacactgttttaagcacctgaatgtcctgacaaaagtcctatgacgaacgattattttttgtattttaaaattgatgaatcatagttttacatattttcggggggtccatgtgatattttgatgcctgtatacaaagtgcaatgattaaaccagggtaactggaatttccatcacctcaaactcttatcctttctttgtgttggaagcttacaatttttctcttctagctgttttgaaatatccaataaattactgttagctgtaatttcccaatggtactatcaaatgctacaacttacaggaagacactaatttttatgccaatttcacagacagggaaatttagttgcttggtggctaagtaacttgcccacagttacactaatgagggggcagagctgacagctgaatccagggagtctgatccccaaacccaagcattaatagtgactccatactacactgtttccaatgaatcaaggtttcctgctccctgggctattccacccatcagtgagggaaatctataccaccgttctcaacaagggcaatatacaacaaaaaataatattgcatttgttcttgggagaagggttatgccaaattagatattaacatggtctgtgtctcccctaaagaattacagtgcattaacaggtataaagaatatttgttacattaaaatttcgtggagggaagggtgattagggcaaaaaatagtctaaaaaagtatcatggtgagggctgatactgagataaagattgggaaacacatctatactgatcagtttcatagggaagtgaccaatttttttttctctttgcattgggaggatatccagaaacccttcaaaaacattacaagggcatgaccctactacagttatagtaactatataattctaatttatttgtgtagttgtttgttgaatatgtatctcttttgctagagtcttggtcatcatcatatcctaagaccaagaaagtcttggtcatgattacgtccccaattcccatcaggcctagcttctggcacaaaatagacaatcagtcattcaattaataattacagtctatgacagggaccagagacagacacccacacaagatcctgtcatgccatatttccagccacccacccctgctcactgggttgtagaataccagtcagaacaccattagtcttttcattcctgcccaccactctcctgccttcccaaagaagtcccccagatggagttctgccagcatcaaccaactggatattctttgtttgcgttacagaggagactacaaaaattttaattgtgttttcagaggcaatctcatgaatagggttgccagatttagcacatgagaataagaatatgagatattccattaaatattaatttaagatcagcaaagaataattttctagcataagcatgtcccaaatattgcatgggacatacttatatttaaattaaaaagttatttcttgtttatcaaaaatttgaatttaactgagtcctgtatattttacctggtggccctgcccatgaaattctagtggattcaatttggagattgtatgtcaaatgaccttaccttcttaataaattttcgtcttgttttcacattgggtgtgggagagaggagatgttagtaagatgtaaacactacaccaagaaccaaaaacaatgaatgaatggtagagcttataaatcatgcatgctgcttgctaatacttcagctgccttacagaaagggtgggcactggggaaacctgaggagagaggggagcattttggggcatggcaaaggcattctaaaggaatgctctgttttgtgtctaaagttgtcaccaaacagtggtggccacatgaaaaagtttgattctgagacatcacatgccattaggccgagaaaaatggttccaattcagcaaaagctgacactaaatgtatttcacttactgatttcagacttccctactttttgaactgagaaaattctttttataagaaggatcatagagatgtagagaaataaagccccagaattaaccagaattggtaactttttttttaatagcaaaatagttttatccttcaatttgcttgaatttctcgttttcttttccaggtgacaaacccatggggaaatggagagtatcacacctcctaaaatcatgataatgtcactgagagaatctggctggttatttaaaggccctactttcctatctttagagacaacagaaataatcaaaagagaaaaagaaatgaactatctcaggtgcagaggtaaaagccaatgagctctaacaaactgctgcgtaaataagaattcagaacatttgggaggtgtcccttactttgatttacacttacataaaaaaatacactgaatgccactcaaggcaaaaccctgaagtccttgtgtctgtgttacagaattccagaaggctgttcccgcggcctcttcccactcttccagaatcctgtcttttccccatctacctcagtgacaagatgggaggccaacagtttttgggaagccctaggaatgataacattgaacttgggtggtccctttattggtggcaagagatactgcagacgtaaaattttgtagtgcatgaagtgaatgtcataatgaaaggcagatctggggaaacatcatacacttcttaaactttcaaggccccttacttacaaaagctccaagtgggagttaaactagattctttcctatgagatctatgacgcgtttcaccagcagttactaagttatttcccagcagttactaagttatgtgatgttggagcacattttaatcttccctcccccgttgcaatatttatcattccccattcttttctcttcacagaacaaaattatcctgtatggaaattgaaaggtggcttcataacatagtctgcttacgcaaatacagattcagctgtgagaactttctatggagtgcttatttgcatatacaatcccgggactgtgacatccaggtagggaagtttttttaatacaggcttttgacttggtggaaaatggctgatattttaaacaaattttcaagcatgctaacccaattcagggatcctttaaactgatggtttcagacaaacactggcgtcttcttagacattggaagcataatatttcccaaactgacttcagtgttgtcctaacttcccaaggacatggagctgaaacatgctctgccttcattcattgcttttttccgcctggacttttatttgggttcagtgtaagcttagttaatattggaaatagatgaaacagaccacagaaagataacattattacttgaggttagaagagtatttcccaaaatgtaggaagcataccattggtggatcagagaagattatagattgtgcagaaatatgatattacatagtattcaaatagtgaaaccacttctccttttccaactctcatttaatccttctactaacattctggagaaagtctcagtctggtgatggtacatctttaacatttttctaccattggccaattaatcaccttttaataaagctagaaagagcatcagattcagagcttaatacaaatgaggtagctagaatgtaatgtctttttaattagccaaattaatgcttaccttcctcttaggaaaaattattctgattttctatatatgatataaagtttcttttaaagatacaatttaaatagaaaataggtcaatttcaatgtaaaaatatcaaataatagtacatctaacaaaaatggtgaaggtggtacacaagttattgacatttgggaaatactgggttagaagaatagttccagaaccctggtccgcactaggaagacacctgtttgaaatgtttatgactatggggacttaaaaatcactgaagtttaattcatatcatctttaattctcttttaatgatccccaccacccaaggctctgtttttactggagaggagctgggtgggctcaggatggcacatgtcttgtgaagaccagagttcttgtttttcctcctactttaataagatacagaccttatgcctaaagaattttctaaaggcgagtcctagcctggggctatccaggtgctttttcttggtgcctctagcctggatctcggatgtcttctgaccagcttgtccatcacagacactttctgctttcgatgcctttggggcaacagcagtcacaacctcagaactttgtttttgaacaaaattctttttgttttctgttgttttaaagtgcattaatacgctgtgacaattaactgttggtacaccatcccctcttctaaccacaaaacaccctgtaaatgtttatcttttttaaacttccatattcacaattttagatatacagtgattttcaacagtgacctatttaaatgacccagatgaacacacctcaaagcaagacagaacaaaacaaaactctgtatctccatttgctgaagacaaataacaggagaagataatgcagtctctacttgatagttgtagatatctaaatgctattgctacatggtaaagtaaaaaatacctgcagacaaaatatttctttttcatcctggagtcaaagcaaagactgctgctgaatgtcttttagtctcaaatcgatctcctttgattcactattagaaactttatggaagcaatatcacctgcaaaaatttcaattcacttctagatgggtagacccccgccaggcagagaaaatgtgtagtgtgaaccaatccactgaggcaaagtagagggagatcgaaaccgaaatagcctggctacaaccactcaagattgttggctcaagttacaaatgtcagggactttcgtgtagggaaggtagtgggctgaaaacaatacagacttcaaaagcatgaatccaagaacttcagtagaaaagatatcaaaattgcaaggtatgagaaccaggtttgtagaaaacacatctgtttgtgggtgtcatggacaacctacattcacaaaacccgcttttgagacccagctccactaatgtgaccccacagcttcctgggcaggacggtgagattttatcagctgggtacgttcagttttgaccacattctgggtcagggaggagtcttggtccatgaccagctaaagagaatgagtgcatcaggtcacttgggaagccacacacacattcccatactccactgtttagagccttttacgctatgtggcttcaaacaacgcaagacatagaaccaaaagaaatacgttttgccccaaccattcattgaacttgaccctatgacctcggagcaaatgaataactttataggaaaatgcatgtagatgcttcagatacatatttttttccaatggaagaagaaaattctcgaggaaaccaagaaatacaatacaaatgtagtcatgtcattcaaccaatcttggctgtgatcattgaaatagggatcgctacatttaatcagagctctacagtttgcaaaacaatgccacaccttcattcaaccttggggtccaggacaaagaatttttttgtcccaattttatagacatgaagacttgggttcagacagattaagattgtaccactatcaagtagcagaactggagctgaaatgcaggtcttttgagacaaaatctaggatcctcttttcacagccagctccttcacatgtgggtagcagatgtagggggcaaaccaagccatgtatctgatcccactgtttttcaaagcactttccgatatcagaagaaggacccaagacacttatctgtcaccaagttaaacttccttcatggttcccgtgaaacttaaaccgtgtattccactagaggtaacgagccttgtccagtgtaaagggagaacatctctaggaagatggtatttcaaaccaagtttattttgaggagagtgggctgaattcttggatgacagtgaagaacctaggctctctagcgtgtcctaacgcctctgcatggccatccgtttggcaggtgccccagggaaactattctatttcaccaaaccactgcctttgcagtaaagatttatttagttttcaaattacattgaaaaataacatattttttagaaaacaaaaatatagcagctttcttctactttatttttttagagtccacgtcctactgaaaagctttcttctactttacatggactgttttttactatattccctgggtccctctacgcacaactaaaaagactaagatgatgatataattattagtattctgttcttatgctatataagaaattggtattgtgatattatttagccagagttggcacgtctttcaagctttccagtaaaattttaatttaactactgttaatgtaaataaaatattttaatgacaacctaacagcactattaaattgctaattatatatagatatgatacacacacacacacacacacacacacacatatatgtattcaaaaaacaagcaggcagacacaaatccaaatccaattctatgcgcaaacccaaatatatacatacacacttccaactacctaccgtgtcttctgggtccttttttgtttcagctttgttaggtgaaaccttaaaagtttgagaaagccaaatattagaaatcattgctctttagagtgatttttatttcatagataaataactctttagggtggtccagttcaccatacaggtcaagaataaaatgagaagtatttttagttcaatagaaatctcaggaccgccgggtaatacaaaagttaacaaaattaatatcttataatgagatacatctgatcttatacatttaccaagagtttgaccacattcaaaattgtctcctggaagaccacagacttccaataaattttaccattactccaaacacatgtgcaaccctctggtgtttgtggcacattctgttgacatttattgttttttcttttgaggttagtcttgatatttgaaaatagcccaaacacatttgggacagtctgcttcactatgcattcattcattcaggtttttttttttttgaatgatttctacagtattttatttgccacttgagtggcaaaactgctttgagatgtccacaacacagggagatatttttcaattatttttatgatcaatgaacataagacattcaattgcaatagaattccattacaacacagcccatgttacatgatttgggcatccactgcttataccatggttccgagcttcaggggctctcttgctaaaagtctgatataacacaactttcttatgaagcatatcttgtccctgttctctcccatgctccaacagcaccatgataattcatttagtacaataacattcaaatgtgcattattcttagaattaacaaaacttttgagcaatagagtggaggggaaaagaggagaaaactgcttaccagagttttaaagaaactcatgatggaattattattctctgctatagctgctgcctgggaatcgtcctttgcagtctccagtccttctgggtccccagggacagagcaatccgcagttccaagttcttgtccttctttttccttgccgtcaactatgtcctaggggcaaaacagttgtcacagttgccacttgctgaatgtgaactctcaaagtcatacttttgcttcacacccctttctctcttaccccctaattccagccatacttcttctgcccacaggcgtgcagaacaatcatgagattataagagtcactcttccttccctccccctctttctaacatattcagcatttgctgttggttggagggacattgtttggagccaaagggtaacaaacacagcagtgcacgttgcatttcaaacaaaaacccttttcttccaattctgcaaagaagttgtgtaaggtatcgatattttccatctttatagtctccttatctatgatgtgtacattatccccagagatggcgtttcccacaatttccacagagttggattatatcaactaaaaaaaaaaaaaaaaaaaaagaaaaagaaaaagaaaaagtactggtgtttaaaaataactattttgcttttgagatatgaggttcatctgtgcaaggggtgtgataggggaactgattttctccccgacctcctcaggagggtaggatgcgttctgaatctgccttcctttcaccatctcacctctcacgaccccaggacaggaagctactgcctctccaccttctgactgcaacagccctggccttgtctctggttgggctcttgaccctcacaatacattctttactcaacagatcccatcttcccactccttaccaccctccagtagcttctgacagctcttggagtcaagcccaaactctgatgcaggatctccaacgtctaacatggtctgcccctgcctaaatctccatcctctctgtaccacgtgctccttcattccattttctggcccactttctttgagtttttcaaacataccacaggttatttccaaacttctggctctctgtttgaaacattctgctcctctgtctgcccgtaggtaatttccatccatccttaaggtcataagtgtcatctctttggagagattgtccctaaacattcatctaaggctgtcctcccaccactgtcgtctccaccagagtcccttgcccttttaaaaatctttgctgtgtcagcagttctgtttacttctcagtctttgtgcttttcctcatactcccattagactacaaactcgacaaagacagggataatatctacttcactcagtgcttttctcaagtaccaaggacagcgaggcccacagaaggcattcaataaatatgtatcatttatgaaaattttacaaacatagaatagtgctatctgtaccagcataaattctcatgtgacaaagtagtacagaaacttcccattgcaacacagctaaacctgcctcattctttacgactcaggtgacatttattccattgcttggttataacattgtttattgtctaatatccttattgatggacattcacagtgtgtatagttgtacatctagagtattataagcagtagtaaagtgatcatctcacacttttatttttaaatactcatgtatctatattttctttgggtaaattatcaaaaatgaaatttttgggtcaagaggtatgcaaattatataaacttgatgaatattcttgcaaaaaatgagaaggtttcaacagagaggtcctgcaggtacatcggtgcatctgagaagctgtttggtgcaccggaggttgtgacaagtgagacctaaaacgtatccgggctgggcaggttggtgcatgtggttgtggcctggcagtggggagcttggtctggaggtgggtggagtgagggaggcggactcgactctcacctgctggttgagcatcgtcttcactcttcgccctccctttcatccccgtgtagtccttcctttcatcccagggctgtgggttccgccttctccacaccatctccctgcccccatgctgccagttcccttacttagaggagaatgaaaggagacacttctgtttcctcaaaagcgatttctaacaattcgcagtgtgtgaggtggcagaagcccacagaagacttggtatttctattttgaccccttctctcagtagtggagagtgggatatggtggcactgcatttagactcctggattttatactttctcctctggggttggcagtgtctggacaagcagtataaattgatatgggttgactatcccaaccactgagatacaattcaactcattttaatggacgattgtattgggccattttttgcgttgttataaagacatacctgattctgggtaatttataaagaaaagaggtttcattggctcacagttctgcagcctttacaggaagcatgggactggcatctgcttggcttctgggaggcctcaggaagcttacaatcatggcggaaggagaagtgggagcaggcacagcacatggtcagagcaggagcaagagagaaagagtggagggggtggtgggacaaacttgcaaatgaccatatcatgtgtgaacatagagcaagagctcagttaccaccaaggagatggcccaagccattcatgatggatccacccctgtgatctttcaccaggccaaacctccagcataggggattacaattcaacatgagatttaggtaaggacagatgtgcaaattacgtcaactacttattaagcattacatgtacaccagtgctttctctttcctaagctagtataatttgaacaaggtcgcttaatcttaatatattattatttattatagaataatatacaatgccaatacgtcaaatattttacatttacagcatgcaaaccactatacaaataaatgcattaaacatatgtcacttaatctttacaacaatcttctgagacaaatattacaattaacagtttcaaacaatgaaatgaggctcagagagtttaggttacttgtctaaggtcacacagcttgagagaggccaatatggggattataagtcaggcctgtcagaactgaacatcttaaaattctatagattatttggctatgagtgtcaactttgctaaacttatatagtgtgtgcagtaaaatgtaacatcatataaattaaatccaggtggtggaaaaccaagatcctcatagggagtgtatataaatatagactacatccataaattccaccagtaaaaacccttcataacttaactctcccaaaaagtactgcacttataacttgtttaaaccatgtcatccttacgtcttaaacaatgcttgtttatgcttgtatagctttacagttacgaggtgccttcacaaatctatcttatctaatctttgccaagattgtgcaaggcaaattacagatgagaaaactgaggcccaaagaggtttaaacatcatgtccaaggccacagttggcaagcgtaagcattaatttgtttttgcctaagtagcattcctcactccttgtgacaacaggaccctcctgctcattcctggagaagtgcccctcttccattccattctcattgctttcctgcccgtttttttttgttttattttccccctgggtcactcttttgtaaccccagtgacctgcttgctcttctttgaacatgtcaagtaggctgttgcctcaggacctttgcatctgggctgagcttctgcctgccaggagcatgtgaccttacttctttcaagtctttttcaattgtcacttttttctttttttttgagacagagtctcactctgtcacccaggctggagtgcagtggcatgatcttgactcactgcaacctctgtctccctggctcaagccattttcctgcctcagcctcccaagtagctgggattacagtgtgtgccaccatgcctgtctaatttttgtattttcagtagagatggggtttcaccgtgttggccaggctggtcttgaactcctgacctcaggtaatcccctcacctcggcctcccaaagtgctaggattacaggcatgagccactgcgcctgagccaatggccacgttttcatcgaggtctttctttaccactctactttaagttgctataatatatcccggcatatctgatgctgctaattgctttatttttctcctagtagatttcacttctaatatattactggctcctcttccccctaaggacatctggtaatgtctggagacatttttttgattgtcacgagtagcgggttagtgatttaccactggtatctggaggatagatgccaggcatgctgctaaaattcctgcaatgcccaggacaaagagttatctggctctcagtggcaagactgagaattatattaaaactctcacttgtcattttgtgttttgttcctctcccttcactggaatagaaaccaatgaaggttctttttctcccttatgtttccccagcacccagacttgtgcacatggtacaatctcaaaaattactagtgaatgaatgaacaaatgatttaatccaagtgagagtatcagtcatcaatttttagccattatgatttcaaatattttttcttctctccttttctctcctttcatggactccaattacctgcctactagcctacttgaagttatcctgtagctcattaatgttcctttcttccttctttttgaaaaagccctcttccttttcacccactgccctgtggttccttttggatagtttctattgctgtgtatttaaattcacaatttttttttctgcattgtctaatctgttgttaatgtcatccagtgtattttttacctcacacactgtagtttttatctctagaaatttgatttggattttaaaaatatatcttctatgtctctacttaactttccaaacatatgagacacatttatgctaatcctttttatttttttgccaattctaacacctgtgtcagttctgggtaggttttggttgatttctcttcacatcatgagttacattttcctgcttctttgcttccctggtaatttttgtttgcatgtcagacattgtgaatcttacctgtttgggtggctggatattttttgttcctataaatatttttgaactttgtttttggaggtagttaagatacttaaaatcagtttgatccttttagttctggcttttaagatttgttcgtgaaactgactttgcaaaaattatgagtgaaaaaattatgactgtgaaagagatctgacctaaccaacaccatcttgcctttaacttccaagctgcccttgttcattcctgggggtaggccacactaacttcgggaggaatttagttatagtttaactttgaaacaaagataataacagtcccttccccaaacaagccccctttattcttggggaccagtccacctttgtaaaactagcaaattagacacaacattagaaattatggctcaggagtcatacagccagaggccacaagattcttcacctccccagttgttcttatggataacattactgctgtaaaacctaatattggtgtttgagatatttttcagaccctgcattctggtctggctcatctggacttgcggcccccacccaagaactgactcagtacaagaggacatctctgatgtcctatgattctgcccccaatcaactaatcagcattctccacgccttagcaatctgcccaccaaactgaccttaaaaaactctagcctctgaattttggggggaagctgatttgagtaataaaaaagttctaatctcacatttaattggctctatgtgtagtaaactctttctctattgccattcccctgtcttgataaattggctctgtctgggcagcgggcaaaaataacccattggcagttacattaggtaggaccaaaatcgtgtctagtctaggaagctaatattttctcgctaatgaggaaagaccctgtgactactctacccagtgccttattaataatgaggttttctagtctggctggtgagagaaggcactctctctggccctgtgtaaatgcctttctggtggttggttttttttttttcccccttcagtctttgctagtttcctcatatgaacatattggtcagctctctgcctcatactatgtgaggacctttgacagacccttggagtttgctctctgtgtatctctctctctcctctgatgctttgtctatgaactctggccaccttgggctcagggagcctgctgggctctgcctcagttcctcccccctaggctatgggctggaaaccctctcaaggcagtaggtaggagcagacacagggattatctcttatgtcccgtctctcagagaacacctatccttgttgcctgatatcttaaaacagtcttaaaaattgttgtttggtttttttgtccaagttttcatctgttttaggcaagagggcaaagccagttcctgtaactctcccttagctgaaagcttctactctgttaatagtagagagtgttgacttcctgtagctggctacaggtgagttcgtttttggtgatgcatgaatcttgagctacattatcatgtgaacagcaatgaggatcaaatcaggtctgaaaagaagtgagctccctaaatttgaaattaataagtgtatttgaaatatgaactttgtcaccaaaattaataataaatcttgttctaggggtgtagcagatctttttatattaattagtgataatgattatgaacattatttataaatgaataaatgaagggaagaatgaatgtcaatgatcaatctctctttctttcccatagactgatattcaattgagtaattttgcaaacaagaattgaagctcattatctcttactgctatttgttttcctaattcccctctcatcagtacccatcatactgaatcataattgattaattgccagtatcacctgctcaactgggcatttgaggacaggcactgcgtgtgtctcattcacaacaagatcaagtggttgataaaagttccagtgcctgacaaagactccatattcacctcccagctccactcacaggttgaggaaccccagctggggtcttagcctctctgagacaaggtcgtctcatggaacacaagattaataataaaccttgcctggtataattcgttgtgagtttccataagaaataatgcatgtaaattccttagcataatgcctagtatagaagtgtccaataaatgttagccaaacagacaaaaaaaaaaaaaaaaaaaagcaatgaaaatgccatacaatttgcaaagttcctgacacagagtagattcaggagaaacatttgttaaaggatgaaaggatatggagtaaattcttttttctatgcctttgtacactgtgctctccagcttctgtcttcccttttgaaatctattcttcacgattggaatcaagtctccctctcccaccgacgtttttctgggtcaggccacccatggactctgtccccttctctgaatttctataccacagttctcagcactcagttggtacttagattatgcacttagaccagcctaacaccaaaggccaggttggaatagtttgcattaaaaatggggcttttgtgaaatggctgcaaaaatacaaaaagcacattttggtgagtattttaaaagtaacaataatacacatattctacaagggtttcaatcagccccaggactctttctaaatggaagcatatttcttgtgaaatgcctcatgagcagctgaagcttcataaaactaaaagcaaataaaagccatggtcttaatagtcttgttaggttttctggttaattctgggagaaaagtgttttgctttggaagagatgtactttttaaaaacaggttctaatatgagttgaacttttaaaaactaactctgaggtataactgggatccaagcggttaagctggttgattagaaggatggctgcaaattctatttatagcagatgagtgttgatatacgtatgaggaaggcgattttattttaggtggtatgtccgcgcacacacacagttattcttttaatgtgtattgtggactgaaagtttgtgtctccccaaaattcatgtgttcaaatcctaacttctgatgtgatggtattaggaggtggggccttggggagatgactaggtcatggggtggagcccccatgaataggattagtgctcttataaaagagaccccagcgagcgttctagtcctctttccatcattccagggtgcaatgagaagctggccatctgcaacccagaagagggtcctcacaagaacccaaccatgctggcatcttgatttcagacttatagcctccaaaactgtgagatatcaatttctgttgtttataagccatccagtctatggtactttgatagcagcctgaactaagacaatgtgcactagaaaaatatgtccagcatcaaccttttcatattatggatatttttgtgtaggtgaagttcaatataaagtaaactttaaataaagctattacatgaataactgaacaggtgtcttgaagatgagtcattatgaaagtggcacaagacataaatctagactgagaaattccccacaggcctaagtaaggtgttgcccaggagcaccattcatgaattcatcctcactcagtaactatgtgggggtagttacattacatacaagctgtgcagaggccacacagcattagcatgggctctgaagttatgctttcactgtgtattgtggacttaaagtttgtgtctccccaaatcctaaccctcaatgtgactacatacaagctgtgcagaggccagctgcccaggtccaatccctgctctgccatctacacctctgcagtactgcactttccctaactctaggttgcaatttgctcatttgtaaaagtggggtgatgagtagcacctgccttttagggttgttgagggagtaaatgggataatccatataaaggacttaggagaatgtgcagtacagaggaagcattcagtaatggttagctattattattgtgtttaatttaattactgagcactgtggtaagctgtgagatttacaaaaatgaatctgacactgtcttctctcctagatgcttggagccttatggtggataaaggtcagtagatagggacaagtactctgataaaaagacaagtgaggctaagcacagtggctcacatctgtaatcccagcaatttgggaggtcaatgcaggagaattgcttgaacacaggagttcaagaccagcctgggcaatatagtgagaccttgtctctatgaaacaaagcaaaaacaaaacaaaacaaaacaaaacaaaacagaaattagccaggcatggtggcatgcacctgtggtcctagctacttgggaggctgaggcaggagaattgcttgagccagggaggtcaaggctgcagtgagctatgattgtgccattgcactccagcctgggtgacagagcaagaccctgtctcaagataaaaagaaaaaaaagacaagttaatttcatcagcccagtgggtctcagcataactggattttagaatcacctgggcagctttttaaacaaatgccaatacccagattccaccccgaccaattacattagtctttttggaggcgaggctcagatgtcaatatttttagacctccccaggtgattccagtgtgcaccaaggtcaagagtgactgaactagaagggagagggagacttgaagatgaagcagcatttccccaaggccatggagcataggttgcaagtagactcgcagaaacagggaggaatgcgggatggtgatggagaaatttctgtcaagtggacatggaggaaggcatgtgagaaatgcagaaaaagatgaggtggggatgggtttggggagggtttagggggcaggttattcagttcagcagaggtatgggggttatgaaaagcaagatggttataacaataatttggagtcagactgaggaagtgttgactgacatttaaggagtaggtgccatggaaggtgtttgggctcaggcagcctcactctaccttaccaggatggtgggcacagggcaaaggggctaaacagcagcagaagcagcagagggttccatcacataattttgaagtggagaagtccccacctattccctgaagagaaacatcatgtggatgcccacaacggagaagatatggagagtcagagagaacaatctgcaaggcaaaaagcctagagccctttccccttaacccctcctccctaaactcacatgcactaggggaggacgagaagaggaaaaaaagcaagtcccccttcttccagactgcaaggacctcaggccatggtcaaggcagagcttggttctagcaggaattgggatgaatgttataatgaatgtgtgattaaagttttaaagttggattgggctgggcatggtggctcacgcctgtaatcctagcactttgggagaccgaggcaggcagatcacccgaggtcaggtgttcaagaccagcctggccaacatggtgaaaccccgcctctattaaaaatacaaaaattagctaggcgtggtggtgcatgcctgtaatcccagctacggtggaggctgaggcaggagaattgtttgaacccaggaggtggaggttgcagtgagccaagatcgcaccactgcactccagcctgggcgacagagtgagactccatctcaaaaaaaaaaaaaaaaaagttggattgaacaggacttttgaatcacagcaagtctggggacttgcctacggtgtcatgaaagattaggagagaaatttttgatcaaatatctactgtgtgcttcccactgatggaggcagtgagagtacagctcacagtccttggggagctgaaattctcacaagggaaaaaaccgaagtggacaaaaacacagataaactaatacatctcacagatgactcaggtggtgagggctgctaaggagaaaagaaaaggcaaggccacggagggtgaggtgatgggctgctggctacttagacagtaggcaaggttctctgaagttggcgtggaggcaaggaggtagctcttctgatccccagcctgggtccactgctctgagctactccggtctgacagcccacgtgctccccagtgctcatcacagaaaataaaaggggctatgtctaggttgcccgcagctcctgtcctgattgggtttcctaaagggctgcaaggcaatgattcttttttgtggttccagggctagacatacaggggatatctattgaactttctcaaaacaaaatggaatacagtgatgtcagctgaagggactaggaattactaaaatatcaagtggaccctatggatctaggtggccatcaggatctgccatgatggacgccctctgaatgaggaagaaagctgtgagtacttccgtaacctggagaaagaaccctactggagcagacacagttcaaaagaactccaggaacacaggagcccgctgcctttctgcattgccccatgacatcttctctagcctctctgcttccctgatttcccaactgcagtaatgtctcctgccttggacagacagtagctatggaggagcaagatctgccggcccagggcaaggagtaggtttgcctgtggctcttcctgagtgagagttttatggcctttccaggtgaaattctcagcttgaacttaagcccttactttgaaatattttttttttcttcttagattgacattaaaaaataacataagacttctgcttctgggaagatggggcacacacactttctcctgttcctctcaccaaggacaatgaagaaccctggacattatagagaaaacatacataaaaggattctgaaaggtggagaagagaaggcagaccagctgaggacccgaggaaaaacacgatggtgaattccttgggttttctttttgcctcaagtaccccagacttggagttgaagaaattagcaacctggaaacacctataggctctgacatactcacaaatcctttccgaaagcctactctctctgactaaaggaccaggaaagggcaatctggcaagacagaaaacttttagacaatgaccatactactccagccaaataccacaggacattctgtggtctcaccatctcccatgccagagaaagccaagtggggagcctagacttccactttcacaagaccgtaataggttatcccaatacccctgcaagatggcatctgtggggctaagtagggagctgggattctcatcctcaccggttggtaataagccctccccaccatggtgtccgcggggaccacatggggagcctggacttccaaccccacccaggagcaatgagatgctcctccctctccccactggggtggtgtgagaagagacccagtggagttagcgtcagccagtggtaatgagacctccactgtggtatcagtgaaggtcatgtgagcagaaaactcccgcctccacccagtagtaataaggagtatacccccgccccccaacaatggaggctggtgagaaacctggatgtttgcctccacctgacagtaatgaggtagcagccccagtactgctggaatggtgtccgggacagccagctaaaatagaaagtttaagcaagatgcagtctcataatatgaaaatggtcagatttcaattgaagataacttgtcataccataccaagaactaagaaggcctcaaacataataaaacaaggcaatcaacagatgtcaacctggaaatgagatgacagagatgctagaattatctaacaaagatttttttttttttttgagacggagtcttgctctgtcacccaggctggagtgtaatggcacaatggcacaatcttggctcactgcagcctctgcctaccgggttcaagcaattctcctgcctcagcctcctgagcaactggtattacaggtgtgcaccaccacgcccagctaatttttgcatttttagtagagatgggtttcaccatgttggccaggctggtctcaaattcctaaactcaagtgatctgcccgccttggcctcccaaagttctgggattacaggcgtgagccactgtgcccggcctctgacaaagattttaaagtagtcacaataaaatgcttcaattaacaattgtaacagtgcttgaaacaaatgaaaaaatagaaagccccagcaaagaaatagaagatataaaaataactaaaatggaaattttagaattgaaaggtataataatgaaaacaaaaagcccagtgagtgaaatcaacagcataatgggagagacagagagaagcagcagcaaaaacctctattagtagagacaacagatgacaacaaaaaagagagagcaagagagtcaaggtacagattaccagtatcaggtacaaaactggataggagaatgccataaccaatgctacctacataaatttgataacgggcaaaatggaacatttgctcaaaaaacacaaactattataactgacccaatataatataaatgatttaaatatccatataactattaagaaaattgaattcataatttaaaaacttccaggaaagaagtcttcaggcccagaagacttcactggagaattctatgaaatgtttaaagaagaattacaccaattctacatgaaatctcctagaaaacagaagagggaatgcttactaatttattttataaagatagttaccaaaaacttggtaccagaaacagataaagatggcaccaaagaaatgaaaaataccctactgatcaatatgcctcatgagtatagatgcaaacattctttacaaaatattagcaggtagatttcagcaatatgtcaaaagaagtatacatcataaccaaatgggatttactataggtttgcaagcttgattaatatttgaaagtcaattgatgttatccacaatagtgacagactaaagaagaaaaatcacatgatcacaacagtgaatgcagaaaaagtattcaacaaaattcaatcctccattcatgataaatctctaaggaagacagtaacagagggtgcttcctcaacttgataaagacgatctacaaaataaaaattgagaactaacattatccttaattctgaaagactgaatgcatttctcctaagattaggagcaaggcaaggatgtcagctctcattatttgtattctacatagtagtggaagttctaggaagtatattaaggcaagaaaataaatatagggaatacacattgaaaaggaagaaataaaactgtccccagagaagatggcaaaattagacaatttcattattttcaaaattagaaaatcccaaggaatcaacagaataacacctagaattaataattgagttcagcaaggctgaagaatacaagataaacatgtaaaaatgatctagatttctatatactaggaatgaacccatgggcactgaaattaaaaatacaataccataataatcatacgaaaatgaaatactaaggtttacatctcacaaaacatgtgcaaaacttgtatgctgaaagctatataatgctaatgaaagaaatcataggagacctaaataaatggagagacacacaatgttcatggattggaagactcacatagtaaagatgtcaatctgccccaaattgatatacaggtttaatgcaattcctgtcaaaattccagcacttgtagcaagacattttgtagagatagatgaggttattctaacatttatatggaaagacaaaggatttagaataattttttaaaatataaattgatgaatcagtctatctgatcacaagccttgttatatagctacagtaagcaaggctgtatggtattggtggagacatagacatatagaaccaatggaatagagaagccagaaaagacccacacaagtatgcccagacgacttttgacaaaggtgtaaaagcaattctacagaataaagatagtcttttcaacaaattgtgctagagcaatttgacatctatagaggaaaagaaagaacctcaatttaagtctcacatcttatataaaaattatctcaaaagagatcgtggacttaaacataaaacctcaaatataaaacttttaggaaaaaaataagagaaaatttctgagacctatggttaaaaaaatccataaaagaccaaagaccaaaagcaaaatccataaaaagaaaacataataaattggaattcatcaaaactaaaaaattttgccctgtaaaagatcctgttaaaaagatgaaaagagaaactagagagtgggagaaaatatttgcaaaccacgtatctgacgagagactagtatttagaatacatttaaaagaaaaaaattcttaaaactcaacattaaaaacaaacaaaacaatccaattagaaaatgggcaaaagacgtgagggggcatttcattgcagaggatatgcagatggcaaataagcacataaagatgttcaatctcattaaccattagaaaagtgcaaattaaaaccataacgagacatcactatgcacccatcaaagtggttaaagcaaaaaatagtgactattaaatgctgggaaggatgcaagaaactcgattactcactttacaatgtaatcactttacattgctggtagaaatgtaaagggatacaggcagaatagaaaacagttagacagtttcttaaataattaaacatgcaggcagggcgtggtggcaagtgtctgtaatcccagctactctgggggctgagacgggaagatcacttgaccctgggtggctgagccaagatggcaccactgcacttgcctgggcaacagagcaagatccaatctcaaaaacttaaaataaataaataaataaaacatgcaactatagtgattgcactcctggtcatttctcctagagaaatgaagaattatattcacacaaaaacctatgcattaatgtttatagcaaagttatttacaatagcctcaaagttggaacaaccaaacatcaaactggtacttccacagcatgggatactacttggcagtcgaaaaggaccaatatctaccaagacactcagtgattcggattaatttccagagatttatgctgaaggggaaaaaagcctatgtaaaaaagggtacccactgtatgatactatttagatagcattcttgaaataataaagctatagcaatggagaacagactagtggttgcaggaggtaagaaaaggatgggggtgagagggaagtggatgcacctgaacagtcagtatgcagtatccttgtggggataaaaatgttctctatttgattgtatcattgtcaatatcctggttgtgatattgcactacaggtctgaagatgttaccgttgagtgacgctggataaagggataactgttgtatttcttacagctgcatgtgaatctacaataatttcaaagttaaaaagtaaaaaaaaaaaaaaaaagcttgataggataattctggaagagcaacaatgaagaaccacttaaaaagttgaacttttgggatctgcagttaaataaattcgcatgtggttttaacatgtgaaattaacccataacaatgtgtgatggaatattttgcagccatgaattatttaaggagtgtgtaatgacaaaataagtgtccatgataaccgtaaaaatgatcagcctttatgtgtcaggcccagtgctaagcttgttaaaaagatcccgtttaattcttacaacgatcccatgaagcatgcactgtttgtaattccaattatacagatgaagaaattaatgcacagaaagaataaataacttgcctaaggtcataaagtagagttgggatttgatcccaggcccagctgatttcagaggccaaaggtttttcagtgctgtgctgcactgattctatctcctttccttcagatgtttactcaaatattatcttctcagcaagtcctttcctattttaagttcctgccactttattccttttctctgctgtatatttttctactttgtaaccatcagccatacaacatatgttaccatcaaccatacaacatatgttagcatcaggcatacatgcatacgttgtatggctgatgataacaaggtggtaaaattccaaagacatataggaatttagtatatgataaagatgatacctaaaatctatggaagtgaagaacttttaaataaaagatgtaggaaaaacagagcagccatctggaaaaaaattaacttggtgtcacaactcaaccctctaccaggataaaatccaaatagattaaaaataatacaaggaaacatggaaaacagcttttcattttggattgagaaggcttttgtgtgtatgactagaaatccagaagtcatgaaaaggaagattgaaaagtaaaaaaatccaaatgtttacaaaaacattcattggccaagcttgtgtgaagaaggcaatcatgcattgctgttacaagtataaactaattcaatcctgatggagggcagagtggcattgtgtaccaaaactgtaaaaaggatatattcttttaccctgtatttccatctctaagagttgatgtagaggataaacctaaactcacacgtgtgaaataacaaatgtacaaggttattcattgcagtgaggttaatagcgaaagtctggaagccagccaatgggcattaaatggggtcctggttaaataactcatggtacaaccattcaacagaatactctgcaggcattacaagtgaggaagctccctacagatacagaaagtattgttaactgaaaacaagcgtggaatagaacagagtgcatattatgttaccgtttgtgtaaaaaagaaagaaaaagaatttatgttttatttcttatatatgctcaaaggaaccctagaaagatacattaaaaatacaaacagcaattatctactgggtggcattttataattttttgttttgaacagagtgaatatgttacgtattaaaattaagactaaagcaaaatatgcatgattaactaaaaaaatttaaaaacatcaagagggccaagctaagcacagttgtgatgagagtccagccttcaggccaccagtgtgtggcctgtgctttaaacatgttatttgtaggtgctgctgctattctcatcaggcctccgaatcattctcagcaaacaacattatacggaaacagaaacattctccagaaaatacctggaaactgtttttaagcaaacaggcgtccgtggtgttagcttgtttttcacctctgtgtgagaagtttatatatattttcttttttgttggcttcaaagagcaaacagataggaacactgctaaagtgattacaatttgtcatgttgaaaaataatgccgccttatcataatttgattgtctgtaataaggcccatatggaacttctggcactttctttcaactattgtcagctggacttcagactcctttaagcagatctacattgttaaagtgaaaatataagataaggcttaaaaagccttgtctggaatgatctgtgatgcctctactccatctagatttcctcattgtgtagcactgattttactcttagtcttaacaccacgaatcagtactgaaagtacaggtgaacacaagaaaatttgtgtgaaaaatgttgaatggtacagaaactcatgactccactcctttccatctgtcagaaatttgagccccatgctgcctgggataaaagggaaggctctgcttcctctccccagagaatatcacgcgagcacagagggttcgatttgctggacaacaatagtctctggacaatcacgaagtcttcatttttcttcttctgaaaacactgtcacctgcgtgtagccattgtcagattcaggaagaaaaatagggtttggttaatttttgaagatagaatttgtcccccaatttgcctagaaaggaaagcaaattaatatgcaagcaggaaggaatgtgaagaccaatactaaaaatattttgcagaatctcagaatttcctaagcagactatgattttttttttttttgagatgttgcccaggctggagtgcaatggtgcaatctcgtctcactgcaacctccgcctcccaggttcaagtgattctcctgcctcagcctccgagtaactgggattacaggcatgtgccaccatgcccggctaatttttgtattttcagtagagatggggtttcaccatgttggccaggctgatctcaaactcctgacctcaggtgatccaccccccttggcctcccaaagtgttgggattacaggcatgagccaccatgcccaaactctttttttttttaagtttgttttactacagtgctcaaagccactgaaggaaggtcaataaatatatattaatgtaggtaattctgtacttttattttttccactactcctacccaattcacatcaactgataaaaattcaatgagtagttttttttttataatgcattcacatctttcaagcccatggcaaaaacagggaaagaacacagacagcacaaccataggaaatccaattatgaaagggcttcaaatctgcccacttaggacaacatttctctttgtgatctcctgctggagatgattacacattagctataagtatatttaaaaagttgttattctttctgaacaatgaattgtcacataagctctgggtggcatagtttggaaattattgttagaggaaaataacctcttgttgaactgttgctagcagcctgtggcaatttctaattaacacagctcaggaatcctcagcctcttaatgcagtctagaggaggaatcgagaaattacctagatggtggcatttttttacttttagttagattggtggttcactacagtgctccttttataaaaaagagaaaatacagataacaaagaataaaacgaaatgcatcgattattctattactgaaagtcaactgctgtcaacaatttgcaattttttattccacgctgctctttgggtgggatgacagagctatggcacaggaaggcagagatcatttttacccagaggagattcttctgcatgctattttgaaatctgcttttctcatttaacattatactatcactttcttcacctgaccaattctatttttatgtcaccctcgtttacggtgtctagtgtaagggtgtgccacaatcaatatgaaagacctattggatcatttcagctttttttcttacagacaatactggaaattttttaaagccccatgcataaaatattgatcatgttctcaatacattatttttaaacattttttattgatgcataatagatgtacataattttggggtacgtgtgataatttaatacattcatgtaatttgtaaagatcaaattcgtgtacttgggatattcatcacttcaaatatttgtcttctcttcatgctaaaaacattcgacttattctattctagctagtttgaaatgtacagtaaactatagtcaccctcctgacctatcaatcaataaattcttaaatgcagatttgctcattcagaaagcatgtgtgtttgaagactttaaaattgcatactgccaaagcgccacggtggaaacaagcttcttagtggtccaggtagttgattaagaaattatctaagacttcagagggaaataaaataacatgaaaatataaaaccaagaaatctagatttccattgtcctctggcatcttttctgagatggaaattgagtctggataacacagatataaaaatgttccacttagccatttttcttcctcttttggggaagagagaggcaatgttaatttcagctgcttatactaattgaaccaagccgggttggaccaattatccagtgtgatactctctactgtaaatcacaacatcactacctgttttactaccctgtggacataacctcaggatacttaaggctcatctcacacgggggtagcagaagtctagcccagggccttagcatggtacatcatcattaatccatagttattaactgatgtggagatgttacatttgtaagattaaataaagcattgtctgttgttcacatagggggaggggggaaagaaatctatctaagaaagcaacgcacacttgcttcccatataaagctagtgtacattttctcttttctccctcagcaactcctctgcttgaggggtaagtgaatttgtcaacttgagttccaatggcaagtaaaatgtgggtagagaattaagcaataaaatgttcttctcttgtttcccttttggcagcaggctttgctttggggatagtcctaaggacacatgagttggcacactcttaagtatagttcccttatgtgtgattttttttcttttcttttttttttttttgaggtggagtctcgctctgttgcccaggctggagtgcagtggtgcgatctcggctcactgcaatctccatctcccaggttcaagcgattctcatgcctcagcttcctgagtagctgagattataggcgtgcaccaccatgcttggctaatttttgtatttttagtggagatggagtttcaccatgttggccaggctggtcttgaactcctggtctcaagtgatcctcctgcctcagcctcccaaactgctgaaattataggtgtgagccaccacgcccggccaatatgtgtgatttaaaatggaaaaatactgctgcaggcagagtgagtgaagagtgattcccagggtaagccacactgggcaaaagggatttgtggaagattcttctgttccatgattagttcctaacaagcacaaccttccagactggtgacagcatttcacatttactaaaggaaaaatacccaatgttacggaaaacaaacaaacaaaaacaaaaaacaaacaaaaaccacaccagaaaacctgcctttaaatacaaaaaactaataatccacagcctagaacacattcgtcatctatttaacaaacacttccccaaagcgagaaaacagttttgaatgctgccagaattaggttgcagactttctaagaattgtttggcccgtgcaaagaaagaaagaaaaagtcacatgctattcactgactgtttaaacacttctctgtttctgttcctcacccagttgtgattttcactctcctgtctactttctatctcaaaactctgtttatttcactcagagctctttctaaactctggaagtgtttgcttgttaattctctttcttttttaaattgttggtctctccactagaaggaaagctcccatgaagtacactgttctacctgctggggaatctaaaatcattcctggcacaaaggaaatactcatatttgttgcatgaataaatgaaagtatccacttactttttttttttttttttcgagacagagtctcgctctgtcattctcctgcctcagcctcccgagtggctgggactacaggcgcccgccaccacgcctggctaattttttgtatttttagtagagacggggtttcattgtgttagccaggatggtctcgatctcctgacctcgtgatccacttgcctcggcctcccaaagtgctgggattacaggcgtgagccaccgcgcccagcctcccaccccttttatatattgcttaacactggctgcctgattgactctcaggctggaatgacagatggtcatctaagtagcttcaaattctgataagtgctatgaaggatgaaggaagtaaagtggtccatgatgggtgtatttacttgattctcaactgtacccaagaaaaataccaatgcaagtgttatgacgaaggacaacctacatggctgcgctgctgggaatcatttggtgaactggagagtgggtgccccatcttaagggacagtcacaactcacattctgtctggaaatatagggcaaaactacccattatggggaagtctgaaatatagaattgtattgacatattattgctttaaaatatcatcaactttgttaattcaaaaatataattaattaattaaaatattatttaaaacactatgtaggccaagtaagatgcatctctggctagaggccttctacagatggctagttttcaacttctggtttatgttttttattttattttacttcttcaaacccacagccaacatcatacaacttctggtctaaatgcctagctcaacgttctctagaagaaccattccttggaaaattgagctaccttgttagaggcccaacagctacatggatgattaagtttgagaaacacttggttaaacaaagtgaaacaggcgtgcttgctgcaggacttctcagagcctttagtaggtggatgtccattgtgaatcttcagtagagactataaagcaaatagattttctgaaactattccatagcagagccctatttctaggcccatcttattggactaacgttccacagaccaacttggaaagtactatcacgctggttaacattaggtgtcaacttgattggattgaaggatgcctagatggctggtaaagtattgtttctgggtgtgtctatgagggtgttgccagaggagattaacatttgagtcagcggactgggagaagaagacccaccctcaatgtgggtgggcaccttccaatcggctggcagcatggctagaacaaagcaggtggaagaaggtgggataagctgggttgctgagtcttccagccttcatctttgtcctgtgctggatgcttcctgctcttggacgttagactccaggtactttggcctttggactcctggacttacaccagtggtttgccaggggctctcaggcctttggccacagactgacggctgcactgtcggcctccacacttttgaggcttttgaacttctgccactactggcttcctacctcctcagcttgcagacggcctatagtgtgatttcaccttgtgataatgtgaggcaattctccttaataaactccctttcacatatacgtctatcctattagttctgtccctttggagaaccctgactaatacaactaactttagaattttttaaagatataagatgtttcaaaagttttaaagtgtttcatctctttgaacctataggcacagtggttaagtgtgtgggcatcggtgaccaatttccaccctgccactttctagcactatgatttgcacaagttactttacctctccgtgacttagtaaacttgataagttatagccgttacaacttctgagggggcgagtcagatgggacaataccagagggaatgataactcaaaatttattttacaaattaattgcaaaaaacaatttactagatatttcaatggattaacgccatgacatgttaaagaccaaatttaaaataccaagtagatagtacaaatgtagacttgtactatgattctaaagtttaagtgaaatcgtatacaccacatattttgcaatgactttctatttcaacttgtgttaggcagagcagataatgacgttgcaataatacatcctaacagtctgaaaagttgaaccatgacgtgtaccacccttattcttgtcaggttcatttaacaaacattattggatgccaacatgtgccagccattgtgctaggcattgggaatactcagttgcataaaaaatggtcacgtctcttaagataactgtctcaatgtgtcgaagtggtcagataacagaacagcgttctccaaatttcagactgtgatcattagcagatttaaaaataaggtagtgggtcaaaaccagcagtaaacaaatcaaacagaatagaaaagaatacaaaatccctgcaggtgttacatgctgcaagaatagtattacttcatgaattctttgtttcatgtatgcgcatgtatatcagctcaagtaaaatctagttcttactatggggtcacagttaaattagaaaactaatgtaatggatacactcagatgaattaccataggtggatactgtagcagcttctacttgctccattcacttaatgatttccagacaatgttaggtagagaagataaatctggtttctatctgtggcatgtcctctttgctggaagagccttctttctactgaagaaactgaaaatgctggctgatagctatttgcaccttgacacagacacgtgactcaatttcaccaaagggctctgaggataaattttaggaaactcctttcttatttataggacattatgacacatacatcggaaatattacacgtccaattccaggtcactgcaatagagtcaatatcacaatagagtcacacacatttttcggtttcccagtgcacataaaagttctccactgtcctggagtctattaagtgtgcaatagcattacgtctaaaaaaaaagtacatactttaatttaaaaataccttgtctcatggtgtatatgtaccacattttctttacccagtctattgttgatgggcatttgggttgattccatgtctttgctattgtgaatagtgctgcaatggaatactatgtgtccataaaaaggaacaagatcatgtcctttgcagggatatggatggagctggaagccattatctttggcaaactaacgcaggaacagagaaccaaacaccgcatgttctcacttataagtgggagatgaacaatgagaacagatggacacaggaaggggaacaacacacactggggcctgtcgggggttgggggagggagagcatcaggaaaaatagctaatgcatgctgggcttaatacctaggtgatgggatgataggtgcagcaaaccaccatggcacacatttattttaagttctggggtacacgtgcacgtcacccgggctcctgcacatcctgcatttgtaccccagaacttaaaataaaaattacaacaaaaactttatctctaaaaaatgctgacacaaagacacaaagtgaacacaggccattggaaaaatggtgctgacagacttgcttgatgcaggattgtcacaaacctttaatgtgtaaaaatgcagcatctgtgaagcacaataaagagaggtactcctgcatacttggaatcatgttaaaaccacaagggactaagcctagggactaagcaacaatggaggacaccagtagagaaagactgaggcgggcttgtgggggctgtgaagatgttgaaccaacctgaactcccctacctctagggttctttttacatgcaagaaatagtacatcctccttgttaagtgaaccactattaattgattgttgtgtgtgtgtgtgtgtgtgtttcctgcagccaaagtaaaaatgatatattaccaacccctaaatgatacactattcaaactccatcactctgaaaagccatttgatctatttcataattactcatttctaagtttctaacaatttagaaaatatacagttttatttagcatgactactactgatggcctatattatcttctaactttacaaaaacccctagggcaggtagtagcttccttttgtggatgaaaacacaggtttttaaatgattgagtataacaggcttaggtgacagatggatctcgattccacttctgccactaattagctttgcgaccttaacgcaggtaacttaagttctccccaagttctctcctctgttcaatggcaatagaaatacctaccttgttgggtttttttaacaataaaaacagataatgtatgcaaaatgcttactgcacagcctagaaataatgaattattttaaaatggggctattattgtcatttaactcaaccacacagctatttagtggtagagtctggactcatacctaggtcacccaggctcctaacacttccacatcacctctgccactgcaaacatctcatattaagcgtttcttactgctaaatgcatcaaaatcccagtggtatagctgaggaccttgtttactccaaaacttgcataatgtaagatggattttccctttgcactgacaaagtcttttgggtggctagttctctttaccagttgaaaaggcatggccttgtggacataaggcagaaacaacacaaaataaaaaacagttaataattcacttggccttctaatgttgaaattcggtaattctttttatttgtttttatttttcacttgggattttgggtatttacaactttgcatatgctaacatctttgaatttcattgcctcaagttgtaacttcattgaacaagtttcaaataattggcaaaaatagaaacgttgactatttaagactatgggctttggagatggacaattttggctgtgccaccttttagctgtgtgtcaggagtgatatgctttctctgaactgttgacttcttcatctgtaaaatggtgaaaatacaggaattccctggtaagatttgatggctcaatgagctgatttctacaaaatgatttaatcacagaatttgacttaaaatgcgagagggattcatgctgtccgaaatcatccaagagtggagatatctggttagcttcatggagaacctggcactgaatatcaagtcaatttttgataaacagagagagaaagggacataggcagagaaaataccaggagacagatggcgtttgcacaggtcaggtgttggccatattgactggagaaatttaagggaagggtggaaaatgcagttggaaaataggcagaggaaacattgtggaaacccttaaatgtcagacaaagaaactgaggcttatgggcatggacactaacatttctattgtttcaaaaataattttacaacttttatacctttctcacccaagttaggacttgtgcctttggttatacaactcttaaattagagtcaactgtgctatctctgtgagtttgggttgaggactatggaagggaaaggcaaaaaataaaagtaaaatgtgaagtagaagacagggagaaaacccataatactggtaatagctaatttctctttttcttctttcaaaatgcaatttgtgctaagtactttatatggcctatctcatttaacttctaaaagtgtgaacaatgtgagaatgtgctagatactattattatccccattttacagatgaggaaactgaggctcaggaggtgaagtagcttgcccaagatcacacagccagtaggtgacagaggtagagaggaaacctaggctacttgactatgatgcttatgtttaattcactactaaataccatgtaggaaaggactctggagaccttagttctttaattccaattctaccactaaacagtagagacaggatgaacttgtcattcactgagatggaaaaccccgtgaattaaactggtgggcattttgtttttgtcattgttaggcgatgaatgaagagttccattctggacacattagggttgagatactcagtgagcagccaaatggggatgtagaaattcaagtagacatgtggaagaggaggcagctgagactcacgtctggacttcagggatggatcccggctagagatgtaaatttggaacttgtcaacccatagcagtatttaaacctttgggactgagggaaaccttcaaggaaataagcgtagttagagatagccaagaagtgaaccctggggaagtccaacatttagagggtgagatccagcaaaggagatgatggaagagtaccagggaggtggaaggatgttgtttcaaacagcaaggtgtggcccactcagtcactgtgtcggattcaacttgcaggtcagacctactaggacaaagatagagacctataggatttggcagccagggtgatggtagggaatttgaaacatcatggtggctgtgacaagagcctgaatggagtgtgttcaagagagaaaagaagagaagtgaaaacacagaatattgttcttattattagtagcctgagccaatctgaggaccgatgcacttatcacaatgtctcttaaaatactatgtctcttactagattatacactccttgacagacgagaaacatgatttatttttcaaatgccttgcacaaggttagtgcgaaagtaacgattgcaggatttaattacacttttaaaagaaaaaagacattcttcatcttatgaaactctgcatggcaacactttatgcgccccacacccccactcaacacaaacacaactctggaagtactgtgttgataacagaaatgtggtgggttttatttttaaccaataaaggtcaagtttgcattatgtgattttgtgtgtgtgtgtgttgaatcttttaaatgcatatcttacagctctggttcagttgttgtggggagaggaaaaaaacctcatccctgccaacacattggtttgtatgaatcacagctcagtgaaacctttcaggcatataatttatcttttctttggcctatgtagtaaacgcttcatttgttcatgaattcttgccttgttttaattatgctttgccctgaatgtagttttataaggcacaaaaataagattgtcgttctgaaaacacagaagatttgtatgtttcccccaggatgaaatggtggcatctttctcccaattcacagctctgtgggcttgtggctggaattccaatccagcagggagcaagccataaaaatggggggaagggctgctggagggaggcagtagatgcggctgagcccaaggcataattcaccctaagaattctgaatcaatacactgacatccagccatgtacaatgtggtactcccaccaagaaagccactgattgagaagttttattcatgttactttctgagggttggattgtcccattacatttatagaacaattgcttttttccccctaaatacagaactatgcagccgggagtcagaaaagaaaccttgacaatcagaaggctgttttgttgttgttgttaaaaacctttgcaggcatatgcatctgaatatccataagttcacaggctgagggagaaatggctatttcataacttttctgtgtttctcatgtacatagtacaaagtgggcactcagtatttcaaatttcaatatcactgaaaaaaatggaaatttgtcatgtaacaaaatcagatgcagacttcactggtgaatctgagggagtgaattcacttattcagaaaggaagacagttacaattcttgggtcttctgagagatcattataacttgaaaatattacacaagggctttgctatattagatacctgccatgttcctaacacaagctcccattttctgactcaaatctcattttggaacacattccactcaaattgaggttctacccctaagagttctttttcaataaagaaagctgagttaataaatcacaactccaaaacttttcctcacttttcttagactagaaatagattgagtgtgtcgaggttttatggctgagtacattggagggctggctattctatgctgaactggtttacttgattaagatggggatttggatgagtcaccggacacctgtccaaagatgagtaaaacacattccttcattgtcttcccataaataactcaatcttctcctaactgagccaatggataggctttggatgcccaagcaaaacaaacacatgactgttaaaaaatcacaacctcaaaatggccttagaagcctatgaccaataatgagaatggtttctccactcaggcgcaagtagtaaacagtttctcccatatgcaggaatattgacgactagtttaccgcctctgggcacgtaactttcaggtcctggttcatgcatttgctggaatgttccctgggccatggagcccagttctcctggcatctggcatctcccccacactctgctcccccagcacagcacttggcatcttgcattgcaattgcaggtttatttattcacttctctcactggacagcaaactccaccagggccgagactctgtgtctcgcccttcactgtggtccctgtgcctcacctgttcctagtacagtgtcacactcagtaaagagcagatgcctggtgcatttggagacttattttaaattatacggaaagttattcaaccggcttcttgaactggtgaattttggaaagtgggtgtttgaagggaaaatgtttaaactctgaaagaaatgttggaaataagctctttgaatcaaaatgtatagaaaacacaagaatgctgacagtaagagcctaaaacacatgatgactattatcttttcccaattttaactctccagagtgttcagcggtgcccagccttcataatgtaattcttcgtagcaccctggatgcattaaaaccatagattaacgtgatacttattttcattaaggaaaataatttacgtacagtgctcagagtagagcctggcacattgaacattttcaataaatgacagcaagtgtaattattagcacttcggaagtgcaaagttgcattgtattaagacaaatatatttggagctcatccaattttttcctggctctgaagtctgctagtggcacttaactttattcccaagttttgaaaaatattgttatttaaaaagtctgttaaccaaggaaatgcatgccctaaacctataatgtatcaagttttacttccttcttcttttaaggagttcttttcctgccttgaatacaaacaggctctctcaaggttaaaagcaaatgctctttttagtgtcaaaaagagcttgcctttcttcgctcaggaaaaaaagcaactgattccaggataccttctttgaaaaccaacacaaaaaaaccccccaaaaaacaaaaaaaaaacccaaaacccctagtttttacaaaggtttattactcctacttgttggaaaagaattactacataaaagagtctgcccagagctgtaaaatctccttattcaaacacacaccttagagcaaaagatggttaaatatcaattcaggctattaacagtaagggacgaaatgtgttccaacaaaactctgcatgtcaacaaactacagagactaggtaacatcttttaggaatcatttttattccactaatgccttttcctccagaatccactgatcgtaaacgcaacctgtctacttccgcctttgaaaaatggatggacaaattcatctgcatgtaactcacctcctcttttcttttacataaaacagatgccacagctgttattgttcttcacacagaagtttctacccagagaaacatcaggatgacactctgctgcaatgtgctatttgttctagaggggtcaacagcttgccaccttgcctaggcccagggtgactgcatatgtgcagtggtcttatcccattagcgcccccgagcatgcattcagaaccaagtggatacaccttggcacacttaccttccctgcagggacatcatcggactgccctgataagccaggaacctcatccaccttgtcttgatgctctgccctcttggcttcctgttggctgtcacctggcaccttttcctgtcccttgtccagcttgaagaatttgtcaaaaaagctggagtccttgggcttggagggagcttctcctcctgctccccctgtctcaggtgggagaagcgtgggatccctggcggcagagaggaccttgtcttgggccggggcgtgccctggggttttatctgtgtcctgccccggtccagctgccaccggaagtgtccagctctcacttgggtctttgttcgctggagctttattggagctgacatcaagcttcactgatccaagggatgaatctgcggcttggtctccggtacgtcctggtacaggccgagagagcatcaagaaaaaacgagatttagcagctggtgcctcgggtttggcctctttcccaagattctttccgttggcatccgcaacagcacttatctccgttgtctcgggggaagaagtggccacattatccgtcttgacacttattcccaagtcgactgtaaacacaaacataaacagtggttattcagccaagccgggaaattcaggcactaataatggactccagacattttttatacaaaagccatactgcatactggaactgtgttgttctctggtcattctgaaaggcagaagttagctctctacatctccttggaccctgcttttcttgggagaggagaaggcaaggttggtgaggagggaaagctacttaatggaaagtcactagctgccaggtgtggaatgagtgatattcaatgttaattaatcttcttttatctgtgtaagaactccgtgagcagcatattgtcatgatgtcaactgggaggcagtacagcagttaggagcttgggttctggagctagaacaaggtttctcaacctcagcactactcacatttgaagccagattattctttgttagggaggctcatcccgtgcctcataggctgattagcagcatcctggcctctgcccactagacgccggtcacatttcccagtcatggcaaccaaaaatatctctaggcattgctaaatgtcccctggaggacaaaatctcttacgtttgagaggcactgagctgaaatgtctttttgaatccagattatctaattttctgtgcctcaactttctggtaaaaggagacagataataaatctcgtaattttgttaggaagattacatgagttaatagttttaaagcaagtacaatagcacctggaatatattaagtgcttaataaatatcacaaacattagttatcattattcatgagtgagaaaactgacagtcagagaggtcagtacaccctcccctggctgcccagtaagctagtaagcagcagagtctggcttcaggcagaaatctgacttctaagttcatgcgctctctgtcttaccagggacttgtattagcatagactgttaagaatatgggaagatttttaaaatacagtactcagaaaatttctctttgaaaggctggaagagcagatatccacacaagaaggcaaattagacctcaggccagtgtggaattaaaggtgtagggttatctggtcaagactgtgtgtgtggatacaggctccaacccctccaggcaagggcactgtttccaacatccaccctttctcctttgacctctaccttgacctaaattaactataaaaggtccttcttttctaggaccctactataaatcagtgaaatattcaggaaaaaaagaacaccaagaatgttgggatcccagttaaagatcaagattctctactgataagctgtgtgatatggagtaaatcactaaagatctttgaatctcttcatttgtaaaatgggaatattggtagtcctactgcagggttgttgtaatgcttaaagaagaaaagtcatgcaaaggatctggcacaacgccttttccataataagtgcttagtaattgacagatactgtgataacttttcaggtttctctcatgcctttgacaacattgcattttgcttgctctatctgtagtcagacacttcttaatatctgtttgcaggaagacagaaaaataaagggaagaattgagatttctttgatctattcatactgctcattaatatgtagtgagaaatacatacacacacacatacacacacatgcatccattagcaattgtttttgcccaactctagtgtctcgcagtgtctagactaaacaacaaacaaaaaaggggggagagtgagctggattaagcattgaggcacagtgaagaaatggtctggggcaagcccagggatgaatgttaggggtttctcataaacctgaacctgaagaaaatcaccctgccagcatattgatcttctagctcttcttaacctttttttctgtgattcaggaattcataatgatagaaaatattatactaaagaagaaaaaaagagggagaataagtaagtgatagatggatgcatcagggtgtaaagttagcaagtaaggctgttgaagtgtcagagtgaatataaatgaattgtgggaatggtccatgccaggagaagagggtatggttgacaaaaagggaaatgctaagattcaaaacagggaagggcttttcaaaatgccaagagcaccaacttatatctttcagtttaattcctctcttccttacccactggctggaaagcaaaggagctagtggtaagtaagagtgttatagccagagaaaaagtcttcaaaaaacacaaagtactttccatggacaaccttttttattttaaagtgccaatatgttgctttgaaaaagaataaattccttacatccaggtatctggactagacttcagtgcatttagtgattatagcaaatccaaacagtagcttttgatatcagagaatgggtaaagtgtttttgacaatttctaagaacttagagttcttcggtgatacgttccatgcaactgaagctctgctctccaaatttaggtgggtacatacccaagtccatcacctggggcttctatttcctttgctcagatgctcacctcctaggtgggcacctgacataagatagactaataaaaataagtcctgtaacttttgatactcctattaaaaaagagttgcaaaccaataggaggtacacttgagaatcagcacaaatgaaagtagaacctggaaatccaggaagcagatacccaatcatgtcatttaaacatttagatccagctgtgcctgaagctgaactttagcattacataagccaataaatcactcttccccaacttacgccagttgaaattgaatacatactcagtgactttgagagaattccagggaattggtcagtccctgtttcacttgtaaatacacagcaatcaagcctaccaaatctatgattgattggggtgtctgaaagagatggagggaatggaatcaacctgaaaaacatatttcaggagttcatccctgaaaacttccccaacctagctagaggggccaacattcaaattcaggaaatgcagagaaccccagtaagatactccacaaaaagatcttccccaagacatcatcatcagattctccaaagttgaaatgtaagaaaaaatgctaaaggcaactagagtgaaaggcccggtcacctaaaaagggaagcacagacttacagtggacctctcactggtaaccctacaagccagaagagattgaggaccaatattcaacattcttaaacaaaaagaattccaacccagaattttatatctgactaaactaagcttcataagcaaaagagaaataagatcattttcagacaagcaaatgctaagggaatttgtgaccattagaccttccttgcaacagttcctaaaggaagcactaaatatggaaagaccattaccagacactacaaaacacactgaagtacacagaccagtgacattgtaaagcaactacataacaagtctgcaaaataaccagccaacatcatgatgacggtatcaaatcgacacatagcaacactaaccttaaatgtaaatggactaaatgatcccattaaaagacataaagtggcaggctggataaagaaccaagaaccattggtatactgtcttcaagagacccatctcctatgcagtgacacacataggttcaagataaagggatggggaaaaatctaccaagcaaatagaaaacagaataaaacaggggttgcaatcctagttgccgtcaaaacagactttaaaccaacaaaggttaaaagaaaaaaatatgggcattgcataaggataaagtgttaaattaaacaagaagatctaactatcctaagtatatatgcaccaaacacaggaacacccagattcataaagcaagtttatggagaccttcaaacagacttagactcccacacaatagtagtgggagactttaataccccatgacaatattagacagatcattgagacaggaaattaacaaagatattcaagatctaactcagcactaaatcaaatggccctgatagatatctacaggactgtcctacttgaaaccatacaattacatggtaattgaatgacctgctcctgaatgacttttgggtaaataataaaattaaggcagaaatcaagaagttttttgaactaatgagaacaaagatacaacataccagaatctttgggacacagctaaggcagtgttaagagggaaatttatagcactaaatcccacatcaaaaagttagaaagagctcacgttaacaatctaacctcacaactacaggaactagagaactgagagcagaaaaacctgaaagctagcagaagacaagaaataaccaaaattagagctgaactgaaggagattgagacatgaaaaaccattcaaaagatcagtgaattcaggagctgttttttttttgaacaaattaataaaatagaccattagctagagtaataaacaagaaaatagaaaagattcaaataaacacaatcagaaacgacaagggggatattaccactgaccccacagaagtacaaacaaccatcagagaatattatgaacatctctatgcacataaactagaaaatctagaagaagtggataaacttctggacatatacacccttctaagactgtaccaggaagaaattgaatccctgaacagaccaataatgagccctaaaattgaggaagtaatacatagactaccaaccataaaaaaacccagtactagatggattcacaggtaagttctaccagttgtacaaagaagagctggtacagttcctactgaaattattccaaaaagttgagtaggagggagtccttcctaactcatttgatgaggccagcatcatcctgatatcaaaacctggcagatatacaacaagaaaagcttcaggccaatatccttgatgaacttcaatgcaaaaatcctcaataaaatactggcaaactgaatccagcagcacaccaaaaagcttatccaccatgatcaagtagaatgcaagttggttcaacatatacaaatcaataaatgtgactcatcacataaacagaactaaagacaaaaactacatgattatctcaacagatgcagaaaaggctttcaataaaattagacatccatttatgttaaaaactctcaataaactaggtattgaaggaacatacctcaaaataataagagccatgtatgacaaacccacagctaagatcatactgaatgggcaaaagctggaagcattttctttgaagactggcataagacaaggatgatctctctcaccactcctattcaacatagtattggaagtcttggccagggcaatcgggcaagagaaataaataaagcgcatccaaataggaagagaggaagtcaaactatccttgtttgcagattacatgacattatatctagaaaaccccatagtctcagccccaaagcttcttaagctgataaacaacttcagcaaagtctcaggatacaaaataaatgtgcaaaaattactggcatttccatgcaccaacaacagtcaagccaggagccaaaccaggaatgcactcccactcacaatcgccacaaaaagagtaaaatacctaggaaaacagctaattagggaggtgaaagatctctacaaggagaataatgaaccagcgctcaaagaaattagagatgacacaaacaaatggaaaaacattccatgttcattgataggaagaatcaatatcattaaaatggccatattgcccagagcaatttatagattcaatgctatacctattaaactactgttgagattcttcacagaaccagagaaaactattttaaaattcatatagaacccagaaaagagcctgaattgctaaggcaatcctaagcaaaaagcataaagctgaaggcatcatgctacctgacttcaaactatactacaaggctacagtaaccaaaacagcatactactggtacaaaaacagacacatagaccaatggaacagaatagagaacccggaaataagaccacacacctacaactatctaatctttgacaaacctgacaaaaacatgcaatggggaaaagatttcctattcaataaaaagtgctgggataaccggctagctgtacacagaagattaaagctggaccccttccttacaacatatacaaaaatcggccgggcttggtggctcacgcttgtaatcccagcactttggaaggccgaggagggcggatcatgaggtcaggagatcgagaacacggtgaaaccccgtctctactaaaaatacaaaaaattagccgggtgtggtggcaggcgcctgtagtcccagctacttggagaggctgaggcaggagaatggtgtgaacccgggagacagagcttgcactgagccgagaccacatcactgcactccagcctgggcgacagagtgagactccgtctcaaaaaaaaaaaaaaaaaaaagaagacatacaggtagtcaacaagcatatgaaaaaaagctcaatattactaatcatcagagaaatgcaaatcaaaaaccacaatgagataccatctaataccagtcagaatgatattattaaaaagtcaaaaaataagatgctggtgaggtagtggagagaaaggaatgcttatacactgttggtgggagtgtaaattagttcaaccattgtggaagacagtgtggcaattcctcaaagacctaaagatagaaataccattccacccagcaattccattactgggtacatacccgaaaaatagaaatcattcttttataaagatacatgcatgtgtatgttcattgcagcactattcacaatagcaaaaacatggaatcaacctaaatacccaccaatgatagcctggataaagaaaatgtggtacatatacaccatggaatactatgcagccataaaaagaacgagatcatgtcctttgcaggaacatgaatggagctgaaggccattatccttagcaaagtattgccgaaaaagaaaatcaaatactacatgttctcacttataaatgggagctaaatgatgagaacacatggccacacagggggaacaacacacactggggcctattggagggtggaaggtgggaggagggagaggatcaggaaaaataattaatagatattatttcatcacccaggtattaataatacctatttcatcacccaggcttgatacctgggtgacaacaaacccccatgacacaaatttacctatataacaaacctgcccgtgtacccctgaacttaaaataaaagttaaaaaaatgcaaaaagatgacataccaaagagatgttacttttcatttttaaaaaagtcaaagaatttaaggaaaattaaaaagaaatcaagaatgacagtagcagctccaaaatatttagaaggtagagttgaaaattttgattttcttagtgcagaaaaatattttgtgctgcatgtttttttaaagaaagtcattttatctgtatatgtgattaaaaccttatttccagtgccatcttcgtgtaattgttaagaacttggattgtggatcacaggaacctggctttgactcttaactgctcactctttaaatggataacccgggtaagttatttcctgtctctgtgcctcagttttcttacaaattggcatgaaaataacagtgcctccttcagagggtaattctgaggattaaatgaaatattgcccatacagtgcttaccacaggctggtagatgattggtattcggtaaacagtagttatttttgttatactaatatgttattaatataattaccattttgtatttttaaatgtaagccataaggaaaggaattattccaatagtttaatttacaaacttgagttttctagaaagacttttaaaaacagtagtgatataaatcaatttatcttaagaaacataagtatctgggccaggcaagtttcagaaatgtttatcattttcaaagtaccaaatattctcgtcaaaacaagctgcttcatcagagttctaattatatatttaaacatacatgcacacacacacgtttgtattacaatattcaaaacttctgaggaagaattatcttttttttttcatgtgccaaagctaaaactttcacttgctacagctgtgtattagtctatttccatactgctataaagagctgcccaagactgggtgatttataaaggaaagaggtttaattgactcacagttcagcatggcagggaaggcctcaggaaacttacaatcatggtggaagtcaaagggggagcaaggacctttcttcacaaggcagcagaaagaagtgccaaatgaacagggaagagctccttatgaaaccatcaggtcttgtgagaactcacttacttttatgagaacagcatggaggaaactgtccccatgatccaatcacctccacctggtctctcccttgacacgtggggattatggggattaaattccagatgagatttgggtggggacaaaaagcctaacgacatcaagctgtaaaaacaatagctaacattcattgactgtttcccagcattaggataaatgtgtgtaacaagaggcattttatttatgtatgacatttgtttatttattatttatttatttggataaatgtctataacaagaaacattttatttaagtataacagcaaatctacaagttaggtactatcatcactcccattttacaggtcgtgaaactgaggctctgaaaagtcaagtcagttttctaatgttgtccagctaatgactggtagatttagtatttgaacccacatttgcctgattccaaagttcaaactcccaacaacatgtggtaaccaaagcaggaacagaagagaaagaagaaatagaagggagggaagatgaacaaagtagacaaagtttagttaatagaattagtggatacccaagaaaaaactatgtacaagagggggaaaaaaaccctgttttctcacatctgggaaacattgatatctatatatttttggttttaaataaaaattaggttatgtcattcatttgcataaaaccatccaaagaagggcctcacaaaattaaaacaaaatccaaactctctactatgggccacaccctccagaacttcagctcgtactatgtttttcctcacacctctcaacataccaacatgtttccacctgcagccctcaccactagttattctttcaatctggaaatattttcgctaagatcttcctatggttaccttcttatcattcaagacttaggttatgtcaggccttccctgactcctccatctgaagtaacccctcctgcttactcctgtttattctctagactccacagaggattcatcactctctgaaatgatcccattaatttcttcttcacttgtttcctctccacgacctgtaagccccaagtggacccggacttggtctgctctgcttacagctggattccagttcccatagtgctagacactaggattaagccaggaaacatgggtgaagcagcaagcacagagcttggggcacagcctagcaaacactccacaaaggaccatgattgtaactgtagtagggcacaccaatgaacaggttgggaaactgagtctctgagaagagactaatgttgtgctggatgaaatttctttttctgacaatacattatccaaatcctccaagctttcagtttaaaggggaaagcaggaactatcattataattttatttacaaagtgtccatgtatgaacattattcaccgccgaatcatctcttcctatgcaagcaacaccgtcctatgcatcaatatcctgatctgtcaggattcaggataaagtggacatatacacactaattgcaaagggaaattgtacatcttgcaaaagatgcaggggtttatagagtcttgtaacattggtgagctgctcagatcacacacatgaccgtggttggacaaggatctggcaaagttaacacagatcaccgaagaaggaaaagtggacaacacaacacagtaagttcttcaaaagagttatattagaatatcaaaagattatgttaggcctttgggaaaactcaaaactttatgaagacctcaaaaaattatgcaaaaatgacccttcaatggtcatgctgcaagagtcaaatgacacttcaaacaactgcggctttctatgttgtgcaaatgcatttgttgttttaaaggtcgtaaagtcagggtacacgtggcagatacttatgacttggaggaagacgttagattagatttgaaactttcactgaatgatcgcatttcatgcttttcatctgtacattaaaaagccagaatgtctttgccaagaaattctagcataaataaaagaaaaggatgggattttggaacatcatggtagaattcttgactatcagctttatacaacatgtctggacatttagtgatggaaatgctggattccaaaggaatgtaggcaaaggtactactacccccatgctcttcagaaaacatcctctaaaagcaacagtgatgatcagatactgtggggcaagactgacagtgacactcaagatttccactcttctctttaatcatatatttcctgtcattcatgtgctacaaaactctggaatatgcaaagctcattcaaatgcaaaaccagcctttgctccaacatgagcatatattttcatttaaagacaaatcagatgtttcatttgattttttttataaatctgataataatgtacatttaacccgtgtttacaaccaaaataattaatctctctgaaccctttgtttttcctgtctctatcctccaccctcattgccagataaataacatctgcaacctgatgtggcatattgaactttgtttatactcacacaaacacgtataagcatcccagatacacatatacagggactgtatctgtccttgttgtttttatagaaattggatcacattagacatattttctgatgacttttgtacattatagttggtcttcacagtcaatagctccaaagctatcttatcttctaaaatagctgcataatattcctcagtatggatataccaaaagatatttaaaccattgcctaatcaatgaatatcctggtagtttccacattgttttttccatttccactatagtggaataaactttcgtgttcaaaaatcctaaactggtgctatatttctatagaatagaggcacagatgtagaagtgttaccctcaaatcaatatgcatttagttttgaaaaacagacactgccatattattttcttaaaaaggctctacagattcacatttccagcagcaatgagtgtctcaagcaccttttaagtggtaagcagcttaccaggggaggtggcctattattctatcagtggcttcagttgttaggacaccacgggtcagctgtggagatacggttgtggggcaggttgagttcaggacacatagaagattgccaaagggtgactattattactttgagactctggaaaaattagccaggaaacagagacaagaggctcagggtgcagcaaagcagccaaatcaggatgatagtgttttctttggagcagatatactaatggccaaggaactcataaaaagatgcctaatgtcatctcattagggaagtgcagtcaaagccacagcatgatacgtcttcacacccacgaggatggccataatcagagagacaataaccagtggtagggaagatgtgaaaaaatcggaatgctcatgcattgctggtaggaatgtgacatggtgcagctgctttggaaagcagtttaacagttcctggaaaagttaaacatggagttaccctaagacccagcaattccattcctaggtaagcaagaaaatgaaaacatatggccacacaaaaacttgtacacaaatgtccatagcagcattttcataatagctgaaaagtggaaacaacccaaatatccatcaattggaaaaaggaaatctagcatttgcatataatagagtattaatcagccataagaagaaacaaagcaccgatccatgttatatcatgctttatacttggaagcatggtactaagtgaaagacgccagacacaaaaagcaaaatattgtatgattccatttatataaagtgtctagaataggcaaatccatagaggcagaaaacagattagtggttgccagtggctgggaatagggaaaaaactcagcgctaaagggtagggagttttgttttggagtaatgacgatgttctggaattagacgtggaacgattgcacacatggtgcaaatatccttaaaatcacggaattgtcactctaaaaggtgaattttatggtaggtgaattgtacctcaatttgtaaaaagaagaattagataaataaacagcaacacagcaccaaggggtgggggtaggaaacagacaacaaataggagtgaagagttcacaggaaaagacatgcagccagcttttaagcagaagaaaagatgtttggcctcataaatagtaaaataaaagcacaataaaattatgacacttggctttcccttgccaaattggttaaaaaggagacaattgatgaccccagtggaaagcgtataaaaaaagagcagctgtggctgggtacggtggcttaacgcctgtaatcctagcactttgggaggccgaggtgggcaaatcatgaggtaaggagttcaagaccagcctggccaacatggtgaaacactgtctctgctaaaaaacaaaacaaaacaaaacaccaaaaaatagctgggcgtagtggcgggcgcctgtaatctcagctacttgggaggcggtggcaggagaatcatttgaacctgggaggcagaggttgcagtgagccgagattgtgccactgcactctaacctgggcaacagagttcagagtgagactctgtctcccccaaaaaaaaaaaaaaaaaaaaaagaacagccatatagatcgtcggtgggagtgtaatttggccacttctttggaaaatagctcagtaatatctattaatacttaaaatttcacaaacactgtaagtctaacttccacttctaaaatgttatcctagaaataaaattgcataggggtacaaaggcttacgtatggaactatttgctggactactgtagttgtggcaaaaaactggaaatgacctaaacgcttattagtagaaacctggttaaataaattatcatatgtccttgaggacacagggacacaaagaggggaatgacaggcactgagcctacttgagggtgggaggaggaagtcgatcagaaaaaataactagtgggtactaggcttagtacccgggtgaaaaaataatctgtacaacaaacccccatgacatgagtttaccttataacaaacctgcacatgtaatctgaacctagataaaagtttaaaaaaataaataatcatatgtccctacaatgaaatattccacaggcattaaaattccccaaggaattttagtaaggaaagaaaaagctgtgcccaacagcacgtacagtatgtttccatttgtttttaaaaaatggtgtcgggaggttgaggagacaacttataaatagacatgcctgggatacctctggatataagaaactgtaaagtatttacttctaaggaaggaaatttgggatggggcttggggagccatcagagttagggtggggattttttctctgccttatcttattatgtatatcgctcagaatgtttgctatgtgtatgcacctaccccatccattaagaaatgaagaaataatgaaaagaaaaaatgaaagtagggaactagaaatgagaggtgggattcaaagtggactgaacacttgacctatttcccaatttgcctagggctggcccagcagcgaggcaggttctaaccaatgagcatcagctttgaatggaggggctgataggccaggtgggccctgcttgctgagagtgtcatggccttagggacatctccatgttgcagagtctgagcctctgcttggcaaattcagaaaatccagcttttctttttatatcacctggagctgatgtaactctcagaaggcatttttaagaggactcatgaattaaccacatagccaacttactggcttaagactacgtgacagaaagctgcaaagggggccagccactggtaacatcccaccactgtccctctctgtggaaaacacagatgggatgcacattgtgacgggcaggatgcctggagagcccacaaatctgcaagcacagctgaaattggttacaggatttcaatgtttcattgcttgaagctatgataacttgatgatgatgatgatgatgatgatgatgatgacgatgattttttttatagccatctttttagagggatttgaggtagggaaaaaaataaacctcacactatcggaggttgccaactatgaggtctgctgatggtttggccaacacagtgtttatatttttttgaattgggaaatttcatttaaaagtcctaaaatcaggctgttattgaaatatcttattattggctcagggtttcccagggcagccatccttgaagctgtgtggagccctataaacaaggacgctttccagttccctgcaaactccatttcattcagagccttgagccagttcttacatggtcctcagacttgagctagtgcaagaatacccgggaggggttgtgggaacagatagctgggccccacccccagggaagggggtgtttctgactcaggaggtctgggctccggctacagaaactgcacatctaaccggtacccaggtgatgtgatgctgctggcccagggacaactctgcgagtcactgctattgggcactgctattgcacccacacaaggaggcaggctctgcttacatttttcagttcttgttcccagaaacatttgctctttggggtatgctttgcatataatggatcctacccactaatacagtatgctgcttttattgataaacttccagaaacttgaagcgcaccttaccatttctttgatctcgctgattatttttatttttgttaaatgaaaattgttggtaagttctttttggtgtggtaaaaggatatgaaaagctgattttaaaaaaatgtccactctaggattagaattgtaggtgtgtttattctatttcaagatctggttaaaatgcaccttgaggaaaagaattgagtgcagctgttgttatttctcaatgctgtttctcttttcatgtttttttcatgttgtctcttggtctgtcctatctctcttggtctatcctccaagacagagatgagtgatcttgaaaccctgcccatgtttttatctttggagcccaactgtgctgccttgttttcttctccatccaaagaggcaaagagaaagttgcatattactcaacagcagttgcatgacagttaaaatcagactgtatgagtcatggaacagtaagttgtgtccagagtatctgtcatggtaagtacaaaaaagtccttaaaaatttaaaacagaaatgccaatgttttatttttgaaaaatgtgaagaagaaattttccggccgggcgcggtggctcatgcctataatcccagcactttgggaggccaaggtgggcagatcacctgaggtcaggagtttgagaccagcctggccaacacagtgcaaccccatctctactaaaaatacaaaaattagccagatgcggtggcacgcgcctgtaatctcagctactagggaggctgaggcatgacaatcgcttgaacccaggaggcggaggttgcagtgagctgagatcataccactgcactccagcttgggcagcggaaggagactctgtctcaaaaaaaaaaagaaaaaaagaaattttctaagtgtattccaaataacttttaatattggataaacattacgagtttaaaaatacttatgccagaggagtgctgtgactcgtgcctctaatcccagcaatgtgggaggccaaggagggacagtcacttgagcccaggagtttgagaccagcctggataacaaagggagacctcatctttacaaaaaaactaaaaaattagccaggtgtggtggtgtgtgcctgtgatcccagctacacaggaggctgaggcaagaggattccttgagccctggaggtcaaggctgcagtgagtgatgatcatgccattgcactccagctgggtgacagagcaagacctcatctcaaaaaaaaaaaaaaaacaaaacaaaacaaaaaacttacgcccaggtaaaaattgtcagagaaaaataagaaaaaaactgaatgcccaaaattagcataatggctgaatgaattatagtatgtctataccttgaagtacattgtagctttaaaaaaaatgaattaaagttataccagttgaatttggagttgagatggggaagattattacaattaaaaaaaaacaaacactattaatggatgtgctgggaaatgtctgtatggggctagttaaagtaaattaaaataaagaccagacctgaagaatccctgagcggacaaagcctgttagaccacataaatgagctaaaccttgcttgatttgcagacataagcaaaacaactcgaactgtttcttgtaaatgcctatgctaaagaaaaacagaacttgagctcaaccaatcagaaacagtcaacaaacttaaaattatataactgggtaccttccaatgagatgatcaaataaggcaactgtgtaattgtaacacatcaaacacattttatattatgcctctgcattttcccttaattctggcatgtaatgctttgtcatcaaaacactaattcccttttggttttcttttctcaaattaatgaattgcctctattcagatacactctttgaaattttattgtgtctcagatttgtcttttacaaagtatagaacaaagagaaaaatatgaaagaagaaatattaggttgttagcttgggtgtccttggagggggtagggaagatgtgagatgaggaagaagccaataagaaaaagaaaaagacaggtttcaccaaaacaacaataacagaaaatatgattgcatttattcatatatgttaattggtatgtatgtaagtatatatgcatgtaaaaataaaatacaaagaattaaaatgcatactaatagttatttcagttatctatggctgtgtaacaagcatccccaaaatgattgacttaaccaccattttattaggtcatgattccatgcattaagaattcagggccgggtgcggtggctcatgcctgtaatcccagcactttgggaggccaaggtgggtggatcacgaggtcaggagtttgagaccagcctgcccaacatagtggaaccccgtctgtactaaaaatacagaagattagctgggtgtggtggcgggcacctgtaatcccagctacttgggaggctgaggcaggagaatcacttgaagctggaaggcagaggttgcagtgagccaagatcatgccactgcactccagcctggtggacagcgcgagactccatctcaaaaaaaaaaaaaaaaaaaagaattcaggcagatgccaggtgcagtggctcatacctgtaattctagcactttgggaggctgagatgggcagatcacctgaagtcaaggagttccagaccagcctggccaacatggtgaaaaccagtctgtactaaaaatacaaaaattagccagacatggtggcacgtgcctgtaatcccagctatacaagaggctgaggcaggagaatcacttgatctgggacgtggaggttgcagcaagccaagatcgtgccactgcactccagcctgggtgacagagtgagactctgtctcaaaaaaaaaaaaaaagaattcaggcagagagaggataggatcagcttatttctgctctatgatgtctggagccacagctggggtgccttgaaaggatgaagatggctgggacggctcacacagggacatatgtctggagctttagttctggctatgggctggttcctatggtccttcctcatacggcatctattagctgaaatgcccatgatgtcttctttaatcacaggtctggttcctggactgggatggctggaatatttgggaactggctgggtacctctctcttgcctcatggcttcttcatgtgactagcttgggctctctcacagcatggcaatctcagggtagaacttctgatattgtgtctagcctttctcagagctagtgttgcaagagacaaggcagaagctccgagtcttcttaaaaggcttcttgaaagtcctgtgtcatcccttctactacatactgttggttatataggaccagcccagaggggactacacaggggtgtgaataccaggaagcatgggttattgcgtggtgggttgtatgtgtgcatctttggagactatcaaccacaataatgcaatagggaagataattttatctaacaggaattctccactagactttttggtgagaaaaagcactgagtttgagaaggatgagatttccccagggctcttgctcactcccaaggaagacagaggcacaaggagctgttgggccatctgggagagccagtgttcagaactctctgttattactttagactcagtggtgatacagtgcaatggagggaaagaagaaaggagagtgcctgtgagtgttaccagtggagagttgtccaggttcttggtgttttgaacaaaaaaattggacaaaatgcacaaagcaatgaaagcacagatttatagaaatgaaagtacactccacagagtgggagcaggtttgagcaagtggctcaagagtgctggttacagaaatttctggggtttaaataccctctagtggtttcccattggttacttggtgtatgccctatgtaaatgaagaggatgaagggaagttacaaagttatttacttggtgtacaccctatgcaaatgaagaggatatttcctgccatagctgaagtgcagttacatccatagttgagcatagaaagttgtgggttttctgcttgatttagttctaggaagtccttagcttccccgcctccagaccctattcccctacctcatgaggatggggtgtctcacagagtttcaaggtggagagttgaggatagggagcctcttgagtgagagacatatagcaatgtgaggagagagaaaagtggtgtttaggatgtgagttagatctccttaatgtcttttgaaaggccagagtgaggatatgaactactttcctttgctcaattctaataattctttggaatcacctctggcagacactgtttgtggcctgcccaatagccaatcgtctccagccccaaccatgtattattattattcacttgcatctcaaagagatgcttgattcccagtatcccatgcagctggtatgggccatgtgatgtagctctggccaataagaggatgcctacatggtggcagaggcttcagggaaggatcctccttcctcgcataatacaaggagaaaaaaaaatggtggcaaagtttggcctttcctctcctgcttttggatcccatgatgtagagatgtgatgtttggttctgtgacagccatcttgtgagcaggagtgacacaattggctcatgtacttggtgttttgatgaggctgtcagactgctgtaccaaatttagaactgccacctccagacttcttgctcaaattaaaagtgctatttacttatccagggttgcattccttgaagctgagtgcagcagagtctgggaacttgcccttcggccttattattttattcctctgctaccactggcttaatatgccactgttcattgatcaaccatttctaagtctttagtgtatctcaggccttgtgctgagctctgggaccctcataacaagaaaggatggcaagcgtcctgctctcagggacttttacttgagtttggaaacagataaaaaataagatcaattggagggaaatagtggacactaggagaacacatgtatttgctcccttccagacaagtgctgttgcctatattttttactacatcagggagctatgctttttggcatcaggtctcccattccactttgactaggcattgatattggcaaatgcttctcttctcactcattatgttattggcaggagcacttttctcaagttagaattttcaatccaataaaatgattccacttacatcttttttttaagaaaagcaaaattagtctattctttttaggaacaatgactaggagcaaaaaaggaaaatactaattttagaaaccttttatccaggtcaaacattccttctgtttctggaaaatgacgtgtcctggcagggaaggcatgtcttagtctctgccatacgttagcagtgaggcctgagaactaatgtcataaatttgctagaaaggaatcaaagaaggccaaaaatcaggcatttttatttctccaaagatctatgaagttttaggcataaataatatgcaggtgggaaaatctggtcaggtgatatgtcagggaaagccaatggtaaagaataagtatgaaaatagcctctactttttttttttttttaaatagagatggggtctctatgttgcccaggctgaactcaaactcctggactcaagcaatcctcccacctcagcctcccagagtgctgggattttaggcgtgagccactgcacccatcccaatagcctctacttttagttttgcccggactcctttatttcagcacttttatcttgtgccagctgctgtttttagagctcccctacaaagttcatactattattccagttttacagatgagactcagaataaacttccttgccaaggttgtacagctagtgagtggcagagccaaaacctatgcttgggtctgttagagtccaatgcttgagaggatatggttccatttccgattgctgtaatgaattatcccaaatgccccagcacaaatatattacagttctgaagcctgtaggtcaaaaatgggtcagcttctagaagctgtaggggagaatctatttccttcttttctctggtatccagaggtcacctacattccttggcttgtggctccattctccagcttccagtccagcagtgtagcatctttaagcctctctctctttgtgacatctgctcccataatcacaccttttcctactccaacccttctgcctccctctcatgaagacccttgtgatcacactgggtccacctggataatccaggataatatcatcatctcacattccttagtcacatctgccaagtccttttgccatgtaaggtcacatactcataggtgctgaagattagatgtgagcatttgatgggaggaagggcaccgtgccttgtgctggactcttagctataatactctgtggtctcatacatgaagaaattgcataagtaagttgcactccctagtgtatgcactctcagtggggatggtattaatcccaagagggcgaaaatggttctatgggagaggatgaacaaaactcattctttttacgtatagagcacagatacagtacatacacagatacacgtcagtgatattacaatttcatgaatgggatgcgcttagctcttaatgcattacctcgtctagtcctggatgtcacctgcgaggccaacgtgtcatctcacttgcccacctgccttctttgccctggccgtccacgctctgcctccccttgcgtccctccccaacacctcagctctgcttgagtgagaagatgactctggggtcccccttgagaacatatgtgccttttaaaactatgtttttgttattgaagaacaaatgttaactaaatcacatcagcattagctgcactctcacagagcttggttttatgctaatactggccatctatctctttaggtgggtcttttgcaaagaaacaaactagaaaacaactatattctcaaggtggtaaaaagcctttttaggtatttccttcccagaatctctaggcttaggctttctcttctctttttagcttttgagtgaaaaaggtaaggagcagccgtcattctcctttcttattggtgggaaagtgattgttgcatattaataggggttgtggcacctccgtggtaatgtttcactaaatggaacagcatattctctttctaggatgattaattttgtgtggcctgacagtggtgtgtgggactaaatgttctgtcctttctaactgcctgatctctgagccatgggagattgagtttctccttcacaatccaccaaagtttgcatgtgaacaaaacaggggatctctgtacgcaacaggagggtgatgtgctcaactgtgaagtgtggtcctacttgaagttgtctgattcaatgagatgcaataaattaacataccacatgtattggggggaggtgaagaggtaccagatgacagtctcctgaggtctccctctcttgggcagtatatgggaggaatgggctgacaaaatagctaagagatgtcatctcttcacaaaacacctccccatcacattactttcttttgtgcagactcctcctgcccccagtgatgaatccagaggaagcaaaagaactggttgagcagaagacacccttctaacatagcaaatgatctttccccccattctttattgaatttattttttttctttagttgatgtgagctgcttttgactatgctggttttttttttgtttgttgttgttgttgttgttgttgttgttgagatgaggtctctgtctgtctcctaggctggagtgccgtggcacgatcttggctcactgcaacctctgcctccctgggttcaagagattctccttcctcaacctccagagtagctgggattacagacgtgtgtcaccacgcccagctaatttttgtatttttagtagagacggggtttcaccacgttggccaggctggtctcaaactcccaacctcaggtgatccacctgtctcggcctccaaaagtgctgggattacacgcgtgagccactgcacccagccaactatgctgatttttaaaaaacttcattgtaccttaacagcatttacaaaaatcagatttatctgattgaagtataattcacatacaataaaatccaccaactttaatagcacaattcagtgcattttgacaaaatatgcagtcatgtagcctccaccatgatgaaggtataaagcttctccatcattgcaaagtttctcgatgcccctctgcagtgagtgtctcaaccagccccagcccctagcaaccactgatctactttctgtcactacatttgtgccctttctagaattttatataagtggaatcatgtagtatgttgccttttgtgtctggcttctttttcgtagtataataatgttgagattcatccatgctgttgcattgatcagtagttccttcttatttattgctaaggagtataccatctgctatagcctgaatgtgtcccccaaaattcatatgttgaaacttagttaccatgtgatcatattaagaggtgaggccttaaggaggtgattgagtttagagggcaaagaccacataaatggaattatagactttataaacggacttgagggaactagttagtccctttcctgcccttctgtcgtgtctgccatctgaggacacagcattcctcccctctggtgggcacagcaaggcgccatcttggaagtagagaacagggccctcaccagacactgaacctgctggtgctttgatcctggacttcccagcctctagaactaagagaaaaaaatttctactttttataaattaccagatctatggcattttgttatagcagtacaaacagattacgagaccattgtacggatataccctaattggattatccgttcttctaatgatagatattttgctctaataattctcaagatatttttgggttcaaataaaacaactatttgaaaaggatggagacaaattgaggatactaatttaaacaattgcattttggcagaacaagcacataagcctctcacccaaagtttgcaagcaaatgtgtttgtcttagtggcattgcaggtaaatcacatggtatgttgttttaacatcattagcaacctactccaaaacgggacactcaaataacatctaaaattggtgagttaagctagaaatataacataagcaaaaactgagacattttgattttttaatatattgttacttaagatgaataataataccaaacttttgagaaagatctccaatccacatggattgtattacttaatgtttgtttgatatcaaattcccatggtggtttgctcttactaagaaaaagcactctacacgatacatttctttctaggaggatacagaatgtaatttcatgttttagtttaaaagaggtattttccctgattgatatctctcacattgtatcgaaagacaaataaaagacttacaaggcataagggatgtaggaaagactagttttaacttttgatcttaaagttccaaaagatatgttaggcagaaataatacagttaacttcaaatagcaatggcagtctttatgtcaattgacattaaatccaagacagaataactttccttatgtgtttaccacatgccagacactgttctgagagttttaggagtatcaacttatttaaaccgtacaataacttagaagctttggtcctatcattattataattcccattttacagatgacagaacaaagaagctcagaaacctgcccaagctcacatattggagccatgattcaatgtagcattccagcctctttggctgtttgcttagccatggtaccattgctgcttctaaataagccttcataggaaatattattggatgccaatggtattagtctgttctcaggctactaataaagacatacctgagactgggtaatttataaaggaaagaggtttaatggacttacagctccacatggctggggagacctcacaatcatggcagatgacgaaggaagagcaaagggatgtcttacatggcagcaggcaagagagcatatgcagtggaactcccttttataaaaccatcaaatctcgtgagacttattcactatcatgagaacagcatgggaaaaacatgcccctatgattcaattacctcctactgggtccctcccatgacacgtggggattatgggagctacagttcaagatgagatttgggtggggacagagccaaaccgtatcaccaatgaattgttttaattgtaatttttgtaagtaggaaaagtatagataaaaagaaaccaaacagtcaactagatttctatttacatatttttccaatgacttttctatacctctatacatatatgtatacaccaatagagatcaatagaaatgtgcatcaaaagacatggtcaaataattctctctgaaggacaagaaagggtcacccagaatttcacttttataccccttaaaactgcactgaaaattataacttagctaataaccttaggaaaactgcatgaggacaacaataagcttaaaaggggtaatcactctaaagcaagtttcacaggttgaagatgtcaatgaataacaggcaaaattgctacctcgggattaactgggactctttacaaactctccagcagtagctgaggatgttgacagcaagactgccaggtgtgagggcgaggtacaaataacccatgactcagaaatgtgtgtttcttttccctcgtcatgtgcaggtgttcacacggcaactgctgtctcagactgttgtcctacgtttcaagagaaacctatttccctccttttgggaacatctttgtaatatacatacatatatatgaaatatgcatatatatatgtatatctcaaatatgtgcatacatgtatgtgagacatacacatatatgagatatacctatgcatatgtgtatctcatatatgttaacacacatgcataatatataaaaaacataaatatattacaggtgagagaggaaagaaaagagaaagtgagatggaggatggagagaaggatagagaagaggctttctcaatcccaacaatttttccctattcattccttgcccttgcactccatattaaacataagaagataattgaaaacaaacaacccgattaaaaattgggacaaaatgagaatgtaaactggcgtagtcattatgggaaatagtatggaagttcctaagaaagttaaaaaataaaactactatattagtctgtttttcacactgctgataaagacatatctgagactaggaagaaaaagaggttgaattggacttacagatccatatggctggggaggcctcagaatcatggcgggaggtgaaaggtacttcttacatggtggtggcaagagaaaatgaggatgatgcaaaagtggaaacctccgataaaaccatcagatctcatgagacttattcactaccatgaaaacagtatgggggaaactgcccccatgattaaaattatctcccactgggtccctcccacaacacatgggaattatgggagtacaattaaaaatgagatttgggtggggacacagagcaaaaccatatcaactaccatatgattcagcaatccacttctgggtatatctaaaaaagtgaaagaagggtctcaaagtggtagctgtagccccaggttcattgcagcattattcacaatagccaagatatgggaatgacctatgtgtccatcagtggatgaatggaaaaaggaaatatatatatggacacacacatatacatatacatgtgtgtaaatacacacacacaacagaatagttattcaatcatacaaaagaaggaaatattggcatttgaaacaacatggatgaacctggaggactttaggataagtgaaataagctagacacagaaagacaaatactatatgatctcacttttatgtggaatctaaaaaagttgaattcatagaagcagagagtaaaatggtgattatcaggggctaaggtccagggaaaattttggtcaaaaggtacatactttcactcataagatgaataagttgcatggtaaatataagttaataatactgttttgcttacttgaaatttgctaagagtagattgtaagggtcctcaccacaccctacaacaaaaacaaaaaagtagctatgtatggtggtggatgtgttgaatatatatatacacatacacacacacacacacaccatggaatactactcaaccataaaaataacaaaataatgtcttttgcagcaacgtggatggaactggaggccattatcctaagtgaagcaacttaaggacagaaaccaaatactgcatgttctcacttgaaagtgggagctaagccatgtgtataccggggcgtagggtagcataatggatattggagactccaaagaagggagggtgggagtggaatgagggtgaaagttacttattgggtacaatgtatactactcaggtgacaggtacattaaaagcccagactttgccactatataatcacatccatgtaaccaaaaaccacttgtaccctaaagctatgatttttttttaaaagaaccttctacagagcccccaatagttcaggttctcagtccccaactttagggtattctgaatagcagctacgggatgagactagggcatggaatttttaatacattccctaggaaattctaaaagctttggaaccaatgctgtaatatacctccttcattactcaggaaaggaaactgaagcccagaatcttacatgtgaaagaaaacaaccataaccataatatgataatgataggagcacttattatcagtcaggcactgtaatatgtgctttcattatatcagatgcttatgctataagtactgtcattattcccactgtacagatgaggagccagaggttcagagaggttatgtaacttgctcaaggtcacacagctagtacgtggcaaagctagcaatctgattgcagaattcttaccctcaactactgggctatactacctcttcttacataatttatatgtatccgtcacatagtagagcctgaccaccctggaagcattgaatatacagtcttatactccaggataaagtcaaataggtaagtatatgcctcagttttaacactgccctcatgtggacacaattctgttgtcttttataatttatcagcttctgaggaattcctaagtgctgataatggcagaggctgtgcacatttggggaaaaggaatatatgaaatatcgctggagactatgttaaatgtttaataaacaacctcctttaatcctgatagcaattctgtgaggtaggtacttttatccccattttacagatgagaaaactgaggctgagaaaagcagatgccttgttccaggtcacacagccagtaatctgcagggcagagattgcaacctaggtctgccaagcttcatgttttcactctattgcttttatcttatctgctgtaactcctcagtctcctccagctgtcacacacactcagaagagatctgttgttatggctgaatcatattgcccccaaagatgctgaagtcctaaccccctgtgaatgtgaccttatttggaaacaggatctttgcagatgatcaagttaagatgaggttattagggtgggccctaatccaacatgactgcttccatatgatgaaggggaaatttagacatgcatagagggaagatgacatgaagatgcagggaggagatggccatatctacaagccaatgagaggggcgtggaacacgttctccctgatgacccgcagaaggaaccaattctgctgacaactttattttgaacttttggccttcagcactgtgagacaatacatttctgttgcttaagccaccagggcatggtagcccaaggaacaaacgcaagtattttcaaactgagcctgcggcttcgaccctttcatttttttttttttttcaccgtaaacagcatctgcagaccccccttccccacgagagggtagatgcccttcccagagtagcactgaccttcctctaagtgctgaactgtgtgggtcgacaccaccactggaaccccgttcagagcagacgcgttgtcctgaaacagagcacgtggcattgtgagacaaatcttcgggggaaaatcagaagaactcaaggaagaacctctaagatacaagggtgtctcacaaaaaattaaacttaacttaaaggctgtgtttctagaaactccccagttttctatcatgccttggagaaccaaaataactcactccaagagtggactccagttattatgagagcacaccatggtgcctcagctcaggggaccccacactcacaggaagctctgacccgtcgcacggaggggaccccaggctcaaatgggcatttgtcaagtcagggctggagcacgaatttaatatgctgattctgacaccttttaggttatcctcgctccactgtcttgcacacacagacacaatcaatcagcagccaggacttcagtcaacacacttgtcaaatacaggaagttcttttttttttttttttttttctgctgatgcccctgtaatggttactacactacctggtaagtctctgcttctggttcattctcttggtcttcaactctttggggaacactcatttggttacccattgctcctataatggagagaaagagaggaagagagaaagaaatcaaaaccaaacgaagctacatgtgctactaaggtgcagaggcctgacaagccgcccatggctgtattatcatcagctgagatcagaacaaattgcttgtattagtccgttctcacactgctatgaagaaatacccgagactgggtaatttataaagaaaagaggttgaattgactcatggttccgcatggctggggagaccgcaggaaacttacaatcgtggcagaagacacctctccacaggacaccagaagaatgagtgcgagctggggaaatgccagatgcttataaaaccatcagatctcgcgagactcactcagtatcacgagaacagcgtggaggaacccgcccccatgatccaattacctccacctggtcccatccttgacgtggggattatgaggattacaattcaaggtaagattttacgtagagacacaaccaaactatatcattgcttatatttattttgggaaatagaaaggagattttggactcatgtattcaacagaattaaagttaaatgcagtcataattttcagttgcatttcattgctaggggaaaatatttatcatcatgaaaagtgtattcagtgtagatagcatttttttctcttttagttaaagtcacagctattaggattttagaatgagggtaattgaaataataatatttttttctgattctcaaactaaattaattcccctattaaaaccttttacactacggccttttttttttcatagcatttagcagggcttgtaattatatacttacttgggtatatattcatgctttcactgatttagcacatatggtcatgtgtcacttaagggcgagaaaatgttctgagaaatgcatcattagatgatttcatggttgtatgaacatcatagatagtatagcctactacactcctaggctgtatggtataacctatcgttcctaggccactaacttgcacagcacgcaaccacattgaacactctgggaaattgtgacacactgggaagtatttgtgtacctaaacatatcgaaacagaaaaagtccagtaaatacatagtattataatgtcatgtgaccactaagtatatgtggtccatcattgactaaggtatcattatgcagtgtatgactgtgtctattgagcacagctctgcacctgttgctgggctgggcactagggttacagctgtaaattaaacaggcaaggccctctgacttcatggagctgaagtatggtgcacagggagagagttaacataggaacaataaatccacaaacgaggttgtttctgatagttcaaggcagcatggcacagtggttatgaccacagactctagagcaagactgcctgggcatgaatcctctctctgccccttgtagctgtgtgtccttgggagagttaattagcctctctgtgcctcataagactgctataaggacccaatgagttaatgcttgtgacgtggttagaacaatgtctagctcatgttaagcaaaacatatctgcttattaaacaaaaatgcatagggttctaagttatgaataaaagtaatttttttttgagacggagtctctctctgttgcccaggatggagtgcagtggtgcaatctcggctcactgcaacctccgccttctgggtttaagcaattctcctgcctcagcctcctgagtagctgggataacaggtgcgtggcacaacaccagactatttttttttttttttgtatttttagtagagatgggttttcaccatgttggccagactggtctcgagtgcctggcctcatgtgatccacccgccttggcctcccaaagtgttgggattacaggcatgagccactgcgcctggtcgaataaaagtaattaataacattacgtgagatgggatcatatgggagatggcaggttgtggcactgctgggtaggatggttctgaaatgactgttaatgtggttattgtcccataggtgaagggcaaagttgaatatttaatttatgtctcccttccacaagaaattgtaagcaccctgacgtcaaaggcagtgtctaccttcacccaattttgtatctcctaatcttagcagtgtgtttgcatttactgggagcttaattattgttagtcaatggagggaataacgattgatagcatctctcacatatgaggcacagacctaggtacatgaccacatcatcaccaaacctctgaagagcttcgttataataatgtatgatatataataataatgatgataatagcaaatcattacttagcatgttctcaattccaagctctaattttggagtgcttcacctgtattgtctcatgtagtcctatagcactcctgtgagatagaggtatcatgatttcattcttcatatgaggtagccgaaactcgagggggttaaatcattttccaaaggtcacccagttaatgagcaagattcaaacacagtctggctgtgctcctaaccaccggaatgttctgcatattactagcttcccttaaaaaggaggaatggaacctccaagacccaccaagggcaaacatccagtgaggaattgactcctagtatatctgatccctacacaaggactcttgcagccactccaaaggcctgctgtcttgccacctaaagttcttttgcacatgtaattccaatgtagcccatctccaaagacctagcttctggcttatctgctctagtggctctcggaataaaaattaggacttttgatttctggctgaaaggagtcaatgagtcaccagggattcttgtggatctctcgccattggtgtgagtttttattccctggtagtagacgcattgagcaattagatattgaggaggccaaaaaaagggtcatggatctcaccatgtgttctcttgcaggaatttaatacataaccaaatctggggattttgtatgtcttctgatcataccacataataaagctgagcactgttaaaacatgtaggacacttgttgttttgtgctattttctatttataaaatccgtgactcacacacttgcatcagatcatcgcttctgtctgttaatgggacattatgaataatataatattgaatcctcaagaccagggttggcaaagaacagcggtggctggattcagctcactgcctgttttagtaggccagtgagctaaaaatgagttttaaatttataaatggttggaaaaaaattagaagaatcatagaatgtgacacatgaaaattatatgaaagtcaaattttggcatccataaataaagttttgctggaagatagtcatgcccttttatttatatattgtctatgatggctttcatgctataatggcagaactgagtagttgcaacagacacctatggcctgcaaagcctaagatatttactatctggctctttacagaaagtttaccaggatttgagcctactgtgtataaaaacaatgacaacaactctaaaaaatcatagaaatgatagagtaataacaataacaacatttggtgagtgcttaccatctgttgagaaacttctaggagctttatttgcagtaaaactaatttgctctttgcagcaattcaacaagacagaggtattattatttcaattttgctggtgtggaaactgaggcacgcaggttaaatgtctcagtcaaggatacgcgcaaacacatacgttcatatatacacatgcaagaatatatacacacaaagtatctctatctaaattcagcttttaacaagttttaaaattattttaacagtaggattacaagctttattttaaagctcttactatttaatgtaaattcaatcctaacaaagctactttgaatcaacacttgaggttatgaaaaaccttggtgctggaagacgcatggtgtacagaagtaggagagaagatttttcttcccacagagttggggttacattattctgatcattgcacaccctaagtagcctctcggccacttcaaggtgaagggccctgaaagaaggaaaatctaatggcgtgtctttttcagtgataacctggattcagatattgtcactctccaccagcagatataatgcatgtgtcgtgaaattgctcctgcctgtccatcaaccttttaaagaacaggattcatctgggtgggacaaaagcaaaaggttactgccatctattggctgatgtcaatattagcagaaatgaattcagcctacaggactaggtccaaacaactgggaaggctgaaagaagcattttgatgttttgcaatgaagccttctgttcacagttggcaagaagatggcaactccttcagtgccccaaaggtcctggaactcgtaataatgataaccatatatgacttgtatggagagcttgccgtatgccagcccagtgctgaagctctatgtagacatcagtgtagcacataggataggaatgtgggctctggagtttggaatccctgagcatcactgagcctcgctgggcctcagtttcctcatctgtaaaaatggggataattatagcctccatctcaaggggctggtatggagtcaaaccagtgaatataagcaaagtgccctgaacagggcctggcacataaagaggactgcacaagagttagcatgagtaggactctcacgggtatgatccttgctctttgaagccagtttctcccacaggtgcccggtagtgagactctaccgaggaatccagcaacatttctgattcctgtgatcctctcaccgaaaagtcaatttggggccctggaatttgtatttttagcaaatgccccagtgattctcatgatcagacacctatagaaaatagtgtgatggtgaccatcttcaagctttttccaggagtgaggatgctctaggacacaggactcttatgttaaaattggaaaaccctgggcaaaccagaatgacttgggtggagacttttttttaaatccccgtttaatagatgggaaaactgaggctcaaggcagttcagacagtaattcttgtctgtaatagttttctcccatttctcaaaaaggagaaaaataaatcagatagagtttttcatgataaacgtacaattgaaagagctaactttcatttttgaaaaagaaaaagtttgaatggggtgttaaaatgccctttctttcatgaactgattatatgagtgttttgtctttatgaccttattttacattaaacatacgaagctatggtgggtggaggggtgttgtttttgaaattagacttgtgtttgagggtttggcactttgccactgggggttgattgtggaggttcagatgagaaagccccttcacttccccgcctcctgcctgtgttatgggggcccatgcccagactgggctgcatgtgagaacctcccacagagttctgagatccccatgcccaggcccctgccaaactgatgacagcagattctctggggtggggctgggcatcggggtactttcaagatctctaggtgatttccatggctgagagcccctgttttggatatttctggggtgagtgagtgagtgtctcctggggtcagaactctcctggctgctgcctaccctgacctagacaaccaaacccacggattctcagacggaggaatagctcaggcttcggagtccacagaccaccatcacccaggcacctgaatacactcacaacccttctaggggcactgctttgctgacgcactgtttcgtgagcttgcaaatcaagagaactgtcctgggcctccagcttcccttcccccagaactggcgggcagggcaggctttccagctggttattcagaagcaagcccagatgccccaccggaggtgggtggaggctgccctccgcagtctcgctctcctgcatctctggggttcccctctctcctcttgagaacaagagatctggagtgagacaggcatccgtaaaatcccacgatcgtgaggctttgggcaaagcacttgacccttctgaaagtatctttcttgtggaaaatgacagtattcataatggtggcaataataaacacatttagagtgttttctctgtgctgagcagttctgatttgcatatatttgcctctcttggtcctcccaacaactctctgagttaggtacttttattttcccagttgtcttatgagaagccggagcacagagaggttgagtggcatgtcctgatacatcgtggtaccgtgcgaaggggtaaatgtgatgggaaagtgcctggcagggcgagcacctagtagctattagtgatatagatgtcccaaactcaactcatgatggttcgactgacaatatttcaactttatgatgagtatctatctatcatctatctatctatctatctatctatctatctatctatctatctatctatcatctactttatctatctatctcacacacactatatatataacatatttacaatgtttagggtattttattttggtaccaattttccaggactatatatctatatttcatattttggatatcttgtcctattcctcgatgacttacattgctttgctaaacgttttctccttggaaatatgctgttctttgtttctccctcacaataagtggagcacagcgtttctggagtcaggagcgattttggccccgaaggggcatttggaaatgcctgcatgcagttttgatagtcacggttcagctttggggggcgtgcactggtatccggtgggtagaggctggggacgctgctacataccctgcaatgccaaggaccgcccccttcccccagcgaagaattgtctgctttgctgagggtcgctagtgctgatattgaggggccctgctctagtgcctggacttggggatgttctcctcgtgtttgtagccaggtgtcacctagggatctgcatttctgaaaagcacgtgagtaaattcgtctgtggtggtgaaatagcgcaagccctctgcctgggctcccctctggctcaccctggccatatgcataagccctggctccgtgtctgagaagtgaggggtggagggaaggaccataatagattccttgcgtggagctcctgtgaagattagaagggtgtggcccatgtgttgtataactgggtggctggtgcacagcagctgaggaatagagataagctgttagtataagcagtaaataaaatggaccatacattagcagtagtaatacctaatatttttgtagcgcctaccttatgccagccattgctctgaatgcttctctgtgttaactcacagcttccttatcagaacccgatgaggcaggtattttttttctttttttttttttgaggcgaagtctggctctgtcgcccaggctggagtgcagtggcgccatttcggctcactgcaagctccgtctcccgggttcacaccattctcctgcctcagtctcccgagtagctgggactacaggcgcctgccaccacgcccggctaattttttgtatttttggtagagacggggtttccccgtgttagccaggatggtctcgatctcctgacctcgtgatccgcccgccttggcctcccaaagtgctgggattacaggcgtgagccaccgggcccggccgaggcaggtatttttattgtccccattttacagatgcagaacctgagcccagggaacttaaactcctcacttaagatcatgctatggattgaaatgtgtccttccaaaattcgtgttggattcgtgttgaagccctaacgtgcaatatgactgcatttggaaatgtggcctctaaggaatcaaggctaaatgaaatcagaagggtggaccttgatctgatagaattagtgtcattataaaaagagacaccaaagagctctctctgtctctctctcaaccgtgtgaggacacagcaagaaggcagctgttggctagccagaaagagtggtctcaccagaaatgcatcggccagaaccttgatattggacttccagcctccagaactatgagaaaacaaaaatgactgttgtttaagccacctagtctgtggtgttttggttaccacagcccaagctgactaatacagatcatcttctagtaagtgggagaatgaggacttaaccctcgcaaactcaagtccagagtttagacttttaacttttctattttcatactttctactgtctcttctgctgtataagtgatgttatagttttatgaaatatttatatgtaatataatagaacatggaatagaaaatatttcctgcatattcattcttgcaatgagaaaattataactaggcaaggaatatatatggtacaatctaaagtgaggattaggccgggcgctgtggctcatgcctgtaatcccagcagtttgggaggctgaggtgggtggatcacttgaggtcaggtgtttgagaccatcctggccaacatggcgcaaccctgtctctactaaaaatacaaaaattagccagatgtggaggcacaatgcctgtaatcccagctacttgggaggctgaggcaggagaatcgcttgaacccaggaagcggaggttgcagtgagccgagatcacaccgctgcactccagcctgagcgacagaatgaaactctctcaataagtaaataaataaatcaaataaagtgaggattgaacaattgaagggtcactgataatcactgtaaggatttagcgccagggcttggcagtactcaggtgagtaaacgttagttattgctaatattattcatttatcttattattgttataattgagttagttctgtgttctgatccatgagtgaattggcctcctggaagctgccctcaaatccctcctcttttacacagtgattgatggtccatgtcgcctccttgtagttacagattaataataggccctcctcctggaaacaggccaaacgccaaaccccatgcaagctggcctggagaaagcacttctgaaacttcatcaccagcaggcagctagacgactgttgaatgggagggggggtggttttgaagggtggaatggtgacagaattagtcaccaagtaaacaagcaacaccttcgatcaatgcaatggaatgtaggtaacccaggggccctcctcactgctcagctgagggtgacgccaacatggccaggctggcacacccagcagaaccagccctctgcccccaacatcagtaaagaccttgcaggaggaaagaacaaccccgctttgcctgccccacagtcctgcagctccatgtgtgtgcccgcacagtgctaggaacacggcagctattatcaggagtgccaggtacagtgctacaggttgcctcctgtacaaggggacacagggaactgaaatccagtcctcactgaactgcccaagccctgattcctggtatgggactttgtgggtccaggggcaggggtgccttgatcaaaatcaccttggatgttttagggctgcttggtgattgatgttttgctttcggagtacttaattatgtttgcacaaacggatggtaatcctaaaaatcttagagctcgctctcatagtcttattattgcaccaaacattgttaagtgcatgataatcgcaggtaattttaattggaggcttactatgtgccaggcagcaccagggtgagcatagcaggacacaaaatataggaaggcaaccatctctggtgcagaatcggcagcagagagtgagcgcctccctgcattttatcccccaggtgctcactggcttcacccttgccctgaccctggtgccaggcacttcacacacattgtctccttttcccttgcagagtcccattattccctgattgcacagataaagaaaccaaggctgagcaatgccatcccctcatctcacgaacgtcacctccatgagggtaggcaccttactagtcctacttgcccaagagtagcagtcagaaagctacggggaggcacacctggggtttgaacctgggtccacgtgactcaggcactcaaatcctgaactgcttcagggcagggcacttggcttgaagagaagctgcagacacagagacaatcaagtcacatctaatactccagcaggacagatgagcctgcaaggtgcaaaggtacccccgcccccaacccaaagcctttttcaattcctctccctccacatctcttgtcatggtaaagcaggcagaatccatgggctttaacgggcccattgcttttcccaaagctcatgcctttttcctaaaaacaaaacccttctgggttccagaactctttggaaaaaaagaatcttctgtgatttgggacattggtttgttcccccaccctcacttaaatgagaaactactttagcatgccccgccccgtctgttgtctttatttaggaggaagcaccctctacataccctgagtatatacacccagggcctgaagctgctgtgatcagctcaggatccccaggaggctgaggcggatcaggccctggactccgggggaacaatgtaagggacaccaaaaagctcagccatggagatgaatagtattttaacatgaaatttgtgaaaatcaaaattaccgctgttcctgatcttatctttctgtaacatgttcatagtttgttcatcacgggtgtcttgccattaattctgacttttaaaaatgttgtgttaacataccgtttatctccatgactgagttttttggcatcccttacatttcgtgcccaaggtgagagtctcactggctgcaccctcatcccaggcccgactggactccagttccacagcatcctttccatgagacctggaaccagatgcagctccctcttcacccagcttcatgttcctagttgtaaaatggagacgatggtaacagcgaaaacaagaaccacagctaagagttactaagtgcacaggtatttacgggcagtagagtcctctcagccctttgatctcagtactgttattaggttcactttacagatgaggaaactgaggcccagagggctgagggaacctgctccagggcacccagccagcccagggtggagctggggctggcatctggcggtgtggctgcagcgcacccgcattctaatcgcaatgactcttccaggcaggaaactggttcagagggagatgtaaacagcaggggtcctgaagccaggatttgaatcagcagctgcctcatagggtggtcttgagcgttaaataagattcacaaaaggcactccacaagtcctttttcttgtcctcccacttctttaggcaatgcctgaggtgaaggctcagattccactcggctatggggcattcttgccctgacggatccccaaatcacacagcctatccctccatccagtgacttctccccatgtcctgtgcttgaaatgaccctcaatagttccaccaaataggagttatttatgtggctatgcgcctaacactgaccacattgtcatttgctccttgtaaaactaaaaactttgagatgagtgctatctttgggtccatttcacagatagtggaactgaggcttacacatatccaaggccacacagtgaacagaaggcagagctgggatcaaacttgaccctgtctgacccctggcctctatatgacaccgtctaccacaaacagcaaaccctccagccatgcctaaaggatctgaaagcagttacctgctgagcccctgtgggagtatcttcagtcccctcgtgtcacccggagctgctcctgcacagggtcctgggtctccagtgcgtgctgcccagtgcctggctgtcggtggagcctggctccctgcactttgcttccttgtgcagagcctgctggctgaatacacagagcagggcaaacacaagcctgggtggagtcctcccttctccccggaccatcctgcagaaacaggttctcttcctgatgtggggctgccctcccaactccaataaaaactgagcacctgactcctctcgcattaatgcctccctggcaccccaagtattctacccagt

SEQ ID NO: 1820 - DNA, 33578 bp, Homo sapiens
tgcagtccggggctggagggtaggggcgagggtccccggataccgggtctatcacggtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggtgagatttatccattcatctctcaatctattttctttcttcattcactagccactcccccacttctactccatgccaggtccattggtaggttctcggaatggatctgacaggcccagccctctaggaacttagtctagtggaatttaatctagaatctagtctagaagccttaaatagataaacattccaaatgattcctgcaatggtgatggctaataccttcagagcccagtgggtggaagaaggaagtaacttggatgtgggtggaagagaaaagggcaaatcagggaaggtttcaccagggaagggacttttgaactgggctttgaaggttaactaggagtttgcaaatttcccagaagggaagcgacattccaaataggggaagcagaacaggctgcaaaattatgaaaaggcctgccatattacaagaacagcaaaaaaaccaataatgcaagagattgtggaggtgagttcacgggaaaaaagctcaacagcagaaggccttactttctatgctatgttgaggccaagatttatcccagagctcagtatttctcagcttctttaaatattttgtcctttgagcggagagcagtggctcacacctgtaatcccagctttttaggaggctgaggtggaagaattgcctgaggctaggagttcgagaccagcctggacaacaaagcgaaacctccatttctatttttttttctttttttgaggaggagtcttgctctgtcgccaggctggagtgcaagtggcgcaatttcggctcactgcaacctccgcctcttgggttcaagcaattctcacgcctcagcctcctgagtagctgggactacaggcgtgggccacaacgcccagctaattttttttgtatttttagtaaagacagggtttcaccatgttggccaggatggtatcgatctgacctcatgatccgcctgcctcggcctcccaaagtgctgggattacaggcgtgagccactgctcccagccccgtttctatttttaattaaaaaataaataaatggccgggctcagtggctcacgcctgtaatcccagcactttgggaggccgaggcgagccaagttcaagaccagcctggcgaacatagtgaaaccccatccctacgaaaaatacaaaaaaaattagccaggtgtggtggcacttgcctgtagtcccagcttactctggaggctgaggcaggagaatagcttgaacccgggaggcagaggttgcagtgagctgagatcctgccactgcactccagcctgggtgacagagtgagactccatctcagaaaaaataaaaataaaaaataaagccaggcacggtggctcatgcctgtaatcccagcactttgggaggctgaggcgggcaaatcacctgaggtcaggagttagtgaccagcctggccagtgtggtaaaaccccgtctctactagaaaagctagaaaaatgagctgggcgtgggtgggcacctgtaatctcagctactcaggaggctgagaaaggagaatcatttaaacctgggaggggaaggttgcagtgagtggagattgcaccactgcactccaacctgtgcaacagagtgagactctatctaaaaataataataaagataaatacataggccaggcacggtggctcacacctgtaatcccagcactttgggaggctgaggcgggtggatcagctgaggtcaggagttcgagaccagcctgaccaacatggtgaaactccatctctactaaaaatagaaaaattagctgggcgtagtggcacatgcctgtaatccaagctactcgggaggctgagggaggagaatcgtttgaacctgggaggcagaggttgccatgagctgagatcttgccattgcactccagcctgggcaacgagagctaaactccatctcaaataaataaataaataaataaataataaaaataaagatgaaaagttggtgattcttattcaaatcaatcaggcctagaaattagtacattcaacaggaaaggtttaaaaaggaggttgaattgattaagatgataatcataagtgtctaaaaagtgcctttctttcttatgcataggacaccatgaagcaactgccagtcttggaacctggagacaagcccaggaaagcaacatggtctgtaaggaaggatccagacacagaaaagcatgagtttttgtttcatttataagtagtttatttacatatttgatcatcaacaaaaaggggtagagatgaaactgtctgcagtttctggtaattagactcaaactgtctgagaaagtcttcagaggaaagataggggggcagtaattatcacagagcagatgttaattttattaaaatccatttaccagaaagagtaaggcactgaccatctggcatcctcagctccaatgctgtgtcttcccccgagctctgactcatttttaagatttttaggaaattagatttggattaaactggcttcactgtttcttggctgtttgttcaaacaaccctttattcaacaactaacattggcctgatgggggcagctgctctgtgggtgctggaggtagaattgtaaatagtctctgtgtactggggactacagactaagcaggtgatggtgataaaatgtgatctgctctgagtcagggcccacagaaggttgtagagaggtggcagttcttcaacaggaccttgaaggagagactccagactggcttccatgcatctgtcttgctctgtacccagaatacagccaatcatggcatttcctagtttaaaacccttttgtgcctccctgttggtgttgggataaaaatcagactcctgggctgggcacggtggctcatgcctgtaatcccagcactttgggaggccaaggcgggtggatctcctgaggtcaggagtttgagaccagcctgaccaatatggtgaaaccccatctctactaaaaatacaaaaattagctggcatggtgttgtgcaactgtagtcccagctactagggaggctaagacaggagaattgcttgaatctgggaggcagaggttgcagtgagctgagatcatgccactgtactccagcatgggccacagagcaagaatccgtttcaaaaaaaaaaaaaaaaaaaaaggccgggcacggtggctcatgcctgtaatcccagcactttgggaggccgaggtgggcggatcacgaggtcaggagatcgagaccactctggctaacatggtgaaaccctgtctctactaaaaatacaaaaaattagccgggcgtggtggcgggcatctgtagtcccagctactctggaggctgaggcactccagcctgggcgacagagcgagactccatctcaaaaaaaaagaaaaatcagactcctgaccgggcgcaatagctcatgcctataatcctagcactttgggaggctgaggtgggtggatcacttgaagccaggagtttgagaccagtctggccaacatggcaaaaccccgtctctactaaaaatacaaaaattaaccgggagtggtggtgcatgcctgtaatcctggccactcgggaggctgaggcaggacaattcttgaacctgggaggtggaggttgcagcaagccgagatggtgccactgcactccagcctgggcgcaacagagggagactccgtctcaaacaaacaaacaaacaaattagacttcttaaactggcccaatggtccctgcaaaatgtttctgcctgtatttccaacctcaaatcccatgacttgttcctttgttctctttctcttctttattgtgccctttgcactgttccactcaggagctgttcatgctggtctctttgcctggactgctctttctgcctggagtgctctttccctccactttttgtccctctcttttcccagcttattttattttatttttgagacaagttcttcctctgtggctggccacccaggctggaatgcggtggtacaattgtggctcattatagcctcgacctcctggcctcaagtaaccttcccatctccatctcccaagtaactgggactgttggtgtgtactaccatgcccagctaatttttttttttagagacccagtctcgctatgttgcccaggctggtctcaaactcctgggctcaggcgatcctcccactctagcctcccaaagtgctgagattacaggtgtgagccaccacacctggcctacccagctaatttctactcatacttcagatctctctccaaatggtgcttcttcaggaagccttctctgaccaccctatctccctggctccttacagggtgagaccctcctaagacatgcatgtcctcatactatatattctgtactcctttctaccacaattgaagtgaaacagatagttgtgaaactgttgaatgtttcttttcccaactagtctgtaagggctatcaaggcagggacttttttttgttatatccaccatctctggatggctgtgtgcttttggtaaattacttaacctttcttagcttcagttcctccgttgtagaactcagatgatggtaacagctgttatcctcaaagcgtttttttagtttttgtttgtctttgaaacggagtctcactctgttggcaggttggagtgcagtggcacaatctcggctcactgcaacttccgcctcccgggttcaagcgatcctgcctcagcctcccaagtagctgggactataggtgcatgccaccacacccaggtaatttttgtatttttagtagagacggggtttcatcatgttgcccaggatggtctcaatctcttgacctcatgatctgcctgcctcggcctcccaatgtgctgggattacaggcgtgagccactgcgcccggccctcaaaggggttttatgtagattaagtgacatcagaatagagctctgaatgggaaacaaatttggcaaccactgatgaatatatagatgagtgataattgaagttatcactacagataacattaatcaggtaagcaaatgtaaagtgaggaaaagagaattgagaatgacggagagtcaggaggtggctggtaggaaaggagtcggagaaggaagcagaaaggacaaccagaaaagtgagtgcagaaccaaaggaagggatgtgggaaagcctggctgggagaaaggcacaagaagcgaggagaggtcaggagtctcaaacaccagagaggtcaaataagacagggcctgaaaaacagctacagaattttcttttccaatcaggaagcttcaagtgtgttttctcagtcagcattcagaatcactgtggagagtggaatgggctgggcgtggtgggcgcgtccctagcacttagggagaccagggcagaaggattgcttgaggctgggagttcaaggctggccaacatagtgaaaccccatctctactaaaaatacaaaaattagccaggcatggtggtgcgcgcctgtagtcccagctactcgggaggctgaggcaggagaatcacttgaagcctggaagtggaggttatggtgagccaagattgcaccactgcactccagcctgggcaacagagcgagactccgtctcaaaaaaaaaaaagagagagagagatagtggaatgaccgaattctgtatgtgatttttcagagtgctagctttggcttccatcagattgagctttgggggtaatctggaaaagctctgaaatcagtaaattctggataatttttttgatggagaggaatcactggctagtggcaagagccccagggctgttgattaccatgtggtggcacataaagctctcgccaccatttattgagtccttccctgccctgttttgacgtcttgtctcagtcttcacaatcatcttttgcagtaagaactgttgctgtccagccaggcacggtggctcacgcctgtaatcccagcaatttgggaagccgaggcgggcggatcacctgaggtcgggagttcgagaccagcctgaccaacatggagaaatcccatctctactaaaaatataaaattagccaggtgtggtggcacatgcctgtaatcccagctgctagggaggctgaggcaggagaatcgcttgaacccgggaggcggaggttgtagtgagccgagatcacgccattgcactccagcctgggcaacaagagcaaaactccatcttaaaaaaaaaaaaaaaagaaccattgctgtcctcatttcacaaatgagtaaactaaagttcagaaaggttaagtgacttccaaaaggtcacacatctaggaagtacctgagctcgaatttgaaccagatctgtctgaattcatacaccatgctcacagccaccatcctgtgccaagacccatcactgaacatttctggaggtcagtttccctatctaccaaatggggaaaaataagcccagtgcattcctaccagattactgtgagatgaagacagtgacaaaattgaaaagccaaagactgtgtgcaaaggggaggtactattattaatcagagaagtgctgctttattgggtacaatttaaagtgtctgcataaggctcttcattctggtgaatatttcatgaggaatggaaagagcacactactgcatttattctctgctcaggcctcctgaatacatccttcctttggcaggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggtaagatcagcagctgcagagtacatgccctatggccagagaacagggctgtgtgctgctagccatgagcagggcattcctaaaaacaccagcagggttttcctataagaaaacatggccaggaccaggtgtggtggctcacgcctctaatcccagcactttgggaggccaaggcaggtggatcacctgaggttagagttcgagaccagcctgaccaatatgatgaaaccctgtctctactaaaaatacaaaaaaattagccgggtgtggtagtgggcacctgtagtcccagctactcgggaggctgagacaggagaattactttgaactggggagatggaagttaaagtaagccaggatcatgccactgtactccggcctgggtgacagagcaagactctgtctcaaaaaaaaagaaaaaagaaaaagtcagcatcactgacagatccctcaggtttcttagtaggcccctggcacacattcatctgaccagtacctccttgtttagcgggagagaacccttatggagccctggttgtccagccatttattcatcaaatatttctgtaggatacattgatgactaccaccactcattctattcacatatccaatatatcactaagccctacatatctcttttctttgttttttgtttttgtttttttgagatggagtttcgctcttattgcccaggctggagtgcaatggcgcgatcttcactcattgcaacctctgcctcccaggttcaagagattctcctgcctcagcctccccaagtacttgggattacaggcatgtgccaccatgcccagctaattttttttttttttagacggagtcccactctgttgccaaggctggagtgcagtggcacgacctcagctgaccgcaacctgtgccttccaggttcaagcgattctcctgcctcagcctcctgagaagctgggattacaggcgcccaccactacacccagctaatcttttgtatttttagtagagactgagtttcaccatgttggccaggatggtctcgaactccagacctcatgattcacccttcttggcctcccaaagtgctgggattacaggtatgagccaccacgcccagcctacatatctcttatctttatccatgtctgtccatttccactactactactgtagtccaagccactgttatctctcaactagacttacaagagcctcctcaccagcctccctgcttccaagtttaccccctatacagtgcattttctctacctagccagcgaatatcatctaaaatacaaatctaaccatgtcactccctatttcagacttttctcaacctcccttttttttttttttttttgagaccaagtcttgctctgttgcccaggctggagtgcagtggtgctgcaaactcggcttactgcaacctctgcctcctgggttcaagcaattctcctgcctcagcctcctaaatagctgggattacaggtgtgcgccaccatgccctgctaatttttgtatttttagtagagatggggtttcacgatgttgatcaggctggtcttcaaatcctgacctggtgatcctcccgcctcatcctcccaaagtgctgggattatgcatgtgagtcaccacaccagccttttttttttgaggcagcgtgtcgctctgtcacccaggctggagtgcagtggcacaatcttggctcactgcaacctctgcctactgggttcaagcgattctcctgcctcagcctcctgaatagctgggattacaggcgcgtgccaccagcctggctaatttttgtatttttagtagagatgggggtttcaccatgttggccaggctggtctcaaacttctgacctcaagtgatctgcttgcatcagtctcccaaagtgctgggattacaggcgtgagccaccgagcccggccccaacctcatttcttggctctctccaacccacatttgctgcactggatatccttcagttccttgaacacagcttgagctctctggcctccatgcctttgcacacacagatccctctgctaggaatgtttttcccttttcttatcatctggcttctctatatctttcagatttcagattaaatgtcacttctaccaggaacctttcctgttacctctggactcgttcaggcactacatgactctgtatgtccgtagtctcatgtgctcttccatcctgtctgccttcacagccctatcacatgtgattgtttcttgtccgtctgccccacaagaacataagctcctcagaaacagatagcatattttcctcatcattgtatcccagacactaccacagggcttagtacagagtgggtgctctataagtatttaaatgaatgaatgaatgaacctgctaataagaaacaattggatctgggcgcagtggctcacgcctctaatcccagcactttgggaggctgaggcgggcggatcgctaggtcaagagatcgagaccatcctggctaacacggtgaaaccctgtctctactaaaaatacaaaaaattagccaggcgtggtggcgggcacctatagtcccagctactcggggaggctgaggcaggagaatggcgtgaatccgggaggcggagcttgcagtgagtggagatcgtgccactgcactccagcctgggtgacagagcaagtctccgtctcaaaaaaaaaaaaaaaaaaaaaggaaatgattattagctgggcgtggtgactcacgcctgtaatcccagcactttgggaggccgaggcaggcaaatcacaaggtcaggagatcgagaccatcctggccaacatggtgaaaccctgtctctactaaaaatacaaaaaaattagctgggcatgatggcttgtgcccgtagtcccagctgaggcaggagaattgcttgcatctgggaggcagaggttgcagtgagccaagattatgccactgcactccagtctggcaacagagcaagactccgtctcaaaaaaaaaaaaaaaagaaaataaaagaaacgattattctttgctctacacaagggcagaagttgaacaatggtgacccacttacgtattttgttaggtccatgtaacatttccctattgttttaatcttaagttttgtttttttttttgaaatggagtctcaaactgtcacccaggctggagtgcagaggcacgatcttggctcactgcaacctctgcctcctgggttaaagtgattctcctgggccgggcatggtggctcaccatgctgtaatcccagcactttgggaggccgaggtgggcggatcacgaggtcaggagattgagaccatcctggctaacacggtgaaaacccatctctactaaaaataaaaaaaaaaattagccaggcgtggtggcgggcgcctgtagtcccagctactcgggaggctgaggcaggagaatggcatgaacccgggaggcagagcttgcagtgagccgagatcgcgccactgcactccagcctgggtgatagggcgagacgccatctcaaaaaaaaaagaaagtgattctcctgcctcatactcccaagtagctggaactacaggcacgtgccaccatgccccgctaatttttgtatttttagtagagatgggttttcaccatgttggccaggagggtcttgaactcctaacctcaagtgatccacccacctcggcctccccaagtgctgggattacatgcgtgagccaccacgcccagcataatcttaaattgtttaccaaccaattatgcagaaatctacatataaaaatttaaatggtttggcttctcttgataatgttggaaaatctaatgtcagtaggcctccctgtctacatggcaacaattatttggaactgagctgccacctatcaagagggctcttattctccagtttgccacagtttttgttactcccacctaggcatttgaatttctactccctgcactaaaaaaatcaaaggtaggctggacgaggtgtaatcccccagcaccttgggaggccaaggcgggtgggtcacttgaggtcaggagtttgaggccagcccggccaatatggtgaaacccccatctctactaaaaatacaaaaattagccaggcatagtagctcacacttttaatcccagctacttgggaggctgaggcaggagaattgcttgaacctgggaggcagaggttgcagtgagccgagatcgcgccagtgcgctccagcctgggcaacagagcaagactccatctcaaaaaaaaaaaaaattcaaaggtaaattaaatcacttctagccctcaattacattaaattagttcaacttacatctttattgcaacctattaatagctttgtgaccctggctacaccatctcaaccatctggacctcagtgctctataaagtagggataataacttgcttcagatctaacaagataatgcctgtaaaggtcttgtgtaattggttaaccaagtaaaataattgttaataataaaggttagggttttttgtttgtttgtttgttttttgagacggagtcttactgtgtcacccaggctggagcgcaatctcagctcactgcaagctccacctcccgggttaatgccattctcctgcctcagcctcccaagcagctgggactacaggcgcctgccatcgcgcccagctaattttttgtatttttagtagagacagggtttcaccatgttagccaggatggtcttgatctcctgacctcatgatccgcccacctcggcctcccaaagtgctgggattacaggcatgagccacagcgcctgaccaaggttaggtattactattctgtgaacttgtcttagccagccatcatttatttgcaagtaacagaatctcacttaaaccagaggaaaaagggggaatttatttagtcagatacaggcgtgtttctttctttctttcttttttttttttttgagacagagtgttgctgtgttcccagactggagtacagtggcacaatcttggcttgctgcaacctccgcttggtttaccaagtaaaataaccctgggttcaagcgagtcccctacctcagcctcccgagtagctgggactacaggcacgtgccactatgcttggctaattttttgtattttagtagagatgaggtttcaccatgttggccaggatggattcgatctcctgacctcgtgatccgcccacctgggcctcccaaagtgctcggattacaggcgtgagccactgcacctggccaatacaggcgtgtttcaaagaattcaaggacaggaagtagagcccaggatcatgagaaagtggaagcacttgatctggttggctcattctggtttcattggctaccttcaacccaatcagctaaagctacaaagtcaaagcatagtacaaacatgtcatctgggatctatccttgtggttgacaaagtggggacagtttccatagaacggggtctatggactaggcagacagccccctaagtatctattatagaattttctggaggttgacaacatgccctttaagtgattcagtggttttcatttatgtttatggccctcttctcatgaccctcctcaagtgtgccaaccaatataataattggcagccccaatctaggaactgggtgaaatgttttccaggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctggtaagtagccaaaggttattttatttacgtacatacaaataaactttcatgcacacacacacacatatatataaatccaattataattccagtacatttggattatactaattaccatttaactttgctgacatagaaaataggaattttaacttgtagcataatctgaaaacaacagaataaaaacaattgttggtaacacatacaatttttaacttgttaaatgtcaaagctggaagggacttcagagaacagctatatcaagtgggctactcaggtttatcaagggcaaagtgactttcctaaagtcacaagaggccgggcatggtggcccatgcctgtaatcccagtactttgggaggctgaagaaggcagatcacttgaggtcaggagtttgagattggcctggccagcatggtaaaacccccatctctattaaaaatagaaaaattagctgggtgtagtggtgggcgcctataatcccagctactcaagaggctgaggcaggagaatcgcttgaacccgggaggcggagattgcagtgagctgggatcatgccactgcactccagcctgggcgacagagtgagactctgtctcaaaaaaaaaagaaaaagaaaaaaaaatttttttaaaaataaagtcacaagagagtcagtgactgagccaggcttagaacccaagtcacctagattagtagtcctccagtaaaggcgattgtgcccccgggggacatttggccatatctggaaacattttgggttatcacaactgggggtagcgtgggctactggcttctagggggtagaggccagatatgctgtatatatatcctgtcgtgcctaagacagccatcacagggaagaattgtctggtctaaaatgtcagtagtgccaaagttaagaaacactgacctggatcctcctagtatgtttcttttagccaaaagtacaaagttcctaacttgtctcactggcaagacattttgtttgttcgttttgtttgtttgtttttgtttttcatatcttgctgtttccatcactggcagttttattatagaggaagcagtttgggaacgtcgctactgagaggaggttgctaaaccacctgtggggaagtggacttgtctttttgccttttgtttgtttgtttttgtttttctctttacaaatattatttatgttcattgtaaaatatttgaaaagtacaaataagtggaaaaagtcatccacaatccattattatattaaggctattaccaattttctgtctttttttttttttttgtgacggagtttcactcttgttgcacaggctggagtgcagtggtgtgatctcggctcaccacaacctctgcctcccgggttcaagtgattctcctgcctcagcctcccaagtagctgggattacaggcatgcgccaccatgcctggctaattttgtatttttagcagagatggggtttctccatgttagccaggctggtctcaaattcttgatctcaggtgatccgcccacctcagcctcccaaaatgctgggattacaggcatcagccaatgtgaccggcccagctttctgtctttttcctgtcttttctctgtttttacaagcctgagatcatactatatttacacattcataactttttccttttaatttcataatcccaggagaaataggtgggttttttttttttggctttagcaaaaataattgatttgttattaataacaatgctttgttaatataatatcatttgtttgttttttttgggtttttttattgttggtaacttttttttttttcgaggcagggtctcactctgttgcccaggctgggatgcagtggtatgatcacagctcactgcagcctcgaccacccaggctcaggtgaacctcctacctcagcctcccaggtagctgggactacaggcgcttgccaccatgcctagctaatttttttgtattttttgtagagacagagttttgccatgttgcccaaggtggtctcaaactcctgggctcaagcaattttcctgcctcggcctcctgaagtgttgggattacagacatgagccactgcacctggccaacatcatttttaatggctgtatcatactccattatatataaaatactccataatatcataacttctccatttatgaacatttagttcttttcaggtttttaccattataattaacaaagcagtgaacatcttcattcagaagtcatagactgtatttcaaattattttcttagggttcctgccaagaaataaaaaggctaggtaaaatactgtgaaccttttcaaggttttgatacatactaccaaattgctctccagaaagatttttccggtttatcctctctccaactgtgtttaacagtgtttctttcattactgaccagcactgaatttatcagttttaaacattgctaatttgataggcaaaaaaacttgtacatagtttaaatatgcattttgggccggtgcggtggctcacacctgtaatcccagcactttgggaggctgaggtgtacagatcacctgaggtcaggagttccagagcagcctggccaacatggtgaaaccctgtcactactaaaaatacaaaaattagccaggcatggtggtgcatgcctgtagtcccagctgctgaggagggcgaggcaggaggatcgcttgaaccctggaggcagaggttgcaatgtgccgagatcatgccacagcctgagcaatgagtgagactctctctcaaaaaagcattttttgacctggacatttttcacatgtcagccaactcttgctcagttccctctatcaacaatatatttggggtgttgcccacctactacatttgttgagtattgcccgataaaaaaattaaaattaaaaaaaaaaactattgtacaatagttggtcagagttcaggaactaggaccaaattttcttatatgtcaagtatttaaattccttcagcacatttagacagtatgttatcttttaatttgatttatttgtttgggtatttatttcctgtcttccctcctcttccatgccctccctctgtggaacataagcgctttgaagggaagagtttgtttattgttgaatactcagggtacagaacactgtccgaaataaagtagacacggccgggcatggtggctcatgcctataatcccaacactttgggaggacgaggagggcggatcaaaaggtcaggagttccagaccagcctggccaacatactgaaagcccgtctctactaaaaatacaaaagaaaaaattagctgggcttggtggcaggtgcctgtggtcccagctacttgggaggctgaggcaggagaatcgcttgaacctgggaggtggaggttgcagtgagccgagatcgcgccactgcactccagcctgggtgacagagtgagacaccgtctcaaaaaaaaaaaaaaaagaagaaagtgatagagtagacacttggcagaccatttggctaattgtgaagccaatttgcttggaggactagcagtataatatggtgcttaagggcacagatgagggtctctgttttgctatgcactaactatgaccttggactagtgatttaacctctctctgcctctgttttctgtcacattggatagtaatagtttctaccttgttaatttgtcaaggatttaaataaactcagtatctggcacataattaatgctcagtaattgttgtggtagttgatgtagttaaggtttggcaaagggaaatcagttctggaaccctggccttttgattttcaacaatggtatccattgaaataaaataaagtgagaatttggaaagctgtcaaagagggtgattttattttatttatttatttatttatttttatttttgagacagtgtctcactgtgttgccaaggctggagtgcagtggcgcaatctcagctcactgcatcctccacctcttgggttcaaatgattctccagcctcagcctctcgagtagctgggattacaggcacatgccaccatgcccagctaatttttatattaaagagggtgattttctatcatatcccttttctctcctagaaaatataatttgacatcatgcccaagaaatatgaaatatgtacttagttgcatttgttaccaaggcaagtccctcaaatgctcaggactcctttgtgattctttgtgctggtgtttgagttggcaggaatacagccctagggtcttctgggcctggaggtgacatgtatacctttctagctccctctaagatccaaaagctctccaacatctgtaactatagagacagctacattttgctttggatataggctgagactttttcagtctccaggtccccatttgagtcccacacatattacagatgtttcctgtagcattttatatattggatgtagaccttttacaaaagacagaatttcttggtgtgttatggtagagcaagtgtgggactctgatagaactgagttcaggcccggcgcggtagctcacgcctgtaatctcagcactttgggaggccgaggcgggcagatcaggaggtcaggagctcgagaccatcctggctaacacggtgaaactccgtctctactaaaaaaaaaaaaaatacaaaaaattagccgggcatggtggcggatgcctgtagtcccagctgctcgggaggctgaagcaggagaatggcgtgaacccgggaggcggagcttgcaaagtgagccgagatcgcgccactgcactctgggctgggagccacagcgagactccgtctcaaaaaaaaaaaaaaaaaaaaaaaaaaagaactgagttcaaactcctgctctgctacgcacatatgctataacctgcaggaaaggatttaaatgtgcagagcttcagtttcctcatctaaaagtagagatacttccgctcacttcccaagcttgagtgaagacaccagggatggcagtgcccagggcaatgatgctgcccattgagggtgctcaattaatgcatctgcttctataaaacccaggttcatccttaaaagaaataagcttctatacatctatctaggtggtgaaattttattctccagtcagaggagtgggaattagaaagatcttggtgttactgaaagagtttaaattccaactcagccatttcttaggcatgtcactttatctgtctctctctctctctctttctctctctctttctttgccttattctgtaacccaggctggagttgcagtggtgtgatcttgactcactgcaacctcaaccgctgcaggctcagtatatcctcccacctaagcttctcaggtagctgggactataggcatacgccaccacacccgactaatttttttttgtatttttttgtagagacagggttttgccatgttgcccaggctggtctcaaactcctgggctcaagcaatccacctgccccagcctgctaaagtgttgggattacaggcatgagccaccgagcctggctagccatgtctcttttaaaaagttacttaatccatccctacttcaattctcttacctgtaaaatgcggaaattaatatttgtttagcatttactgtttagtagggactgttattactgctactgaaatgtaatagtattgtctttttttttttttcatttctttctttcttttttttttttttcaagatatggtcttactcttttacccaggctagagtgcaatggcacgatcatagttcattgcagcctcaaactcctgggctcaagcaatcctcctgccttggcttcccaaagtgctagggttacaggccttacagccactgtgctcagcctaattttttttaatttttaatttattttattttattattattattttttaagatgaagtctcgctttgtcaaccaggctggagtgcagtggcatgatctcagctcactgcatcctccgcctcctggttcaagtgattctcctgtctcagcctcctgagtagctgggattataggtccccaccacgacacctggctttatttatttatttatttatttttagtagagatgggatttcaccatgttggccaggctggtctagaactcctaccctcaagtgatccacccaccttggtctcccaaagtgctgggattacaagcgtgagccactgcacccctggctgattttttgtagagacaggatattgctttgtttcccagtctggtcacaaactcctgggctcaagcaatcctcctacctcgatttcccaaactgctgaggttacaggtgttagctgctgcacatggcctgcctactttcttttattggccacattttctgggaaatctggcacacctggactctggcatctagtgggaatgaatgttagcagatgttagggggagcgatagtgagcaaagtagaagagggttcagagaggatatttgaaggcctccaaaacaaattgacctcttttttttcttctttttttttaatatggagccttgctctgtcacccaggctggagtgcagtggtgcaatctcagctcactgcaaccttcacctcctgggttcaagcgattctcctgcctcaacctcctgaggagctgggattacaggtccccaccaccatacccggctaatttttcagatttttagtagagatggggttttaccccatgttggccaggctggtttcgaactcctgacctcaagtgatccgcccgccttggcctcccaaagtgctgggattacaggcatgagccacactgcacccagcctgactccattcttgtgcttacagcttttaaatcttggggattttggactgtcttggcaaatcctaagtatcatcttcattcttccttgatgtttgtgagtatgagatccctgcccaaaactatgctggcccccctggggattggagtttggaaactgacttcactcagccccagagtcaaggtcagaagcccctctacctggatattttaagtgcctgcattctctctggcccagaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaagtatggactggtgggcaccttggggctggtcagggccatcccagtttacacattacctaatataggaagcagaagttagaaaaggaaagcctgactaagtgtctcacttctagacttctttgttatatctcttagctgatatctttttcccacagcaaaattggcatttaaaaagggatagtgaggcctggcatggtggctcacacctgtaatcccagagctttggaaggctgaggcaggtggaccgcttaaggtcaggagttcgagaacagcctggccaacataccttttctctactaaaaacacaaaaattatccgggcatgatggtatgcacctgtaatcccagttactcaggaggctgaggcaggagaatcgcttaaacccaggaggaggaagtttcagtgagccaagattgggccactgcactcagcctgggcaacagagcaatactccatctcaaataaataaataaataaataaataaataaataaataaataaaactaaaaaggtaggccgggaacggtggctcacgtctgtgatcccagcactttgtgacgcccaggtgggaggatcacctgaggtcaggagtttgaaaccagcctggccatcatggcaaaaccccatctctactaaaaatacaaaaattggccgggtgcagcggtgggtgcctgtaatcccagctactcgggaggctgaggcaggagaatcacttgaacccgggaggcggaggtggcaatgaaccaagatcgtgccattgcactccagccttggcaacagagcgagactctctcaaaaactaaataaaaaaataaaaaggtataatgatcaagttaaaaagtttaaaccatacaatttataaagtaaaaaagtaaaagaaagaataagaaagacaaaaaacaaacagaagtaaaagattccccttcagcctttcctttccccgcctcaggtacatgcctgggtgattttttttctttttctttttttttttttgagatggagtctcgctctgttgcccaggctggagtgcagttgcccgatctcggctcactgcaacctccgcctcccgggttcaagcgattctcctgcctcggcctcccaactagctgggattaccagcatgcaccaacatgtccatctaattttttgcgtttttagtagagacagggtttcaccatgttggccaggctggtcttgaagcctgacctcaggtaatctgcccacttcagcctcccaaagtgctgggattacaggcttgagccactgcacccggccagatttttgtatttttattgtagagatgcagttttgccatgttgcccaggctggtctcaaactcatgagctcaagcaatctgcctgcctctgcctgcccacctctgccaccacactcagccaaaatttttaccttgcaaagtaaaattgggaaaattaagagatagcacattcccaagccagagtatttgggaaaaaaaaaaaaaaagacacatcacagtgtgacttttctctttccagaaagaatgggctttgtgattcttttaaagcagttttaaaagtttaaataatattggttttgaatatataaaactataaggaacaagaaaaaaaacatatgtatgtgtatatgtgtgtgtgtgtgtacatgtgtatgtactatcaccccaaaattaaattactgttaacatctcagtgtattatcaatcttttttttttaagaacagagataattcaaaccagatgtggtggctcacgcctgtaatgccaggactttgggaggctgaggagggcagattacttgaggtcaggagttcaagagcagcctgaccaacatagtgaaacctcgttgctactaaaaatacaaaaaattaactgggcgtggtgacgcacacctgtaatcccagctacttgggaggctgaggcatgagaatcacttgaaccccggaggcggaggttgcaatgagccgagatcttgccactgcactccagcctgggtgagggagcaagactctgtatcaaaaaaaaaaaaaaaaaaaaaaaaggacagagataattctatatgttacatttgcatcctatatttttcacttaagcattgttccatgcaatcagaaagtcttcaccagcattttgaaatgatgattattatataaatattagagtcagggtctcactgcattgccaaggctggtctcaaactcctagcctcaagtgatccttcagctttggtccctcaaagtgctgggattacaggcattgagccacaccacccggccttcaccatcatttttaataagtgcttaggccaggcgcggtggctcacgcctgtaatcccagcactttgggaggcagaggcgggtggatcatgaggtcaggagttcgagaccagcctggccaagatggtgaaaccctgtctctactaaaaatacaaaaatcagccaggaatggtggcgggcgcctataatcccagctactcaggaggctgaggcagcagaattgcttgaacccaggaggcagaggtgggtggattacctgaggtcaggtaatcctgggcaacatggtgaaaccctgtctctactaaaaatacaaaaaattagctggacgtggtggcaggtgcctgcctgccaccctctgctgcaatcccagctactagggaggctgaggcaggagaatcccttgaacctgggaggtggaggtagcagtgagctaagatcacgccactgcactctagcctgggtgacagagcaaggctctgtctcaaaaaaataaataaattttttaaaaagtgtgtaatatttcctcatggctatactaataattaaacctgctcatggacacttaggctatttccaatttttgtctattataaacaatactgtaatgaacaagccaggtatgctgactcatgcctataatcccatcggctcaggaggctggaggaccgcttgggcccaggagtttgaggatgtagtgagccataattgcaccactgcactccagcctttgcagtagagcgagaccctgactctaaaaaaaaaaaaaaaaaaaaaatgctataaggaacatatttatgcagaaaccatttcaggtaattttaaattaaattccttgggacactggggactccttgaacaaccagcaggcataccataaacagtaattcaaagacaaattgtttggcagacctttgtttcaaagagtttttgcaggctgggcgcagtggctcatgcccgtaatcctttgggaggccactttgggacaccaaagcaggtggatcccttgaggtcaggagttcaaaactagccttgacaacatgatgaaaccctgtttcaactgaaaatacaaaaaattatccaggcatggcggcaggtgcctataatcccagctactcgggaggctgaggcaggagaatcgcttctcctggaggaggcagaggttgcagtgagccaagatcgcaccactgcactccagcctgggcaacagagcaacactctatctcaaaaaacaaaaacaaaacaaaaaaaaaaaacaacagagtttttgcagtactcctttaagacttttctggtatatagaaatgattaattttccagaattctatatatgtacagctttgaagataagaagggttgcctgtagtaaaacgtaataatcatcatattcataactctcatgtattgggtacttttttttccttcatgctttatgtatattatctcatttaattcatacctcagctcttaaaagtaggtattgtcttttttttttttttttgagatgaagtcacgctctgttgcccaggctggagtgcaatgacacaatcttggctcactgcaacctccacctcccgggttcaagcaattctcctgcctcagcctcccgagtagcttggactgcaggcacatgccaccacgcctggctaatttttaaaatattcttagtagagatggggttttactgtgttagtcaggatggtctcgatctcctgacctcgtgatccgcccatcttggcctcccaaagtgctgggattacagtcataagccactgcgcccggccagtattgtctgtatccttattttacagccatagaaactgcagcttagagaagtaattggtgaaaggccacatagttatatagtgagataacctggtttcagctccaaatcccatattctaaccattatcctatactgccacatcaggagtccctgctaacttttatttaagactagtctgtttttttccccaaccccttcagcaaatcaattaagtctagcaggatgcagtggtgtgtgcctatagtcccagctacttgggaggctgaggtgggaggaccacttgagcctaggagttccagtccagcctggacaacatagcaagaccccatctctaaaaataataataagactgggtgtggtggctgacacctgcaatcccagcactttgggaggctgaggtgggtggatcacttgagcccaggagttcaagaccagcctgggcaacatggtcaatccctatctctactaaaaatacaaaaattagccaggcatgatggtgtgcacctataatcccagctatttgaaaggctgaggcaggagaattgcttgaacctgcgaggcagaggttgcagtgagagccaagatcgtgccattgcactccagcctaggcaacaagagcacaactccatctcaaaaaaaaaaaaatggctggatgcagtggctcatgcctgtaatcccagcactttgggaggcccaggggggtggatctcttatggtcaggagtttgagactagcctagccaacatggcaaaacctcagctttactacaaatatgaaaaaatttaggatgggcgcagtggctcatgcctataatcccaacactttgggaggctgagacaggtggatcattttaggtcaagagtttgagaccaggttggccaacatggtgaaaccccgtctctactaaaaatacaaaaattaagggccaggagtggtggctaacgcctgtaatcccagcactttgggaggccgaggcgggcagatcacgaggtcaggagatcgagaccatcctggctaacacggtgaaaccccgtatctactaaaaaacatacaaaaaattagccgggcttggtggtaggcacctgtaatcccagctacttgggaggctgaggcagttgactcacttgaacctgggaggcggaggttgcagtgagctgagattgcaccattacactccagcctgggtgacagaggaagactctgtttcaaaaaaaaaaaagaaaaagaaaaagaaaaaaaaaaaatttagctgggcgtggtggtgcacacttgtaatcccagctactcaggaggctgaggcaggagaatcgcttgaacctggaaggcagaggttgcagcaagccaagatcgcaccactgcactccagcctgggtaagagagtaagactttgtctcaaaaaaaaaaaaaaaaaattagctgggtgtggttttgggtgcctgtaatcccacctactcaggaggctgaggcaggagaatcacttgaacctgggaggtggaggttgcagtgggcgaagatcgcacttgtgcatcctagcctgagcaacagagcaaaactctgtcccccgaccccctgcaaaaaaaaaaaaaaagttgagtgccactgacatagacaagtaacttgtccaaatattagtcattaagggatgaaattgttattgaaacattacttataaaataaataaataacaaggctgggcacagtggctcacacctatatcctagcactttgggatgccgaggtgggcagattgcctgagctcaggagtttgagaccagtctgggcaacatggtgaaaccccgtctctatgaaaatacaaaatattagatggggccgggcacggtggctcacgtctgtaatcccagcactttgggaggccaaggtgggcgaatcacgaggtcaagagatcaagaccagtctggccaacatggtgataccgcgtctcaattaaaaatagaaaaattagctgggggtggtggcatgtggctgtagtcccagctactcgggaggctgaggcaggagaattgcttgaaccggggaggcggaggttacagtaagccgagattgtgccactgcactccagcctgggcgacagagcgagactctgtctgcaaaaaataataataataaatagaagccaggcgtggtgactcacgcctgtaatcccagcactttgggaggccaaggtgggcagatcacctaaagtcaggagttcgagaccagcctgaccaacatggagaaaccctgtctctactaaaaatacaaaaattagctgcatgtggtgttgcatgcctgtaatcccagctactctggaggctgaggcaggagaatcgcttgaacctgggaggcagaggttgcagtaagctgagatcatgccattgcactccagcctgggcgacaagaccgaaactttgtctcaaataataataataataatgataataataatacattaaataaatgaataacaagaagatgactctgaagggctgtcacagaaacagactcattcattttgactttgtggcagttttagtttgaagctaaagaggagatcgtttttatttcatagcgagaaatggcttccgggtgctgagtagaaggggcaggcatgtttggtagtgggctctccagccctagaagcatgcacgcagagcctctgtaggacttttttttttcttttttttaagacagagtcttgctctgtcgcccaggctggaatgcaatggcgcaatctcggctcacttcaacctccacctctcgggttcaagcaattctcctgcctcagcctcccaagtagctgggattactaggcacctgccaccacacctggctaatttttttttttttgtatttttagtagagacagtgtttcaccatgttggccaggctggcctcgaactcctgacctcaggtgatccacctgtctcggcctcccaaagtgctgggattacaactgtgagccaccgcagcagcctataggatgtaaaaggagggatgcctggattggctgggggagttggagtgaatgaccccagggttgcttcctgcatgggacagctccgcttgctaggaggtgctacagaggcttgggcctgtttctcgtgttcttttttaatagttttgccatttgatgttattgaatttacttttctagacactctgacctggtcacagccagagacacttggaaatcctccatctccccggcatggtcatgtgatggtggcagcagggacaaagctcttcatccacggaggcttggcgggggacagattctatgatgacctccactgcattgatataagtaagcagggcatgggggcttgtctgtttaaaattgttatttttatttatttatttatttttagacaggatctctgtctgtcactcaggctggagtgcggtggcatgatctcagtagcctcagcctccaggactcaagtaatcctcctacctcatcctccgcagtagctggagctacaggtgtgtgccaccatgcttggctaatataaaattttattttggtagagatggggtctcaccatgttgcccaggctgatctcaaacttctgtgctcaagtgattttttagtgtgctttgaaagaatatggccttgcttggccaggtgcaatggctcatgcctgtaatcttagcaccttgggaggctgaggcaggcatatcacctgagatcaggagtttgagaccagcctggccaacatggtgaaaccccgtgtctactaaaaatacaaaaattagcctattgtcatggcacatgtgcctgtaatcccagctacgttggtgcctgagtcaggagaatcgcttgaacccaggaggtggaggttgtggtgagctaagattacgccactgcactccagcctgggccacagagcaagactccatctccaaaaaaaagaaaaaaaaaaaaaagccgggcttggtgactcacacctgtaatcccagcactttgggaggctgaggctgggggatcatgaggtaaggaggtcgagaccagcctggccaacatagtgaaaccccatctctactaaaaataaaaaaaattagccaagtgtggtggcactcgcctctagtcctagctacttgggaggctgaggcaggagaattgcttgaacccgggaggcagaggttgcagtgagccgagaccacaccattgcactccagcctgggtgacagagtgagactccatctcagaaaaaagagctgggcacagtggctcatgcctgtaatcccagcactttgggaggccaaggcaggtggatcatctgaggtcaggagttcgagaccagcctggccaacatggtgaaaccccatctctactaaaaatataaaaattagccaggcgtggtggtgcatgcctgtaatcccagctactcgggaggctgaggcaggagaattgcttgagcccaggaggcagaggttgcagtgatccaagatcatgccactgcacttcatcctgggcgacacagcaagactccgtctccaaaaaaaaaagaaaaaaagaaaaaaaaaatcagccaggcttggtgacaggcacctgtagtcctggctacgtgggaggctgaggcaggagaatcgctggaacctgggaggtggaggttgccgtgagctgattgcacccctgcactccagcctagacgacagagtgagactccgtctcaaagaaaagaaaaaagaaaaagaaaatatagccttgctcttatgtgtaggtaacttgaccagctggcagaatcttcatcagattctgttacctctggacagaatactaataataaaaaatcatagcactaaataatctcctgagtgcttactatggacccagccatttattgtctcttaaccttccaacagtgctctcctttcattacaacccattatgctttgtgttggcctactggatttctttctggtgttagccattaacccatgaaggatctggataatgtggatgtagatgactagagtttcatgcttttcatgttaaatggttgaaaacagtgggaagaggaaggttagagagaacatgagaaatatcctttaagtatctgaagggctgatatgctgtggagagaccctggactcattctgggcaattccttcaagctgtgaggtccattatggtagggaacttgtctattttgttctccagtacatttctagcacttagcacagtgtctggcagatagtgggtgacaggtactttcttttttttgagatagtgtctcacttggttgcccaggctggaatgcactgatgcgatcttagctcatggcagcctctgcctctcaggtcaagtgattctcctgcctcagcctcccgggtagctgggacaacaggcacgtgctacaacacccagataatttttttattttctgtagagatgaggtttcaccatgttgcccaggctggtctccaactccaggactcaagggatccacccgccttggcctctcaaagtgctgggattataggcgtgaaccactgctcccggctcatacctgttattgagtggagggatgaagaaatgaacatgttctgcattgctccagactacaagaactggaacaatgggcagaaggcatgggaagtcctgtgtagtgtatcgggctgacttcccaagccctgaattatctggctccatgacagctgaggccaggggacactggctttgtattcttgcattggctagaattttggccacaccgggtgattctcccttcttactctgagatgctgggcccctgccttgcattgacagatggaaactatttttttttttttttgagatggagtctcgctctgttgcccaggctggagtgcagtggtgcaatcttggctcactgcaagctctgcctcccgggttcatgccattctcctgcctcagcctcctgagtagttgggactacaggtgtccaccaccacgcccggctaattttttgtatttttagtagagacagggtttcaccgtgttagccaggatggtctcaatctcctgaccttgtgatccgcccacctcggcctcccaaagtgctgggattacaggtgtgagccactgcgcccggccgacagatggaaactatttacacaaaaccattccttgcgggcagtcagatggggtcttaatgcttatttttaaaaagagcctttttctggtgttaggaactacttgttgactatttttcctgcctacccaagtagttctctaaatctaaaatccagtgatagcttgccttatttaaatgcttgttttggctgggagcagtggctcacccctgtaatcccagcactttgggaggccgaggtggacggatcacctgaggtcaggagtttgagactagcctggccaacatggtgaaaccctgtctctactaaaaatgcaaaaattagccgggtgtggcggcacgtgccagctactctggaggctgaggcaggagcatcgcttgaatccgggaggtggaggttgcagtgagctgagatcgcgccactgcactccagcctgggtaacagagtgagactctgtctcaaaagaaaaaaaaatgcttgtttgaaaagatgcaagtttccctgcaaaaataggtgggaagtaggcgctaaggcagcacattatcgtgtagagattttggagacacaggctttggagccacacctaagtgcagtcttgctgtgccacttacaagctatagggtctcggacaagtctctttccttctctattcttgtttgctcatttgtaagaagaaaggggaggccaggcaccaggccatggctcccgcctgtaatcccagcactctgggaggccgaggtgggtggatcacgaggtcaggagttcaagaccagcctggccaagatggtgaaacaccgtctctactaaaaatacaaaaaattagccagacccggtggcaggtgcctgtaatcccagctactcgggaggctgaggcagagaattgcttgaacctgggagtcaagatcaagccactgcactccaggctgggcaacagagcggaaaaaaaaagaataagaaaggggataggcagaagtaatagaaatttcatagggctgttatgaaaattaagtgagcaaaatttgttgtttagccagcacttacaaaatcgctaaggaactgtattttttttttttttttttttttgagacggagcttcgctcttgttgcccaggctggagtgcaatggtgtgatctcagctcagcgcaacctccgcctcccaggttcaagcgattctcatgcctcagcctcctgagtagctgggattacaggcatgcaccaccatgcctggctaattttgtatttttagtagagacggggtttctccatgttggtcaggctggtctcgaactcccgacctcaggtgatccgcccgcctcggcctcccaaagtgctgggattacaggcgtgagccaccgtgcccggcccaggaactgtatttaaagtacacacacacacacacacacacacacacagagacagagagagagagagagagaaactgagctaattcgaggcagttaatagtgaatggttgaaggtgactgttattataaaggttgtatcacatttctgtgtgatccaaagactgcctacatcagaatcgcctgagattctgggaatcactgagcccctccctgccttcctccctggactacccaatcataatgtcagagttccccaaataattcttatgtgcactaaacctctcagagctcttggtgaatgactttcagtgattggtgtgcaaactacagtagatagataagtttgaaagcacatcttagcccatgctgcgccaaagctctttctttctcttggcaggtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacaggtgagcaggtgtccatgggggatctttaaacaaatctaaacattctttgaaacgtgatgcggtggctcacgcctgtaatcccagcactttgggaggccgaggcaggcagatcacgaggtcaggagatcgagaccatcctgaccaacatggtgaaaccccatctctactaaaatacaaaaaattagccaggcgtggtggcgggcgcctgtagtcccagctactcgggaggctgaggcaggggaattgcttgaacccaggaggcagagaggttgcagtgagctgagatcacaccactgcactccagcctggtgacagagcgagactctgtctcaaaaaaaaaaaaaaaagaaagaaagaaaaaagtgatgcagtgcttccaatttggttcctctatatctaaatccaaaagaatgaaaactctgtaggggatgacatcaggaaagcagcaatgctgccataaggtttttttccttttactcctgtttgttaggactcggctgctacagtaaatcactgagcatttctagaaatttcattactttttaaattttattcagattttggctttcactatctggaaattgtttttttttttttttttttttttgtctgagatggagtctcactctgtcgcccaggctgtagtgcggtgacgtgatcttggctcactgcaagttccacctcctgggttcacgccattctcctgcctcagcctcccgagtagctgggactacaggtgcccgccaccatgcccagctaattttttttttgtatttttggtagagacggggtttcaccgtgttagccaggatggtctccatctcctgacctcgtgatccacccgcttcggcctcccaaagtgctgggattacaggcgtgagccaccgtgcccggcctatctggaaatttcttaacatgaagccttttccctccccaacatagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaatatcttctgcattatatatctgtttttctcctactttggtaggtgaagaaactaatgcaaataattcttatgtgcactaaaccttgctatattgcctctca

SEQ ID NO: 1821 - DNA, 33619 bp, Homo sapiens
tggagtcacggctcgcgactggcctaagtcgccgcaggtattgcagtccggggctggagggtaggggcgagggtccccggataccgggtctatcacggtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggtgagatttatccattcatctctcaatctattttctttcttcattcactagccactcccccacttctactccatgccaggtccattggtaggttctcggaatggatctgacaggcccagccctctaggaacttagtctagtggaatttaatctagaatctagtctagaagccttaaatagataaacattccaaatgattcctgcaatggtgatggctaataccttcagagcccagtgggtggaagaaggaagtaacttggatgtgggtggaagagaaaagggcaaatcagggaaggtttcaccagggaagggacttttgaactgggctttgaaggttaactaggagtttgcaaatttcccagaagggaagcgacattccaaataggggaagcagaacaggctgcaaaattatgaaaaggcctgccatattacaagaacagcaaaaaaaccaataatgcaagagattgtggaggtgagttcacgggaaaaaagctcaacagcagaaggccttactttctatgctatgttgaggccaagatttatcccagagctcagtatttctcagcttctttaaatattttgtcctttgagcggagagcagtggctcacacctgtaatcccagctttttaggaggctgaggtggaagaattgcctgaggctaggagttcgagaccagcctggacaacaaagcgaaacctccatttctatttttttttctttttttgaggaggagtcttgctctgtcgccaggctggagtgcaagtggcgcaatttcggctcactgcaacctccgcctcttgggttcaagcaattctcacgcctcagcctcctgagtagctgggactacaggcgtgggccacaacgcccagctaattttttttgtatttttagtaaagacagggtttcaccatgttggccaggatggtatcgatctgacctcatgatccgcctgcctcggcctcccaaagtgctgggattacaggcgtgagccactgctcccagccccgtttctatttttaattaaaaaataaataaatggccgggctcagtggctcacgcctgtaatcccagcactttgggaggccgaggcgagccaagttcaagaccagcctggcgaacatagtgaaaccccatccctacgaaaaatacaaaaaaaattagccaggtgtggtggcacttgcctgtagtcccagcttactctggaggctgaggcaggagaatagcttgaacccgggaggcagaggttgcagtgagctgagatcctgccactgcactccagcctgggtgacagagtgagactccatctcagaaaaaataaaaataaaaaataaagccaggcacggtggctcatgcctgtaatcccagcactttgggaggctgaggcgggcaaatcacctgaggtcaggagttagtgaccagcctggccagtgtggtaaaaccccgtctctactagaaaagctagaaaaatgagctgggcgtgggtgggcacctgtaatctcagctactcaggaggctgagaaaggagaatcatttaaacctgggaggggaaggttgcagtgagtggagattgcaccactgcactccaacctgtgcaacagagtgagactctatctaaaaataataataaagataaatacataggccaggcacggtggctcacacctgtaatcccagcactttgggaggctgaggcgggtggatcagctgaggtcaggagttcgagaccagcctgaccaacatggtgaaactccatctctactaaaaatagaaaaattagctgggcgtagtggcacatgcctgtaatccaagctactcgggaggctgagggaggagaatcgtttgaacctgggaggcagaggttgccatgagctgagatcttgccattgcactccagcctgggcaacgagagctaaactccatctcaaataaataaataaataaataaataataaaaataaagatgaaaagttggtgattcttattcaaatcaatcaggcctagaaattagtacattcaacaggaaaggtttaaaaaggaggttgaattgattaagatgataatcataagtgtctaaaaagtgcctttctttcttatgcataggacaccatgaagcaactgccagtcttggaacctggagacaagcccaggaaagcaacatggtctgtaaggaaggatccagacacagaaaagcatgagtttttgtttcatttataagtagtttatttacatatttgatcatcaacaaaaaggggtagagatgaaactgtctgcagtttctggtaattagactcaaactgtctgagaaagtcttcagaggaaagataggggggcagtaattatcacagagcagatgttaattttattaaaatccatttaccagaaagagtaaggcactgaccatctggcatcctcagctccaatgctgtgtcttcccccgagctctgactcatttttaagatttttaggaaattagatttggattaaactggcttcactgtttcttggctgtttgttcaaacaaccctttattcaacaactaacattggcctgatgggggcagctgctctgtgggtgctggaggtagaattgtaaatagtctctgtgtactggggactacagactaagcaggtgatggtgataaaatgtgatctgctctgagtcagggcccacagaaggttgtagagaggtggcagttcttcaacaggaccttgaaggagagactccagactggcttccatgcatctgtcttgctctgtacccagaatacagccaatcatggcatttcctagtttaaaacccttttgtgcctccctgttggtgttgggataaaaatcagactcctgggctgggcacggtggctcatgcctgtaatcccagcactttgggaggccaaggcgggtggatctcctgaggtcaggagtttgagaccagcctgaccaatatggtgaaaccccatctctactaaaaatacaaaaattagctggcatggtgttgtgcaactgtagtcccagctactagggaggctaagacaggagaattgcttgaatctgggaggcagaggttgcagtgagctgagatcatgccactgtactccagcatgggccacagagcaagaatccgtttcaaaaaaaaaaaaaaaaaaaaaggccgggcacggtggctcatgcctgtaatcccagcactttgggaggccgaggtgggcggatcacgaggtcaggagatcgagaccactctggctaacatggtgaaaccctgtctctactaaaaatacaaaaaattagccgggcgtggtggcgggcatctgtagtcccagctactctggaggctgaggcactccagcctgggcgacagagcgagactccatctcaaaaaaaaagaaaaatcagactcctgaccgggcgcaatagctcatgcctataatcctagcactttgggaggctgaggtgggtggatcacttgaagccaggagtttgagaccagtctggccaacatggcaaaaccccgtctctactaaaaatacaaaaattaaccgggagtggtggtgcatgcctgtaatcctggccactcgggaggctgaggcaggacaattcttgaacctgggaggtggaggttgcagcaagccgagatggtgccactgcactccagcctgggcgcaacagagggagactccgtctcaaacaaacaaacaaacaaattagacttcttaaactggcccaatggtccctgcaaaatgtttctgcctgtatttccaacctcaaatcccatgacttgttcctttgttctctttctcttctttattgtgccctttgcactgttccactcaggagctgttcatgctggtctctttgcctggactgctctttctgcctggagtgctctttccctccactttttgtccctctcttttcccagcttattttattttatttttgagacaagttcttcctctgtggctggccacccaggctggaatgcggtggtacaattgtggctcattatagcctcgacctcctggcctcaagtaaccttcccatctccatctcccaagtaactgggactgttggtgtgtactaccatgcccagctaatttttttttttagagacccagtctcgctatgttgcccaggctggtctcaaactcctgggctcaggcgatcctcccactctagcctcccaaagtgctgagattacaggtgtgagccaccacacctggcctacccagctaatttctactcatacttcagatctctctccaaatggtgcttcttcaggaagccttctctgaccaccctatctccctggctccttacagggtgagaccctcctaagacatgcatgtcctcatactatatattctgtactcctttctaccacaattgaagtgaaacagatagttgtgaaactgttgaatgtttcttttcccaactagtctgtaagggctatcaaggcagggacttttttttgttatatccaccatctctggatggctgtgtgcttttggtaaattacttaacctttcttagcttcagttcctccgttgtagaactcagatgatggtaacagctgttatcctcaaagcgtttttttagtttttgtttgtctttgaaacggagtctcactctgttggcaggttggagtgcagtggcacaatctcggctcactgcaacttccgcctcccgggttcaagcgatcctgcctcagcctcccaagtagctgggactataggtgcatgccaccacacccaggtaatttttgtatttttagtagagacggggtttcatcatgttgcccaggatggtctcaatctcttgacctcatgatctgcctgcctcggcctcccaatgtgctgggattacaggcgtgagccactgcgcccggccctcaaaggggttttatgtagattaagtgacatcagaatagagctctgaatgggaaacaaatttggcaaccactgatgaatatatagatgagtgataattgaagttatcactacagataacattaatcaggtaagcaaatgtaaagtgaggaaaagagaattgagaatgacggagagtcaggaggtggctggtaggaaaggagtcggagaaggaagcagaaaggacaaccagaaaagtgagtgcagaaccaaaggaagggatgtgggaaagcctggctgggagaaaggcacaagaagcgaggagaggtcaggagtctcaaacaccagagaggtcaaataagacagggcctgaaaaacagctacagaattttcttttccaatcaggaagcttcaagtgtgttttctcagtcagcattcagaatcactgtggagagtggaatgggctgggcgtggtgggcgcgtccctagcacttagggagaccagggcagaaggattgcttgaggctgggagttcaaggctggccaacatagtgaaaccccatctctactaaaaatacaaaaattagccaggcatggtggtgcgcgcctgtagtcccagctactcgggaggctgaggcaggagaatcacttgaagcctggaagtggaggttatggtgagccaagattgcaccactgcactccagcctgggcaacagagcgagactccgtctcaaaaaaaaaaaagagagagagagatagtggaatgaccgaattctgtatgtgatttttcagagtgctagctttggcttccatcagattgagctttgggggtaatctggaaaagctctgaaatcagtaaattctggataatttttttgatggagaggaatcactggctagtggcaagagccccagggctgttgattaccatgtggtggcacataaagctctcgccaccatttattgagtccttccctgccctgttttgacgtcttgtctcagtcttcacaatcatcttttgcagtaagaactgttgctgtccagccaggcacggtggctcacgcctgtaatcccagcaatttgggaagccgaggcgggcggatcacctgaggtcgggagttcgagaccagcctgaccaacatggagaaatcccatctctactaaaaatataaaattagccaggtgtggtggcacatgcctgtaatcccagctgctagggaggctgaggcaggagaatcgcttgaacccgggaggcggaggttgtagtgagccgagatcacgccattgcactccagcctgggcaacaagagcaaaactccatcttaaaaaaaaaaaaaaaagaaccattgctgtcctcatttcacaaatgagtaaactaaagttcagaaaggttaagtgacttccaaaaggtcacacatctaggaagtacctgagctcgaatttgaaccagatctgtctgaattcatacaccatgctcacagccaccatcctgtgccaagacccatcactgaacatttctggaggtcagtttccctatctaccaaatggggaaaaataagcccagtgcattcctaccagattactgtgagatgaagacagtgacaaaattgaaaagccaaagactgtgtgcaaaggggaggtactattattaatcagagaagtgctgctttattgggtacaatttaaagtgtctgcataaggctcttcattctggtgaatatttcatgaggaatggaaagagcacactactgcatttattctctgctcaggcctcctgaatacatccttcctttggcaggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggtaagatcagcagctgcagagtacatgccctatggccagagaacagggctgtgtgctgctagccatgagcagggcattcctaaaaacaccagcagggttttcctataagaaaacatggccaggaccaggtgtggtggctcacgcctctaatcccagcactttgggaggccaaggcaggtggatcacctgaggttagagttcgagaccagcctgaccaatatgatgaaaccctgtctctactaaaaatacaaaaaaattagccgggtgtggtagtgggcacctgtagtcccagctactcgggaggctgagacaggagaattactttgaactggggagatggaagttaaagtaagccaggatcatgccactgtactccggcctgggtgacagagcaagactctgtctcaaaaaaaaagaaaaaagaaaaagtcagcatcactgacagatccctcaggtttcttagtaggcccctggcacacattcatctgaccagtacctccttgtttagcgggagagaacccttatggagccctggttgtccagccatttattcatcaaatatttctgtaggatacattgatgactaccaccactcattctattcacatatccaatatatcactaagccctacatatctcttttctttgttttttgtttttgtttttttgagatggagtttcgctcttattgcccaggctggagtgcaatggcgcgatcttcactcattgcaacctctgcctcccaggttcaagagattctcctgcctcagcctccccaagtacttgggattacaggcatgtgccaccatgcccagctaattttttttttttttagacggagtcccactctgttgccaaggctggagtgcagtggcacgacctcagctgaccgcaacctgtgccttccaggttcaagcgattctcctgcctcagcctcctgagaagctgggattacaggcgcccaccactacacccagctaatcttttgtatttttagtagagactgagtttcaccatgttggccaggatggtctcgaactccagacctcatgattcacccttcttggcctcccaaagtgctgggattacaggtatgagccaccacgcccagcctacatatctcttatctttatccatgtctgtccatttccactactactactgtagtccaagccactgttatctctcaactagacttacaagagcctcctcaccagcctccctgcttccaagtttaccccctatacagtgcattttctctacctagccagcgaatatcatctaaaatacaaatctaaccatgtcactccctatttcagacttttctcaacctcccttttttttttttttttttgagaccaagtcttgctctgttgcccaggctggagtgcagtggtgctgcaaactcggcttactgcaacctctgcctcctgggttcaagcaattctcctgcctcagcctcctaaatagctgggattacaggtgtgcgccaccatgccctgctaatttttgtatttttagtagagatggggtttcacgatgttgatcaggctggtcttcaaatcctgacctggtgatcctcccgcctcatcctcccaaagtgctgggattatgcatgtgagtcaccacaccagccttttttttttgaggcagcgtgtcgctctgtcacccaggctggagtgcagtggcacaatcttggctcactgcaacctctgcctactgggttcaagcgattctcctgcctcagcctcctgaatagctgggattacaggcgcgtgccaccagcctggctaatttttgtatttttagtagagatgggggtttcaccatgttggccaggctggtctcaaacttctgacctcaagtgatctgcttgcatcagtctcccaaagtgctgggattacaggcgtgagccaccgagcccggccccaacctcatttcttggctctctccaacccacatttgctgcactggatatccttcagttccttgaacacagcttgagctctctggcctccatgcctttgcacacacagatccctctgctaggaatgtttttcccttttcttatcatctggcttctctatatctttcagatttcagattaaatgtcacttctaccaggaacctttcctgttacctctggactcgttcaggcactacatgactctgtatgtccgtagtctcatgtgctcttccatcctgtctgccttcacagccctatcacatgtgattgtttcttgtccgtctgccccacaagaacataagctcctcagaaacagatagcatattttcctcatcattgtatcccagacactaccacagggcttagtacagagtgggtgctctataagtatttaaatgaatgaatgaatgaacctgctaataagaaacaattggatctgggcgcagtggctcacgcctctaatcccagcactttgggaggctgaggcgggcggatcgctaggtcaagagatcgagaccatcctggctaacacggtgaaaccctgtctctactaaaaatacaaaaaattagccaggcgtggtggcgggcacctatagtcccagctactcggggaggctgaggcaggagaatggcgtgaatccgggaggcggagcttgcagtgagtggagatcgtgccactgcactccagcctgggtgacagagcaagtctccgtctcaaaaaaaaaaaaaaaaaaaaaggaaatgattattagctgggcgtggtgactcacgcctgtaatcccagcactttgggaggccgaggcaggcaaatcacaaggtcaggagatcgagaccatcctggccaacatggtgaaaccctgtctctactaaaaatacaaaaaaattagctgggcatgatggcttgtgcccgtagtcccagctgaggcaggagaattgcttgcatctgggaggcagaggttgcagtgagccaagattatgccactgcactccagtctggcaacagagcaagactccgtctcaaaaaaaaaaaaaaaagaaaataaaagaaacgattattctttgctctacacaagggcagaagttgaacaatggtgacccacttacgtattttgttaggtccatgtaacatttccctattgttttaatcttaagttttgtttttttttttgaaatggagtctcaaactgtcacccaggctggagtgcagaggcacgatcttggctcactgcaacctctgcctcctgggttaaagtgattctcctgggccgggcatggtggctcaccatgctgtaatcccagcactttgggaggccgaggtgggcggatcacgaggtcaggagattgagaccatcctggctaacacggtgaaaacccatctctactaaaaataaaaaaaaaaattagccaggcgtggtggcgggcgcctgtagtcccagctactcgggaggctgaggcaggagaatggcatgaacccgggaggcagagcttgcagtgagccgagatcgcgccactgcactccagcctgggtgatagggcgagacgccatctcaaaaaaaaaagaaagtgattctcctgcctcatactcccaagtagctggaactacaggcacgtgccaccatgccccgctaatttttgtatttttagtagagatgggttttcaccatgttggccaggagggtcttgaactcctaacctcaagtgatccacccacctcggcctccccaagtgctgggattacatgcgtgagccaccacgcccagcataatcttaaattgtttaccaaccaattatgcagaaatctacatataaaaatttaaatggtttggcttctcttgataatgttggaaaatctaatgtcagtaggcctccctgtctacatggcaacaattatttggaactgagctgccacctatcaagagggctcttattctccagtttgccacagtttttgttactcccacctaggcatttgaatttctactccctgcactaaaaaaatcaaaggtaggctggacgaggtgtaatcccccagcaccttgggaggccaaggcgggtgggtcacttgaggtcaggagtttgaggccagcccggccaatatggtgaaacccccatctctactaaaaatacaaaaattagccaggcatagtagctcacacttttaatcccagctacttgggaggctgaggcaggagaattgcttgaacctgggaggcagaggttgcagtgagccgagatcgcgccagtgcgctccagcctgggcaacagagcaagactccatctcaaaaaaaaaaaaaattcaaaggtaaattaaatcacttctagccctcaattacattaaattagttcaacttacatctttattgcaacctattaatagctttgtgaccctggctacaccatctcaaccatctggacctcagtgctctataaagtagggataataacttgcttcagatctaacaagataatgcctgtaaaggtcttgtgtaattggttaaccaagtaaaataattgttaataataaaggttagggttttttgtttgtttgtttgttttttgagacggagtcttactgtgtcacccaggctggagcgcaatctcagctcactgcaagctccacctcccgggttaatgccattctcctgcctcagcctcccaagcagctgggactacaggcgcctgccatcgcgcccagctaattttttgtatttttagtagagacagggtttcaccatgttagccaggatggtcttgatctcctgacctcatgatccgcccacctcggcctcccaaagtgctgggattacaggcatgagccacagcgcctgaccaaggttaggtattactattctgtgaacttgtcttagccagccatcatttatttgcaagtaacagaatctcacttaaaccagaggaaaaagggggaatttatttagtcagatacaggcgtgtttctttctttctttcttttttttttttttgagacagagtgttgctgtgttcccagactggagtacagtggcacaatcttggcttgctgcaacctccgcttggtttaccaagtaaaataaccctgggttcaagcgagtcccctacctcagcctcccgagtagctgggactacaggcacgtgccactatgcttggctaattttttgtattttagtagagatgaggtttcaccatgttggccaggatggattcgatctcctgacctcgtgatccgcccacctgggcctcccaaagtgctcggattacaggcgtgagccactgcacctggccaatacaggcgtgtttcaaagaattcaaggacaggaagtagagcccaggatcatgagaaagtggaagcacttgatctggttggctcattctggtttcattggctaccttcaacccaatcagctaaagctacaaagtcaaagcatagtacaaacatgtcatctgggatctatccttgtggttgacaaagtggggacagtttccatagaacggggtctatggactaggcagacagccccctaagtatctattatagaattttctggaggttgacaacatgccctttaagtgattcagtggttttcatttatgtttatggccctcttctcatgaccctcctcaagtgtgccaaccaatataataattggcagccccaatctaggaactgggtgaaatgttttccaggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctggtaagtagccaaaggttattttatttacgtacatacaaataaactttcatgcacacacacacacatatatataaatccaattataattccagtacatttggattatactaattaccatttaactttgctgacatagaaaataggaattttaacttgtagcataatctgaaaacaacagaataaaaacaattgttggtaacacatacaatttttaacttgttaaatgtcaaagctggaagggacttcagagaacagctatatcaagtgggctactcaggtttatcaagggcaaagtgactttcctaaagtcacaagaggccgggcatggtggcccatgcctgtaatcccagtactttgggaggctgaagaaggcagatcacttgaggtcaggagtttgagattggcctggccagcatggtaaaacccccatctctattaaaaatagaaaaattagctgggtgtagtggtgggcgcctataatcccagctactcaagaggctgaggcaggagaatcgcttgaacccgggaggcggagattgcagtgagctgggatcatgccactgcactccagcctgggcgacagagtgagactctgtctcaaaaaaaaaagaaaaagaaaaaaaaatttttttaaaaataaagtcacaagagagtcagtgactgagccaggcttagaacccaagtcacctagattagtagtcctccagtaaaggcgattgtgcccccgggggacatttggccatatctggaaacattttgggttatcacaactgggggtagcgtgggctactggcttctagggggtagaggccagatatgctgtatatatatcctgtcgtgcctaagacagccatcacagggaagaattgtctggtctaaaatgtcagtagtgccaaagttaagaaacactgacctggatcctcctagtatgtttcttttagccaaaagtacaaagttcctaacttgtctcactggcaagacattttgtttgttcgttttgtttgtttgtttttgtttttcatatcttgctgtttccatcactggcagttttattatagaggaagcagtttgggaacgtcgctactgagaggaggttgctaaaccacctgtggggaagtggacttgtctttttgccttttgtttgtttgtttttgtttttctctttacaaatattatttatgttcattgtaaaatatttgaaaagtacaaataagtggaaaaagtcatccacaatccattattatattaaggctattaccaattttctgtctttttttttttttttgtgacggagtttcactcttgttgcacaggctggagtgcagtggtgtgatctcggctcaccacaacctctgcctcccgggttcaagtgattctcctgcctcagcctcccaagtagctgggattacaggcatgcgccaccatgcctggctaattttgtatttttagcagagatggggtttctccatgttagccaggctggtctcaaattcttgatctcaggtgatccgcccacctcagcctcccaaaatgctgggattacaggcatcagccaatgtgaccggcccagctttctgtctttttcctgtcttttctctgtttttacaagcctgagatcatactatatttacacattcataactttttccttttaatttcataatcccaggagaaataggtgggttttttttttttggctttagcaaaaataattgatttgttattaataacaatgctttgttaatataatatcatttgtttgttttttttgggtttttttattgttggtaacttttttttttttcgaggcagggtctcactctgttgcccaggctgggatgcagtggtatgatcacagctcactgcagcctcgaccacccaggctcaggtgaacctcctacctcagcctcccaggtagctgggactacaggcgcttgccaccatgcctagctaatttttttgtattttttgtagagacagagttttgccatgttgcccaaggtggtctcaaactcctgggctcaagcaattttcctgcctcggcctcctgaagtgttgggattacagacatgagccactgcacctggccaacatcatttttaatggctgtatcatactccattatatataaaatactccataatatcataacttctccatttatgaacatttagttcttttcaggtttttaccattataattaacaaagcagtgaacatcttcattcagaagtcatagactgtatttcaaattattttcttagggttcctgccaagaaataaaaaggctaggtaaaatactgtgaaccttttcaaggttttgatacatactaccaaattgctctccagaaagatttttccggtttatcctctctccaactgtgtttaacagtgtttctttcattactgaccagcactgaatttatcagttttaaacattgctaatttgataggcaaaaaaacttgtacatagtttaaatatgcattttgggccggtgcggtggctcacacctgtaatcccagcactttgggaggctgaggtgtacagatcacctgaggtcaggagttccagagcagcctggccaacatggtgaaaccctgtcactactaaaaatacaaaaattagccaggcatggtggtgcatgcctgtagtcccagctgctgaggagggcgaggcaggaggatcgcttgaaccctggaggcagaggttgcaatgtgccgagatcatgccacagcctgagcaatgagtgagactctctctcaaaaaagcattttttgacctggacatttttcacatgtcagccaactcttgctcagttccctctatcaacaatatatttggggtgttgcccacctactacatttgttgagtattgcccgataaaaaaattaaaattaaaaaaaaaaactattgtacaatagttggtcagagttcaggaactaggaccaaattttcttatatgtcaagtatttaaattccttcagcacatttagacagtatgttatcttttaatttgatttatttgtttgggtatttatttcctgtcttccctcctcttccatgccctccctctgtggaacataagcgctttgaagggaagagtttgtttattgttgaatactcagggtacagaacactgtccgaaataaagtagacacggccgggcatggtggctcatgcctataatcccaacactttgggaggacgaggagggcggatcaaaaggtcaggagttccagaccagcctggccaacatactgaaagcccgtctctactaaaaatacaaaagaaaaaattagctgggcttggtggcaggtgcctgtggtcccagctacttgggaggctgaggcaggagaatcgcttgaacctgggaggtggaggttgcagtgagccgagatcgcgccactgcactccagcctgggtgacagagtgagacaccgtctcaaaaaaaaaaaaaaaagaagaaagtgatagagtagacacttggcagaccatttggctaattgtgaagccaatttgcttggaggactagcagtataatatggtgcttaagggcacagatgagggtctctgttttgctatgcactaactatgaccttggactagtgatttaacctctctctgcctctgttttctgtcacattggatagtaatagtttctaccttgttaatttgtcaaggatttaaataaactcagtatctggcacataattaatgctcagtaattgttgtggtagttgatgtagttaaggtttggcaaagggaaatcagttctggaaccctggccttttgattttcaacaatggtatccattgaaataaaataaagtgagaatttggaaagctgtcaaagagggtgattttattttatttatttatttatttatttttatttttgagacagtgtctcactgtgttgccaaggctggagtgcagtggcgcaatctcagctcactgcatcctccacctcttgggttcaaatgattctccagcctcagcctctcgagtagctgggattacaggcacatgccaccatgcccagctaatttttatattaaagagggtgattttctatcatatcccttttctctcctagaaaatataatttgacatcatgcccaagaaatatgaaatatgtacttagttgcatttgttaccaaggcaagtccctcaaatgctcaggactcctttgtgattctttgtgctggtgtttgagttggcaggaatacagccctagggtcttctgggcctggaggtgacatgtatacctttctagctccctctaagatccaaaagctctccaacatctgtaactatagagacagctacattttgctttggatataggctgagactttttcagtctccaggtccccatttgagtcccacacatattacagatgtttcctgtagcattttatatattggatgtagaccttttacaaaagacagaatttcttggtgtgttatggtagagcaagtgtgggactctgatagaactgagttcaggcccggcgcggtagctcacgcctgtaatctcagcactttgggaggccgaggcgggcagatcaggaggtcaggagctcgagaccatcctggctaacacggtgaaactccgtctctactaaaaaaaaaaaaaatacaaaaaattagccgggcatggtggcggatgcctgtagtcccagctgctcgggaggctgaagcaggagaatggcgtgaacccgggaggcggagcttgcaaagtgagccgagatcgcgccactgcactctgggctgggagccacagcgagactccgtctcaaaaaaaaaaaaaaaaaaaaaaaaaaagaactgagttcaaactcctgctctgctacgcacatatgctataacctgcaggaaaggatttaaatgtgcagagcttcagtttcctcatctaaaagtagagatacttccgctcacttcccaagcttgagtgaagacaccagggatggcagtgcccagggcaatgatgctgcccattgagggtgctcaattaatgcatctgcttctataaaacccaggttcatccttaaaagaaataagcttctatacatctatctaggtggtgaaattttattctccagtcagaggagtgggaattagaaagatcttggtgttactgaaagagtttaaattccaactcagccatttcttaggcatgtcactttatctgtctctctctctctctctttctctctctctttctttgccttattctgtaacccaggctggagttgcagtggtgtgatcttgactcactgcaacctcaaccgctgcaggctcagtatatcctcccacctaagcttctcaggtagctgggactataggcatacgccaccacacccgactaatttttttttgtatttttttgtagagacagggttttgccatgttgcccaggctggtctcaaactcctgggctcaagcaatccacctgccccagcctgctaaagtgttgggattacaggcatgagccaccgagcctggctagccatgtctcttttaaaaagttacttaatccatccctacttcaattctcttacctgtaaaatgcggaaattaatatttgtttagcatttactgtttagtagggactgttattactgctactgaaatgtaatagtattgtctttttttttttttcatttctttctttcttttttttttttttcaagatatggtcttactcttttacccaggctagagtgcaatggcacgatcatagttcattgcagcctcaaactcctgggctcaagcaatcctcctgccttggcttcccaaagtgctagggttacaggccttacagccactgtgctcagcctaattttttttaatttttaatttattttattttattattattattttttaagatgaagtctcgctttgtcaaccaggctggagtgcagtggcatgatctcagctcactgcatcctccgcctcctggttcaagtgattctcctgtctcagcctcctgagtagctgggattataggtccccaccacgacacctggctttatttatttatttatttatttttagtagagatgggatttcaccatgttggccaggctggtctagaactcctaccctcaagtgatccacccaccttggtctcccaaagtgctgggattacaagcgtgagccactgcacccctggctgattttttgtagagacaggatattgctttgtttcccagtctggtcacaaactcctgggctcaagcaatcctcctacctcgatttcccaaactgctgaggttacaggtgttagctgctgcacatggcctgcctactttcttttattggccacattttctgggaaatctggcacacctggactctggcatctagtgggaatgaatgttagcagatgttagggggagcgatagtgagcaaagtagaagagggttcagagaggatatttgaaggcctccaaaacaaattgacctcttttttttcttctttttttttaatatggagccttgctctgtcacccaggctggagtgcagtggtgcaatctcagctcactgcaaccttcacctcctgggttcaagcgattctcctgcctcaacctcctgaggagctgggattacaggtccccaccaccatacccggctaatttttcagatttttagtagagatggggttttaccccatgttggccaggctggtttcgaactcctgacctcaagtgatccgcccgccttggcctcccaaagtgctgggattacaggcatgagccacactgcacccagcctgactccattcttgtgcttacagcttttaaatcttggggattttggactgtcttggcaaatcctaagtatcatcttcattcttccttgatgtttgtgagtatgagatccctgcccaaaactatgctggcccccctggggattggagtttggaaactgacttcactcagccccagagtcaaggtcagaagcccctctacctggatattttaagtgcctgcattctctctggcccagaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaagtatggactggtgggcaccttggggctggtcagggccatcccagtttacacattacctaatataggaagcagaagttagaaaaggaaagcctgactaagtgtctcacttctagacttctttgttatatctcttagctgatatctttttcccacagcaaaattggcatttaaaaagggatagtgaggcctggcatggtggctcacacctgtaatcccagagctttggaaggctgaggcaggtggaccgcttaaggtcaggagttcgagaacagcctggccaacataccttttctctactaaaaacacaaaaattatccgggcatgatggtatgcacctgtaatcccagttactcaggaggctgaggcaggagaatcgcttaaacccaggaggaggaagtttcagtgagccaagattgggccactgcactcagcctgggcaacagagcaatactccatctcaaataaataaataaataaataaataaataaataaataaataaaactaaaaaggtaggccgggaacggtggctcacgtctgtgatcccagcactttgtgacgcccaggtgggaggatcacctgaggtcaggagtttgaaaccagcctggccatcatggcaaaaccccatctctactaaaaatacaaaaattggccgggtgcagcggtgggtgcctgtaatcccagctactcgggaggctgaggcaggagaatcacttgaacccgggaggcggaggtggcaatgaaccaagatcgtgccattgcactccagccttggcaacagagcgagactctctcaaaaactaaataaaaaaataaaaaggtataatgatcaagttaaaaagtttaaaccatacaatttataaagtaaaaaagtaaaagaaagaataagaaagacaaaaaacaaacagaagtaaaagattccccttcagcctttcctttccccgcctcaggtacatgcctgggtgattttttttctttttctttttttttttttgagatggagtctcgctctgttgcccaggctggagtgcagttgcccgatctcggctcactgcaacctccgcctcccgggttcaagcgattctcctgcctcggcctcccaactagctgggattaccagcatgcaccaacatgtccatctaattttttgcgtttttagtagagacagggtttcaccatgttggccaggctggtcttgaagcctgacctcaggtaatctgcccacttcagcctcccaaagtgctgggattacaggcttgagccactgcacccggccagatttttgtatttttattgtagagatgcagttttgccatgttgcccaggctggtctcaaactcatgagctcaagcaatctgcctgcctctgcctgcccacctctgccaccacactcagccaaaatttttaccttgcaaagtaaaattgggaaaattaagagatagcacattcccaagccagagtatttgggaaaaaaaaaaaaaaagacacatcacagtgtgacttttctctttccagaaagaatgggctttgtgattcttttaaagcagttttaaaagtttaaataatattggttttgaatatataaaactataaggaacaagaaaaaaaacatatgtatgtgtatatgtgtgtgtgtgtgtacatgtgtatgtactatcaccccaaaattaaattactgttaacatctcagtgtattatcaatcttttttttttaagaacagagataattcaaaccagatgtggtggctcacgcctgtaatgccaggactttgggaggctgaggagggcagattacttgaggtcaggagttcaagagcagcctgaccaacatagtgaaacctcgttgctactaaaaatacaaaaaattaactgggcgtggtgacgcacacctgtaatcccagctacttgggaggctgaggcatgagaatcacttgaaccccggaggcggaggttgcaatgagccgagatcttgccactgcactccagcctgggtgagggagcaagactctgtatcaaaaaaaaaaaaaaaaaaaaaaaaggacagagataattctatatgttacatttgcatcctatatttttcacttaagcattgttccatgcaatcagaaagtcttcaccagcattttgaaatgatgattattatataaatattagagtcagggtctcactgcattgccaaggctggtctcaaactcctagcctcaagtgatccttcagctttggtccctcaaagtgctgggattacaggcattgagccacaccacccggccttcaccatcatttttaataagtgcttaggccaggcgcggtggctcacgcctgtaatcccagcactttgggaggcagaggcgggtggatcatgaggtcaggagttcgagaccagcctggccaagatggtgaaaccctgtctctactaaaaatacaaaaatcagccaggaatggtggcgggcgcctataatcccagctactcaggaggctgaggcagcagaattgcttgaacccaggaggcagaggtgggtggattacctgaggtcaggtaatcctgggcaacatggtgaaaccctgtctctactaaaaatacaaaaaattagctggacgtggtggcaggtgcctgcctgccaccctctgctgcaatcccagctactagggaggctgaggcaggagaatcccttgaacctgggaggtggaggtagcagtgagctaagatcacgccactgcactctagcctgggtgacagagcaaggctctgtctcaaaaaaataaataaattttttaaaaagtgtgtaatatttcctcatggctatactaataattaaacctgctcatggacacttaggctatttccaatttttgtctattataaacaatactgtaatgaacaagccaggtatgctgactcatgcctataatcccatcggctcaggaggctggaggaccgcttgggcccaggagtttgaggatgtagtgagccataattgcaccactgcactccagcctttgcagtagagcgagaccctgactctaaaaaaaaaaaaaaaaaaaaaatgctataaggaacatatttatgcagaaaccatttcaggtaattttaaattaaattccttgggacactggggactccttgaacaaccagcaggcataccataaacagtaattcaaagacaaattgtttggcagacctttgtttcaaagagtttttgcaggctgggcgcagtggctcatgcccgtaatcctttgggaggccactttgggacaccaaagcaggtggatcccttgaggtcaggagttcaaaactagccttgacaacatgatgaaaccctgtttcaactgaaaatacaaaaaattatccaggcatggcggcaggtgcctataatcccagctactcgggaggctgaggcaggagaatcgcttctcctggaggaggcagaggttgcagtgagccaagatcgcaccactgcactccagcctgggcaacagagcaacactctatctcaaaaaacaaaaacaaaacaaaaaaaaaaaacaacagagtttttgcagtactcctttaagacttttctggtatatagaaatgattaattttccagaattctatatatgtacagctttgaagataagaagggttgcctgtagtaaaacgtaataatcatcatattcataactctcatgtattgggtacttttttttccttcatgctttatgtatattatctcatttaattcatacctcagctcttaaaagtaggtattgtcttttttttttttttttgagatgaagtcacgctctgttgcccaggctggagtgcaatgacacaatcttggctcactgcaacctccacctcccgggttcaagcaattctcctgcctcagcctcccgagtagcttggactgcaggcacatgccaccacgcctggctaatttttaaaatattcttagtagagatggggttttactgtgttagtcaggatggtctcgatctcctgacctcgtgatccgcccatcttggcctcccaaagtgctgggattacagtcataagccactgcgcccggccagtattgtctgtatccttattttacagccatagaaactgcagcttagagaagtaattggtgaaaggccacatagttatatagtgagataacctggtttcagctccaaatcccatattctaaccattatcctatactgccacatcaggagtccctgctaacttttatttaagactagtctgtttttttccccaaccccttcagcaaatcaattaagtctagcaggatgcagtggtgtgtgcctatagtcccagctacttgggaggctgaggtgggaggaccacttgagcctaggagttccagtccagcctggacaacatagcaagaccccatctctaaaaataataataagactgggtgtggtggctgacacctgcaatcccagcactttgggaggctgaggtgggtggatcacttgagcccaggagttcaagaccagcctgggcaacatggtcaatccctatctctactaaaaatacaaaaattagccaggcatgatggtgtgcacctataatcccagctatttgaaaggctgaggcaggagaattgcttgaacctgcgaggcagaggttgcagtgagagccaagatcgtgccattgcactccagcctaggcaacaagagcacaactccatctcaaaaaaaaaaaaatggctggatgcagtggctcatgcctgtaatcccagcactttgggaggcccaggggggtggatctcttatggtcaggagtttgagactagcctagccaacatggcaaaacctcagctttactacaaatatgaaaaaatttaggatgggcgcagtggctcatgcctataatcccaacactttgggaggctgagacaggtggatcattttaggtcaagagtttgagaccaggttggccaacatggtgaaaccccgtctctactaaaaatacaaaaattaagggccaggagtggtggctaacgcctgtaatcccagcactttgggaggccgaggcgggcagatcacgaggtcaggagatcgagaccatcctggctaacacggtgaaaccccgtatctactaaaaaacatacaaaaaattagccgggcttggtggtaggcacctgtaatcccagctacttgggaggctgaggcagttgactcacttgaacctgggaggcggaggttgcagtgagctgagattgcaccattacactccagcctgggtgacagaggaagactctgtttcaaaaaaaaaaaagaaaaagaaaaagaaaaaaaaaaaatttagctgggcgtggtggtgcacacttgtaatcccagctactcaggaggctgaggcaggagaatcgcttgaacctggaaggcagaggttgcagcaagccaagatcgcaccactgcactccagcctgggtaagagagtaagactttgtctcaaaaaaaaaaaaaaaaaattagctgggtgtggttttgggtgcctgtaatcccacctactcaggaggctgaggcaggagaatcacttgaacctgggaggtggaggttgcagtgggcgaagatcgcacttgtgcatcctagcctgagcaacagagcaaaactctgtcccccgaccccctgcaaaaaaaaaaaaaaagttgagtgccactgacatagacaagtaacttgtccaaatattagtcattaagggatgaaattgttattgaaacattacttataaaataaataaataacaaggctgggcacagtggctcacacctatatcctagcactttgggatgccgaggtgggcagattgcctgagctcaggagtttgagaccagtctgggcaacatggtgaaaccccgtctctatgaaaatacaaaatattagatggggccgggcacggtggctcacgtctgtaatcccagcactttgggaggccaaggtgggcgaatcacgaggtcaagagatcaagaccagtctggccaacatggtgataccgcgtctcaattaaaaatagaaaaattagctgggggtggtggcatgtggctgtagtcccagctactcgggaggctgaggcaggagaattgcttgaaccggggaggcggaggttacagtaagccgagattgtgccactgcactccagcctgggcgacagagcgagactctgtctgcaaaaaataataataataaatagaagccaggcgtggtgactcacgcctgtaatcccagcactttgggaggccaaggtgggcagatcacctaaagtcaggagttcgagaccagcctgaccaacatggagaaaccctgtctctactaaaaatacaaaaattagctgcatgtggtgttgcatgcctgtaatcccagctactctggaggctgaggcaggagaatcgcttgaacctgggaggcagaggttgcagtaagctgagatcatgccattgcactccagcctgggcgacaagaccgaaactttgtctcaaataataataataataatgataataataatacattaaataaatgaataacaagaagatgactctgaagggctgtcacagaaacagactcattcattttgactttgtggcagttttagtttgaagctaaagaggagatcgtttttatttcatagcgagaaatggcttccgggtgctgagtagaaggggcaggcatgtttggtagtgggctctccagccctagaagcatgcacgcagagcctctgtaggacttttttttttcttttttttaagacagagtcttgctctgtcgcccaggctggaatgcaatggcgcaatctcggctcacttcaacctccacctctcgggttcaagcaattctcctgcctcagcctcccaagtagctgggattactaggcacctgccaccacacctggctaatttttttttttttgtatttttagtagagacagtgtttcaccatgttggccaggctggcctcgaactcctgacctcaggtgatccacctgtctcggcctcccaaagtgctgggattacaactgtgagccaccgcagcagcctataggatgtaaaaggagggatgcctggattggctgggggagttggagtgaatgaccccagggttgcttcctgcatgggacagctccgcttgctaggaggtgctacagaggcttgggcctgtttctcgtgttcttttttaatagttttgccatttgatgttattgaatttacttttctagacactctgacctggtcacagccagagacacttggaaatcctccatctccccggcatggtcatgtgatggtggcagcagggacaaagctcttcatccacggaggcttggcgggggacagattctatgatgacctccactgcattgatataagtaagcagggcatgggggcttgtctgtttaaaattgttatttttatttatttatttatttttagacaggatctctgtctgtcactcaggctggagtgcggtggcatgatctcagtagcctcagcctccaggactcaagtaatcctcctacctcatcctccgcagtagctggagctacaggtgtgtgccaccatgcttggctaatataaaattttattttggtagagatggggtctcaccatgttgcccaggctgatctcaaacttctgtgctcaagtgattttttagtgtgctttgaaagaatatggccttgcttggccaggtgcaatggctcatgcctgtaatcttagcaccttgggaggctgaggcaggcatatcacctgagatcaggagtttgagaccagcctggccaacatggtgaaaccccgtgtctactaaaaatacaaaaattagcctattgtcatggcacatgtgcctgtaatcccagctacgttggtgcctgagtcaggagaatcgcttgaacccaggaggtggaggttgtggtgagctaagattacgccactgcactccagcctgggccacagagcaagactccatctccaaaaaaaagaaaaaaaaaaaaaagccgggcttggtgactcacacctgtaatcccagcactttgggaggctgaggctgggggatcatgaggtaaggaggtcgagaccagcctggccaacatagtgaaaccccatctctactaaaaataaaaaaaattagccaagtgtggtggcactcgcctctagtcctagctacttgggaggctgaggcaggagaattgcttgaacccgggaggcagaggttgcagtgagccgagaccacaccattgcactccagcctgggtgacagagtgagactccatctcagaaaaaagagctgggcacagtggctcatgcctgtaatcccagcactttgggaggccaaggcaggtggatcatctgaggtcaggagttcgagaccagcctggccaacatggtgaaaccccatctctactaaaaatataaaaattagccaggcgtggtggtgcatgcctgtaatcccagctactcgggaggctgaggcaggagaattgcttgagcccaggaggcagaggttgcagtgatccaagatcatgccactgcacttcatcctgggcgacacagcaagactccgtctccaaaaaaaaaagaaaaaaagaaaaaaaaaatcagccaggcttggtgacaggcacctgtagtcctggctacgtgggaggctgaggcaggagaatcgctggaacctgggaggtggaggttgccgtgagctgattgcacccctgcactccagcctagacgacagagtgagactccgtctcaaagaaaagaaaaaagaaaaagaaaatatagccttgctcttatgtgtaggtaacttgaccagctggcagaatcttcatcagattctgttacctctggacagaatactaataataaaaaatcatagcactaaataatctcctgagtgcttactatggacccagccatttattgtctcttaaccttccaacagtgctctcctttcattacaacccattatgctttgtgttggcctactggatttctttctggtgttagccattaacccatgaaggatctggataatgtggatgtagatgactagagtttcatgcttttcatgttaaatggttgaaaacagtgggaagaggaaggttagagagaacatgagaaatatcctttaagtatctgaagggctgatatgctgtggagagaccctggactcattctgggcaattccttcaagctgtgaggtccattatggtagggaacttgtctattttgttctccagtacatttctagcacttagcacagtgtctggcagatagtgggtgacaggtactttcttttttttgagatagtgtctcacttggttgcccaggctggaatgcactgatgcgatcttagctcatggcagcctctgcctctcaggtcaagtgattctcctgcctcagcctcccgggtagctgggacaacaggcacgtgctacaacacccagataatttttttattttctgtagagatgaggtttcaccatgttgcccaggctggtctccaactccaggactcaagggatccacccgccttggcctctcaaagtgctgggattataggcgtgaaccactgctcccggctcatacctgttattgagtggagggatgaagaaatgaacatgttctgcattgctccagactacaagaactggaacaatgggcagaaggcatgggaagtcctgtgtagtgtatcgggctgacttcccaagccctgaattatctggctccatgacagctgaggccaggggacactggctttgtattcttgcattggctagaattttggccacaccgggtgattctcccttcttactctgagatgctgggcccctgccttgcattgacagatggaaactatttttttttttttttgagatggagtctcgctctgttgcccaggctggagtgcagtggtgcaatcttggctcactgcaagctctgcctcccgggttcatgccattctcctgcctcagcctcctgagtagttgggactacaggtgtccaccaccacgcccggctaattttttgtatttttagtagagacagggtttcaccgtgttagccaggatggtctcaatctcctgaccttgtgatccgcccacctcggcctcccaaagtgctgggattacaggtgtgagccactgcgcccggccgacagatggaaactatttacacaaaaccattccttgcgggcagtcagatggggtcttaatgcttatttttaaaaagagcctttttctggtgttaggaactacttgttgactatttttcctgcctacccaagtagttctctaaatctaaaatccagtgatagcttgccttatttaaatgcttgttttggctgggagcagtggctcacccctgtaatcccagcactttgggaggccgaggtggacggatcacctgaggtcaggagtttgagactagcctggccaacatggtgaaaccctgtctctactaaaaatgcaaaaattagccgggtgtggcggcacgtgccagctactctggaggctgaggcaggagcatcgcttgaatccgggaggtggaggttgcagtgagctgagatcgcgccactgcactccagcctgggtaacagagtgagactctgtctcaaaagaaaaaaaaatgcttgtttgaaaagatgcaagtttccctgcaaaaataggtgggaagtaggcgctaaggcagcacattatcgtgtagagattttggagacacaggctttggagccacacctaagtgcagtcttgctgtgccacttacaagctatagggtctcggacaagtctctttccttctctattcttgtttgctcatttgtaagaagaaaggggaggccaggcaccaggccatggctcccgcctgtaatcccagcactctgggaggccgaggtgggtggatcacgaggtcaggagttcaagaccagcctggccaagatggtgaaacaccgtctctactaaaaatacaaaaaattagccagacccggtggcaggtgcctgtaatcccagctactcgggaggctgaggcagagaattgcttgaacctgggagtcaagatcaagccactgcactccaggctgggcaacagagcggaaaaaaaaagaataagaaaggggataggcagaagtaatagaaatttcatagggctgttatgaaaattaagtgagcaaaatttgttgtttagccagcacttacaaaatcgctaaggaactgtattttttttttttttttttttttgagacggagcttcgctcttgttgcccaggctggagtgcaatggtgtgatctcagctcagcgcaacctccgcctcccaggttcaagcgattctcatgcctcagcctcctgagtagctgggattacaggcatgcaccaccatgcctggctaattttgtatttttagtagagacggggtttctccatgttggtcaggctggtctcgaactcccgacctcaggtgatccgcccgcctcggcctcccaaagtgctgggattacaggcgtgagccaccgtgcccggcccaggaactgtatttaaagtacacacacacacacacacacacacacacagagacagagagagagagagagagaaactgagctaattcgaggcagttaatagtgaatggttgaaggtgactgttattataaaggttgtatcacatttctgtgtgatccaaagactgcctacatcagaatcgcctgagattctgggaatcactgagcccctccctgccttcctccctggactacccaatcataatgtcagagttccccaaataattcttatgtgcactaaacctctcagagctcttggtgaatgactttcagtgattggtgtgcaaactacagtagatagataagtttgaaagcacatcttagcccatgctgcgccaaagctctttctttctcttggcaggtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacaggtgagcaggtgtccatgggggatctttaaacaaatctaaacattctttgaaacgtgatgcggtggctcacgcctgtaatcccagcactttgggaggccgaggcaggcagatcacgaggtcaggagatcgagaccatcctgaccaacatggtgaaaccccatctctactaaaatacaaaaaattagccaggcgtggtggcgggcgcctgtagtcccagctactcgggaggctgaggcaggggaattgcttgaacccaggaggcagagaggttgcagtgagctgagatcacaccactgcactccagcctggtgacagagcgagactctgtctcaaaaaaaaaaaaaaaagaaagaaagaaaaaagtgatgcagtgcttccaatttggttcctctatatctaaatccaaaagaatgaaaactctgtaggggatgacatcaggaaagcagcaatgctgccataaggtttttttccttttactcctgtttgttaggactcggctgctacagtaaatcactgagcatttctagaaatttcattactttttaaattttattcagattttggctttcactatctggaaattgtttttttttttttttttttttttgtctgagatggagtctcactctgtcgcccaggctgtagtgcggtgacgtgatcttggctcactgcaagttccacctcctgggttcacgccattctcctgcctcagcctcccgagtagctgggactacaggtgcccgccaccatgcccagctaattttttttttgtatttttggtagagacggggtttcaccgtgttagccaggatggtctccatctcctgacctcgtgatccacccgcttcggcctcccaaagtgctgggattacaggcgtgagccaccgtgcccggcctatctggaaatttcttaacatgaagccttttccctccccaacatagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaatatcttctgcattatatatctgtttttctcctactttggtaggtgaagaaactaatgcaaataattcttatgtgcactaaaccttgctatattgcctctca

SEQ ID NO: 1822 - DNA, 33619 bp, Homo sapiens; identical to SEQ ID NO: 1821

SEQ ID NO: 1823 - DNA, 58182 bp, Homo sapiens
gtcttgtttcaagtccaatttatttcacacaacacacaggctgctgagggaatccacctgcactgcactcagttgaacttccggcccagtgccgcgtcagagactaaaccatgggagaaagttcacaccctggcctgggccacccaccttcagctctctcctgtgcgtcaggacgcacgctggccccaagagcttcactcaacacggctgggtcctgggcggacgtgggcacagcacttgccaggcgcccctggcaggggctcttctgatacgcaaggaggaaggaatgagagagaaacacattcagccgagggggaggcccgtgcaggaggggtagagagaacaccgggttttcagggaagacctcatcaaagagcccacaggcacacggcactcattagcaagctgcccaaattactccacacaccaacgtttttaaaaaatttacaaagctgaattccaataagcatccgataaacatgaaaagcctttcacgaacacccagcagccgcgccacccgccagcccgagcccgctcacctcagtcctccgcaccgctctcctctccgctgtcttcgtcgtcgaccccaccctcggcgccctcaacctcctcactgtcctcttccgagtccgtctcctccagccactcctgagtttcttcaaaagcagaatgaacgcacatacacgtcagcgcagctgaggcaggtgggggaggctgcgggacggtggtggctacgtcctggggggattccattttcttaagaaccataatgtgaaacctaactcctcttccccgacccccttcagatccacaaaggaaacagactgcgttcccctgggcttcaggacagagatccgagacggcaaacatgcaaaagcacccccataacggagcggctggccaacggggcctcctgccaccctccaccccggctcacggtgttctcacaaaacagcaaacatcctgtgccaacagttcaccacctttccctagatttgtggattttgctttagtctcagatctttaaaaactgcatggtgactcgatcccagcagcagttggggtaaaggggacgtgtgactacggcagcagaggggccctgggtcaggcagcaaggctggaggctcagacccagggcctcggggcccggctcggacggccatccacaaacaagcatgctgtggacggagcagcagatgcacccgtgtcctgtgccgccagagccgcagctcccgtcagcacccgggacaaaggacagacgtgcccagggtgggcccccctttccacaacagggtcctgttctccgtcaatctgaccgtggaggcaggagcacaggcgagaagtgtcggcacaggccgcctctgggcagcttgcagggcttgctttcgagggacgcgacacacgaccgtgggctctcgctcccgggcacggaggcaccaagctgcctggctcacctgggtccatctccaccaaggccttccacgcctccatcctgtgcaggtccaggcagtgcaggtcgctgagggtgacctggcggtcgccggcctcaaacatgcccccatagacgtagagcaccccatgcttcacagccagcatggcgttggagcgtggacacggcccaggtgcggggctgccggcctcctcaaggctgtcttcgtcctcagaccggggctgccccgccgagcctggcgcggtgagcacctgcttaatggtgaccacggtgccatcctcggccaccacctccttgaccagctgcacaggcccctgggtgccagctcccccacacgccggcctgctaccaccttcgggctcctcttttctgccccgcctgcgtttcttcttttcagacttgggtccctattaatagaccgaggaagcagagagcagcagcttcagcgaggcaggggtcattcctgctatgcccacaaggccaggcaagggtttgcggggaccacccacaagcgtggggagtgtgtgacccaggaaggcgccatccctgactgccctgggtgcaggcactgggctgcaggagcacgctcctgtctcccactagcctcgccgttcactcctgggctggggcagaaaaccccccactgcgtgtcctcactgaggggccgctccacacctccactgagaggtggacaggcccaccagaccccacacacagggcaccagccccacaggctccgacgctcaccctgggaaaacccaatcacccacagtgctggctcccagaagggctggggaagccaggctgaggggcttcctcccctttcccaagcaagacagacggtcaggcccacaagcccagctcatttactacaaacggcgagccagagaggggcccttcctcaccaaacgtttttaaaggggagctctcaggtcaggctgcctcctgcaggacagctgtccatccctctctgtcccacttccctggctgcgtcgcaggggtcagtctggacccttctgtcacagcctttgtcattttgtcacaaaacgctgccagctcacgaggtgacatttgccaggttatttccaaattttccaaggatcactacctccagatcaacccaaagtcagcttcacattctagacttctaagatccactttgtgtctggactctgcaacagtgagtttcaaaagggaaagctctctgaggtcctccgtaatcctggggaatgtcaacggccctgagatcacagtgtgagaaccgtgacactagctggggtcaacacgctctctgaagaaaagccacaggggaaacctgtgtagactctgcttggagcaattccttctaaagtaaaagagcgaggcggactgtgggtccagaaacgaacccgcgtgtttttccaatttccagcccaggtgccaccacacgtcaaaagcagcttcaggagtttgcaaccaacagcgaccagccctccttggccctttctgggtccggctgacctggtacactcagagaccctgaggccaactgggggatccccttctgggactgtcacccactgctgtgcctgtgctgggctggccctggacagcagctatgctcacgtggacagtaaagatggtgtcggaaaccagggaagctcaagggtcataacacaggctggtccacaccaggacctccagcaaacccttctcacacagagggccggggaggtcccgggcacctcagcccagggcaactggcttctgaggtagcagccccgccagcatccaggacagactaaggggaccgtgaccaagggctctccaagcctagtcacccaggacagtcagagacggaaccctcgcccctcttgagagagctcatgggctttgggggccccaataccaaaaggtgctggaggaaggcagtggtggcagggacccaagttagggctgcgcaccacggcgcatgctactcagaggttgcactaccttcagctgtccctcaaaccaacggttcctggtggcgtcgtagaagtacagatcgttgaagaactcgcccgacaggctctcctcctcttcctcgtcacagacacccccgaagaacagtgtctggtgattcggggccatggccacggaaaagccagaccgtggggtgggcttgacccccgaagggttcatccgagtccaaacccacttgtctgtcaaaagagaacaaggaagtgggataagaacacaaggaaggaccctgagagccagcccaggacacgctcaggaccccaggtgccccccagaatggggtaaatgaaaaccgtgagactgtgggcaaaaactctgctccctctgcagaaaaacagacaccattcaactcccctcgagttccacccttttccttaagagagctggcattcaacagctttccacacacccccaagcacctctaaactaggggcagctacaagccgcagtggaaaggcagggattgggcagaagcagcacacacgctagacacacagaggggcttctgtggggaggctgccctgcacagggaccctccgcccggcacggggacccttcgcccagggggctgagtggcctgcaccagccccccttgggcctgcacggggaccctccaccctgcacggggaaccttcacccagggggctgaatgcctgtgccagccccccttgggcctgcacggggaccctccgccctgcaaggggacccttcgcccagggggctgaatgcctgtgccagccgcccttgggcctgcacggggaccctccgccctgcacagggacccttcgcccgggggctgcagtgtggccagcgaggagccttcgcctggggtctgagtgcctgcaccagccccaccttgggctgcagtgtggccagctctacttcaggaagggtctatgttctctcttggcacgcgcctatgtgatgtgccaaccctcaaacagagcccaatgtgcagatgtctccccaccacttctaggagacagaatggagatttttttcctccaatgaacatttaaaaaaaaaaacagaagcagcaaatggacgtattctgtgtggtgctagacgtcacccgcccatgcccagtgtgggcgtggctctggggcccccgcctcattcccaccagcacatgactgtgtgaaggaacagggaagaccaccacaagaactcgccacacagggcaggaccctctccggtgacagaaacccacacacacaaggtgtgtcgctcctcaccacgatgctttcctcctgggggctgacgagcagagcacacaggctcagggccgccctgcgggaaacagtccagcatccaggttcaagttcactggggtgtaggctggaaagtgactgaaagaaggcgtctgtcctatcagccagggtgcagtaaggcagggccctgggagaggcacctgggccttttgacaggcaaatgggtgtggactcagattaacccttcgggtatttctgaggcctcagcatgaggaattttagtgcaagaaggaggtaaaaacactttgcacaatggtcccctctcctggggaggctggagaacttgctgtgggtcacaaaagcagacctggcctaggcattgggtctcctgggtctagcccagccctctggtcccaagccacagcctcccataagagagctgtcccctggtttcctaacggcactggggacgctaaactccacggcaaacacccttgatctgtgcctcctggcatcactctcttgctctggagcagaacaaatgccattgtctccttctatttattttttattttttgagacagagtctcactctgttgcctaggctggagtgcagtggcacgatctcagctgacggcagcctccacctcctgggctagaacaatcctcccacctcagcgtccccagtagctagaactacagacgtgcgccagcacacctggctacatattttttttgtttttttgagacagagtctcgctctgtcgcccaggctggagtgcggtggtgcaatctcggctcactgcaagctccacctccgaggttcacgccattctcctgcctcagcctcccgagtagctggaactacaggcacacacgccagcacacctggctacgttttttttttaagagatggtgtgtcactatgttgcccaggctggtttcaaactcttggcctcaagcaatcctcccacctcagcctcccaaagtgctgggattataggtatgagccactgcgcccagccagtaacaaatgcaatttttttcaaaatcaagaaattaatgattgaaaagtagcaggccacccccatccccccgcccatgctccacacaggcacggcttcttccgcttcagaggtctgtgagaactgacgggcagccactggcaggaaacgccgccaacagttcatctcagcacatgacccacgcccaggaacatgaaacgtgccatgtgtagaaggtggtgagagtggctgacacatcctgggccctctgggtgccagagccatgtaaagggctgtcccctaggtcatcccatgtcatccttttaaaaagtcccagagaatgatgattgttcccctgtgctttagtaagaaaattttgattcttagatcccagtttagctaaaagcttttagaaatctaggcattctaacagccccgagttcagtaactcaagctgacagaggccacggccgttcttggaggccgtccctgtgagggccaatagcagtctcggtgatgacttctgaagttctgtgcatgagcaacaccgacccctggctgggaagcccacacccagcctgcccagctgctgcccgcaaccaccccaagagcgaggcccgtcaccacagtgccaggcagccccagtgactcctggtggcttgtactcaaggcccaggatggttctcccttcgagagctcaagacccttggaggggcccatcaggagctgctgaggggcactgtgctcactgctccacagagggctgtctgcagggtaacagcgcccgtgcttctcagtcagtccatcatcaatgcccccaaaggtgattgcccagcagacaccagggctatggagcctgtcccacccggcccaccccgaaatgagccatctcggcaggccctccgctccgggcagggtgcaggggctcaccgccagccccacatccatgggagggtgtgggctctgcctcccgccacacacagaccagccagctcccgccctggaggcacagcacctctaccttctcttccgtcctctggcttcagcaggaacatgtctgagtgccgtgtgcccttgtccacgtctttcttaactctctgcaatggaaaggaattgtgtgagaaccgggggcagctacagtggttgcttacagaccccccaaccctgtgggcgcattttggatggaaggggctggaggccttccctgtagaccagccccaaagctccaaagcgtgcctgcagtgtgctcagggctggcaccacctgacaggctttatcccccaaatgggtccatctgaagaggccacctttctaatggccgcgatcacacagtacactagagttcctgtcggggcacgcacagcttccacagcagccctggtctgtgtggaaaccaccacaggggcctctgataccattacagagtcactctttgttcctgatcccggtggatccccaccgccttccaaataacacgactcaggcttcacagcagaaatcaagttactactgtgtgcagagggcaggcactgcccactgaaagacttctccaagcttcgaaaacaacgcgctccatgtcccttagcccttagtcttctgcctcaagtgagcctcagctggaccaggtgcactgttccccagcacccatgccctacaagtcctggtgccacacccattacctgggacctaaggttgtgagggagatagccagcaaaacgctcaccctgggtggagggcccccatccatttccatctcatctttgtatttgtttgcactttaattctctatttttaatacactattttagaagttttgtatttgcagaaaattgagacgatagtaccgagagctctcacacgcccacaccaatgtcctcccagcatgaataccttcctctccttggcgcccttgtgacggatcaggaaccggcactgacccgttaccgggagcgtggcccacacttcattcactgccccagtgctccgcagctcatcctgcccagggatcccgtcgagggtcccactggccgtttcgtcctgtcgcctcctcaggttcctctgggccctgagcttctccgactctccttgtctctgaggaccatgatagctgtgtggatggctcaggagttttatagagtgcccctctactgggactgtctgctgtctttctcattagactggggttatgaatcattaggacgatccccggggtgaagtgcccatctcatcacatcccatcaagggtccacaccatcaacaggactcatcacagtggatgctgacatcgaccgcctggctgaggtcgtgtctgacagtttctcttcagctctatgttctcacagatattgacacagacttcggccacgctactgtggtcgcaggggtagtgacacagacttcaggcatgctctgtgcctcatggatactgacacagacttcaggcacgctcagtgcctcgtggatattgacacaggctttgggcacgctctgtgtctcatggatattgacagactttgggcacattctaaggtcttgtggatatttatgcagactttgggtaggctctatgtctcgtagatattgacacagacttcaggtacgctctatgtctcgtggatactgacgtagactttgggtacacactatggtcttgtggatatttatgtagactttgggtacgcgctatgtctcgtggatattgacgtagactttgggtacacgctatggtcttgtggatattgacgtagactttgggtacgcgctatgtctcgtggatactgacatagactttgggtacacgctatggtcttgtagatattgacgtagactttgggtacacgctatggtcttgtggatattgacgtagactctgggtacgcgctatgtctcgtggatactgacgcagagttcggctatgctctatcactacccatctttgttgctcgggttgttcaacgacacacagctgccactaggagcctttacagctactcttgggtccctgtgacttgcaccatctttgtgggttcctttgagcacctccttaggctctggcaccacaagatgctcaattcctcctatatactccctgctcggccctacgattcgccatttctcaagggagccctggttccctttgttggagaatagtgttagaaaccaagaaaccaggggccgggcacggtggcttacacctgtaatcccagcacttcaggaggccgaggggggtagaccatgaggtcaggagatcaagactaatcctggctaacacgatgaaaccccatctctacgaaaaatacaaaaaaattagccaggcacagtggcaggcgcctgtagtcccagctactggggaggctgaggcaggagaatggcatgaacccaggaggcggagcttgcagtgagccgagatctcgccactgcactccagcctgggcgacagagcgagactccgtctcaaaaaaaagaaaagaaaagaaactaagataccaagatttgctgtaatcccagcactttgagagtccaaggtgggcagactgcttgagttcaggagttcaagaccagcctgggcaatggcaaaaacccatctctcccaaaaaatatgaaaatcagccaggcatggtggcatgcatctgtagtctcagctactcccaacgctgaggtgggaggactacttgagcctgaaaggcagaggctgcagtgagccaagatcatgccactgcactccagcctggacgacagagtgagacttctcaaaaattaaaaaaattaaagagaccaagatttgggcaatggatgtgtaaactgctaccgggtagtattgtttctaggccgtcccatctggtagagcaaggaaatatttgtttatggttatttttcttatagctaacatgtactgtatttactataatggaaaaaaaacattttccttttgaaacatgcaaatgatccactgtccacagagacttcatatttccacctgggcctgagtgtcctaaaactaagagggctccacattggccatatggagagtgacctgaatctcaggaagtgaaaactgagtctgggtctcttttgttctccttctggaaacatctgtgcaattccagtgatgcagtttctgcacattacagacagtgattgagactagtctctttttgtaacaggttgatagaaaatggctgtcatttccatgcctgcttttccaaacctaagggcctagcattattgtgaactgaattgacacccagagacttcatctgctggggggacaaggaaggaattcagtgacgtctctatttgtcatcagaaactcaaatcgctgcttagcttcggcaggtctctgtctccttgtagtaccctgcacctgtctatatgaaccgtcttgttttgctgacagcaacattgtcttcttagaattaacagcctatgggggaatgttttatgctacaatatttaagtacttcccctccagaccatgcaagccagagaggtggagcacttcacaaggcctgatctgctcacacgggtccacaggttccttccggcacacagctggctggccacaccctctaacagggcccatggttcgacctccccaacagcttctaactcctccttctacagcagtttcttttcttgaagtgttgtgacttttcccaaaatccaacctgtctgtcttcaaagaaagtaacagacaacggccttgttgccctctgtttttctggatcacctgtgctcaagctctattagcatacaccaaaccagctttacattcacgcagtctttccacaaaaaccgattcgctctcgctctccctctccctctccctccccctctccctccccctccctctccctccccctctcctccccctccccctccctctccctccacagtctccctctccctctccctctctctccacggtctccctctgatgccgagcggaggctggactgtactgccgccatctcggctcactgcaacctccctgcctgattctcctgcctcagcctgctgagtgcctgggattgcaggcacgcgccgccacgcctgactggtttttgctggagtgcagtggcgtgatctcggctcgctacaacccccacctcccagccacctgccttggcctcccaaagtgctgagattgcagcctctgcccggccgccacctcgtctgggaagtgaggagcgtctctgcctggccgcccatcgtctgggatgtgaggagcccctctgcccggctgcccagcctgggaagtgaggagcgcctcttcccggccgccatcctgtctgggaagtgacgagcgtctctgaccggccgcccatcgtctgagatgtggggagtgcctctgccccgccgccccgtctgggatgtgaggagtgcctctgtccggccgcgaccccgtctgggaactgaggagtgtctctgcccagccgccaccctgtctgggaggtgaggagcgtctctgcccggccgcccggtctgagaagtgaggagcccctccgcccggcagccgccccctccgggaagtgaggagcgtctccgcccagcagccaccccatccgggaggtggggggcagcccccgcccggccagccgccccgtctgggagggaggtggtggatgcctctgcccggctgccccgtctgggaagtgaggatcttcccggccgccaccccgtctgggaggagtacccaacagctcattgagaatgggccatgatgatgatggtggttttgtcaaatagaaaagggggaaatgtggggaaaagaaagagagatcagattgttactgtgtctgtgtgcaaagaggtagacatgggagactccattttgttctgtactaagaaaaattcttctgccttgggatgctgttaatctataaccttacccccaaccctgtgctctctgaaacatgtgctgtgtccactcagggttaaatggattaagggcggtgcaagatgtactttgttaaacagatgcttgaaggcagcatactcgttaagagtcatcaccactccctaatctcaactacccagggacacaaacacacggaaggccgcagggtcctctgcctaggaaaaccagagacctttgttcacatgtttatctgctgaccttccctccactgttgtcctatgacccagccaaatccccctctccgagaaacacccaagaatgatcaataaatactaaaaaaaaaaaacaaaaaactgattcggctacggtaaagtagtaaacagaatctgcatgaatttttggagaagttagacttcattctaatacattattgctggaatgcaaagacatctgagagagagatcaagtgtcaacatggagggtgagcgcaacagggctggctctggaattacttagcatccggctgagaccccagagcccagcagagctgtgcctgaacgtttggaggcgcatcggccgcacacgccaagtcccaacgggcccccacctcccgcacaatgtagtacaggccacctagcttagcctgcagccacatcccctgatgagaccccacctcccgcagaagtacaggccacttagcttagcctgcagtgagtcctcaatgcagctgctttggctcacccggctgtcggctcagacgccgacccatttcaatcatcaggagaggagaagacacacagggccgccccaaggaccccgtcaccagctcaggccaggtcacagaatgggccggcggtgcagtggtaggtagataaaggccggggagcgtttgtgggagaagacggccagacgactggtcctgggagaagacagtgctaacggcagcactgatgttcaccgaaatcacaatcaggcagggatagggtgtcggttccaagcggacgtgtgtgaacacagaaaccatgggggccgctccttcccacaccactgagactgtccatccaggcgcccgaagacgactcctaaaccacctttgccagacgcaggtccagcaacccatcaagagcacagctcgggcaagcagcgaccgcacgcaccgtgccctcctcaccacacaaccacaggtgatgagcccctgcggagacgccgcgcccctggggagacgccgcaccacatcagtgcacaggaggcatctcacgttttgcggggcttgggagagagggacccatgacgagaggacccccgcccaaccacgtgtcgcgagagcagcatgaagccgcgcgccccctccaggcagagctgctgctaaaatgacaccctgtcggttacggttagcatcacttccatcagcaccacttctagtcagcttccttttgaaaactgcttcagggaagctgctccagaagcccatgcatgtgccctgccacagccgcagcctctttggggacactgctgtcgcgatggtttctgcagagccagcccggggtccccaccgtgcctgcctctccagtcactcagtcctttctcctggaaccgggtcaagtccctctgcgtgtctgaaccgggacaaggccctgcctgcttccatacctgaagctgggccccagggcaccttcccatccacatccgagaccaccttcttaacggccaacggccactcaaccccccacagccaagacttctacctgtcgctttccaagactgaacattttcagcttcgccattaaaaaatacacccagaaggccgggcatagtggctcatgcctgtaatcccagcactttgggaggccgagacgggcggatcacaaggtcaggagatcgagaccatcctggctaacgcagtaaaaccccgtctctactaaaaatataaaaaattagccgggtgtggtggcaggcgcctgtagtcccacctactccggaggcaggagaatggcgtgaacccggtgggtggagcttgcagtgcgccgagattgccccactgcactccagcctgggggatagagcgagactctgtctctaaaaaaaaaaaaaaaaaaaaaaaaatacacccagaaacaggtgtggccacaggtctgcgtgtgctggaacatgagtagaagccactgtcgcgcccaattccccagcacgagacaagctgagacaacctgcagccggtgacctgggagagctgggcacggacctcaggggccaggtgagcacggagctctggctccgaggtcagccgggatctcccaagtcacacagtccacactcgcaacaactctgtctgcttctggtattccaggagctcagctcccaagtggcaaatgaaaggacgctctggcctctgccagcatgctccacggcctcgcggtaacagtggggcgtgcagagaacagccctctcctggttatgcatggacgttatctcctgacctccaggcgcacaatgacaactgaggtcaaaacgcaggcaggaaggagggccccgtcctcagcaggactccgcccctcgctgcccatgtgtccatggaaacagaccactaggtgataaaccttccaccgtcgcgcccccaccctccccatccaaacaccatttccaaagagctgtgctggttccctgactctctaaaggaacgagaactccccctctccagaagctcccacgacaccggaagcacatactaaggactgagtctttgacacgtgaatgttgctgggtctaaggactgagtctttgacacgtgaatgctgctgggtctgctgtcccacacgctgcatctctttcgttaggatacaagtcatcatagtcaaagcactagctggacccagactgactcggaatttataaaacgtggttacgatactgaccaaagctgccggttcttcgtggcagcgcagagcctggagggtgtttaaagtcctcccaaggctactcagatgcatctcctgagggagcctgggacgggatctggttacaggaggaggaaggagggcaggtgtctgtgagttcctcttaatctacaggcaggtccagccccaaggtcaaggctctgagcactactgtccacttcatgaacccgagctcttcacatgtcaaactctggagccttgccatgcagaaccacggtcagaatgccttcatctgatcaaacactgtcaagcacgccactgtccaggcaccaggcacgcaagtggacagaagactggccctgtgagactctcttctccgggctgagagacaatggccaagtctgtaaccagcagggaggatggtgagcagaaggacaaggacacgcagggggatggaaactggggccgccctgctgagacgaggaccatgggggttctgcatagaggagacctggcctggcttgcatctctgcaggtcactccagctgctgcactgtggtgtgatcctgagggccccggggaggcgccaggtctggcaggagagtgcagtgcatggcagtgggcaggggtcaggcactctccaagccacctctacttgctcagtgaaatgtgaggtgagggtgggtggcgggtggcaggacctcctgggagcatggacggggcctgcgtgggagagaggcgtgtgcccacagtgtgtggggtcttctctggcctgggccgcgcagcagcacagcacagctgggtcatgccaagaggacagagcatggcgggtgagggtgtaatggcgccagagcaaggacgagcttcccccagccccaagctcaggtacgggccatgtaccaaagtttctatcagttcgtgcacactgccgcttcagccatggcgcagctgaccacctgcttaggctactgacttttttttacactccaaaccattcacaactcaaatctctcgctaattctgataaatctctcatgaatccaaacagacaagcttttcactgcaattccaaatgccacaggctcagagccaagagctactgaactaagtggattgagatcacccaccgtcagactgagggcgggtgcacgtggctgcagacagcagctgctgagaatgacacgcgactctgatgaaagcgatacagcttagccggtctggctgttcaccgtcctgctgcactctacgacacatctgctgggagaaagcactagaccggggcatcctgcctggctttcagccaagtcagcctgttctcagtgccctcccacatgccagaatatctagacaagcctgaccgatgccagccactactccagaaaatagggtgattttctctgtgcagaacaaaagatgaccaagaaaaaaatcgggtcattccgatcaactcggtacaatctctgaccaactgccattaaaaggctgaaatcctttattgccaaggcagcagaatgaacgtggatcagaatggagaaacagacctatgttcctgcaggcatgtgattttcaacaaaggttcctaaggtattcaatggagaataaaaagccttttcttttttcttttttttgagatgagtcttgctctattgcccaggctggaatgtagcagcacaatcttggctcactgcaacctccgcctcccgggttcaagtgattctcctatctcagcctcccgagtagctgggattacaggcacgccccaccacgcctggctaatttttgtatttttcagtagacatggggtttcaccatgttggccaggctgatctcgaactcctgacctcgagtgatccgcccgactcagcctcccaaagtgctgggattacaggcgtgagccactgtgctcggcctaaaaagcctttccaacagatgctgctgagacaagtgagtatctacatgggggaaacagcctcaacactcacctaatgctgctcttgagaattagtcccgggcagatcacagggctaactgtgaaaccatatcatttttagagaaaaataaaagaaaatctttgttactgaagctaaacaaggtcttcctgtatcacagaccgcaataatcacaaaagaaaaacgtaataaattagattttatcaaaaactcaaagcttctcatcaacaaacacttcggaaggtgaccagccaagccactactgggagggtatttgtaatccacacacctgaaaagaactggtgtccagaatgtcaccttctgcaactcactaacaaaaactacagcccattaaaaatagcagaagacatgaacacacacttcaggaaagacaagctcatgaaaagcactcaacaccagcagtcatgagagaaatgagaattaaaaccacgaggtaccacacatccaccagagcagctaaaaacagaaagactgacgccattggggctggtatgaacagggggcaactggaactccccaacatttccagcacaagtggaaccggccactgcttcgggaagagagctgaccattccttattaaataacacccacacccacacccaccccagggcccagcagctccactccagatatctatttacccaagagaaaccaacacacgcagccactcaaaagattattatggacgtgctcatagcagcttcagtcacagctgcttccaaaggctgtgtcttctgaagaacggaaacagcccaggtgtccaacgaaaaacagaaccacaaactgtgggacagtcatataatggaacacttcagcacgaagcagcaatgaacagaaacatgcaacacgtgggtctgaaaagctgagggaaagaagactggccccacacatctgggtgacttgtttagcagaagctccaggacaggcagatctattacggtgggaaaatcagagcagcgtcacctctgggcggaggggagggtgggcagcggggccgagtgggaagggcacggcaggatcagggtgtgagtcacacggtgcccgcacttgtaaaaatgtgtcccctcactgtgggtcaatgacgcataggaaattaccaccgactacaggcgcccgccaccacgcccggctaattttttgtatttttagtagagacggggtttcacagtgttagccaggatggtctcgatctcttgacctcgtgagccgcccgcctcggcctcccaaagtgctgggattacaggcgtgagccaccgcgcccagcctaagcatagcaaaatcttaatagcaggatctaggaggagtatacaggtgttccccgtaaaattctttcaaaagttagctgtggttgaaaattttcaaaatacaaaggattttttaaacccctacagtgagatactacttcatacctctcagattcacagaaatgtaaaggttggcagagtgtgaaatgggagtgaagcaacaggaacacttgagttccgaggacagagcctgtgccagccgcctctgtgaagcacacgccccacgagcagcaggcacatgtgaggagcacacactccacgagcagatgccagtacacgtgcagagcacacgccccaagagcaggaggctccggggtgggcgcgagaacattcctgtcagcactgttctcaggttaccaaagaaacaagcccgttaacaggagcgaggagaatttcattccacagagactactacacagtagtgagcgtccatggtgcaggaaggagaccctcagaacacagaatcgctcacactgcactgctgacaggggtgtggagaacagaacagggccctaacacggcaccaagttcacagaggagccgattaacactatctctatttctaattctatacaaagaactgtttatattcaaccaatgagtaatcccatgtgaaagcttcaatgttcatgaaactgaagagaccacagacagcagcgcctattttcccacgccgcaactcacccgtctccccaccccgcgcctcgcccgtctccccacgccgcgcctcgcccgtctccccacgccgcgcctcggcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccaccccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccacgccgcgcctcgcccgtctccccaccccgcgcctcgcccgtctccccaccccgcgcctcgcctgtttcccggtccaacgccttgcctgtttccccaccccccgccttacctgtttcgagtagcccccatagacgacgatgccgccctggggagtgacggacatctggcagcctgatctgggtgtgggccccgtccctgacggggacagcttgctccatgtgaaggtgtccagattaaaggcatacacgtcgttgtagtagatgtaatccctggttagaagaacagcagctgtcagggtccgtaacattgggaaaagccctgacattaaaaactgaactgatttaaattaaaggtaaatttcctactgtttggggaaaaactcaaaccatttttctcctctgctcttacaccaacacaacaatcaacacagaaacgtggccgctttccctgcaacgagccagagacgccagtcaggtctcctcaaactcaatcttgacgcaatctacctggagacagggcaacattttcacctgtttaattcaagtttgaattgatatgaaaggaccacaagcacgtatgagtttgcatttgaaaaccggaaataatgctggcccacagaggcagaggaatttaatctgaaagccatactgcgttttcttacacagttaacacaatcagagacaattccattaggttattaggtgtgcaaccgtaagggcagcagtgaatggcgcctccaaagggatgatcagaacggaggtgtgagcagcctggcagcaagggtggtaaggccccacagtggactggaggggtgagcgaggggactgggcgctccagggaaactgaagaccacagaagccgaccctctgtgcccgaaatcacagcgcggcaaggaggccccgcagccttgccctgctcagtgcctgccggacccagcacgcagactgggctgaacagggaagtggcagctttgctggaggcatggggagactcggaggcgcacccagaaagtcctgtcctaatgtggaactttgacacaattatcgtgaaagcgtaaggggctgctctccagctactcaaaaaggagagccaaactcattttttaaggaaagcatggaagagcaagcagctctagcccaagtctcaagtgcccggttttctcctgtttgttcctgttttgtgtgaagcaggaaaagtcacagggcgtttacccagcaccagctgccacatctggtcttaagataaacagcctgggcacagtggctcacacctgcaatcccagcactttgggagtctcaggcaggtagatcacttgaggcgaggagttcaaaaacagcctggacaatatggtgaaaccttgtctctactaaaaacacaaaaaattagccaagcatgggggcgggtgcctataatcccagctactcaggaggctgaggcacgagaatagtttgaacctacgaggtggaggctacagtgagctgatcacgccactgcactccagcctgggcgatcgagtgagaatctgtctcaaaaaaagaagaaagaaaagataacctgaccttgctgactgcaactcagactgaccacatccttcgcaggacgatggctcttaatatagatagaatctgaggaatgtggaaatgtggaagcgtgtaatctttaaaagactgctacagaccactgtttttttcagatttcacgtcgcagatttttagtacaaagattctactttgcacgtaagataaatacagaatattttctctataaatgcagaatagagtttaaggaaaactcccaagttggtatttgaataattttaaacaagataacaacagctttgaaaaaagttctgattttaaaatggttgcaagttaaaacaaacatgaagcatgatttgatttataacctgtaagttcaaaggaggaaggggctgtacaatctcactgtcctacacatagtaggtaatgaattaatgctctgacaaacttatgtgtgcattctgacaattatttgttttaaaataaattttaagaatgaacataaggctaggcgcgggggctcaagcctataatcacagcactttgggaggccgaggcatgtggatcatgaggtcaggagttcgagaccagcctggcgaacatagtgaaaccccgtctctactaaaaatacaaaaattagctgggcatgcggctcacttcaacatccgcctccccagttcaagcgattctcttgtatcagcctcccgagtgcctgggattaaaggtgtgcaccaccacacctggctaattttttgtattttttagtagagatgagtttttgccatgttggccaggctggtctcaaacttctggcctcaagtgatccacccacctcagcctcccaaagtgctgagattacacatgtgagccactgtacccagccttaaatactttttagtttgaattacatttttaaatctttcccccttgaaaagtatttaagaatttggatcccttttccccccgaattcacaaaattaatgagactatatcagtgaagaaaatctgaaacccggctgggcgcggtggcttacgcctgtaatcccagcactctgggaggctgtacagacttatcacgatggatcaagaatcacgagagggtgcgactggactcaccatgtgacaaaggtgtgagtggcaccttcacatcaatcaattgccatgctggttcctgagggaccagtagagaaagagggcttcaaatgaggccccggagatacagacagccactgtctctgacaccacgatgccagcagagagccttcaaagatgaccttcaccagggttgcagagtctgcgacacttcactcagaacacaactgcacttatgacagaaacagggataaccagctcccctgtgtcttgcttttctggactgaactaagtaagctcaagaagataacgtgagcagataacaggcctaaaacaatgagagagcccgcagctcaccctgggcagccatgccagctgcacgaacacccacgtgacatcaaaagagaaccgcaggcctcttccggcatcgctgtggagagtgtgctatcactgctctcccggacaggagtgttttgaagtgattacagacccgtggctctcaaagtgaagtcccctggccagcaacgtcaacatcacctgggagcttgttaaaatgcagattcctgggcctcactccaggcctctgactcagagctgcgatcagcactctaaccagccctctagggtattctgaaccaggctaaggtttgagaatcccattttatttttttatttatttattttttcaaacgaagtctcgctttgtcacccaggctggagttcagtggcatgatctcaactcactgcaacctccatctcctgggttcaagcgattctcctgcctcagcctcctgagtagctgagattacaggcacctgccaccacgcctggccaatttttgtatttttagtagagacagcgtttcactatgttggccacgctggtttcgaactcttgagctcaagtgatccacccgcctcagcctcccaaagtgctgggattataggcgtgaggcaccatgcccagccaaaaccccattttagatagaactagccacatcatttgcaggacctggtgtaaaattaaaatgtggggtcccttgttcaacaatggttaagaatttcaataggaatacagcatgaagccagtgtgaggcccggtgtgaggccctttggagggcaaggccctgtgtggctgcccaaagctcatgaagctggatttgggaggatgggtgcgtctttcttgtgtattcagaatgctctttctataaaaagcccactccttaatgcttcaggagagaaagatttttccgttcttggtaccaaccgtgtactttcatggaagccaccaaacaggatcaattgtctcttccaggccaccatccgatgtccactccgacccgaaggaccgcctgttgatctaaaatgaaataaacaaaaagacactatcaacctgcttaatttctggttgttctaaagacgacaacaacaaacaaaatccaatttttacactgatttctgttttgtgagcacttactgctcacaaattaaataccatttaatctgatctatcaactaccaaaaccatcctgctaagagcccagctagctaagctcaaacctcaagaataaaacaggagaacatctccaagaccttggactgcataaagatttcctaggtagaacattataaactggactccgccaacataaaaaacttcaaaaatacaccattagaaaataaaaagacaagcaacagacagagaaatatcttgaaacacatgactgacaaatgacttgtatccagaatacatacagaattctttttttttttttttttttttttttttttttttttgagatggactctccctctgtctcccatgctggagttcagtggccagatctcggctcactgcaaccttcgcctccaaagttcaagcggttctcctgcctcagcctcctgagtagctggaattacaagcgtgcaccaccacacctggctgattttttgtatttctagtacagatggggtttcaccatgttggccaggctggtctcgaactcctgacctcaaacctcaagtgatctgcctgactcagactcccaaagtgctgagattacaggcatgagccactgtgcccggcccagaattctatcttaatagtaagataaatgacccaataaaaatataggcaaaagatttgatcagaaagttcgtaagatagaaaaatggggggaaaaaagatggaaaaaggccaatgaaaaaaggaaagatgcccaacatcacgagcggtcagggaaacatatgccaagtccacagtgacttcctaccacacatggctgggcacccgagatcaagacaacatcaagtgctggcgaggacatggggctgctggagccatggcaccggtgaaaacgtaacacagtgaaacaacggtgaaacataaacttagcgcacagcttagcaatctgacataagacatggactcaagagaaaggaaaacaccagtccacacagacggacatgcacaagtttatacacgctcttgtgtcaccaccagcagccgagctgtccctcagtgggtgaatgaacagcatgtggtgctccccacatgggggaggacttctcagaaacaaaaaggaattgtttactgatgcacacagcaatgtgaatgaatcttaaaaacatctcgctgaaggaaggcaggttctgctggactccatgcacacgagcgtcttaaaggtgagatccgtcttcggcccaggatagctgctcggggcaggagctgggaggggaccaactacagctctctggggtgacaagggcctacatcttgtctgtggtgctaattacataagtgtgcatatttcttttttttttttttttttgagacagcgtttcattcttgcccaggccggagtgcagtggtgcaatctcggctccctgcaacctccgcctccagggttcaagtgaatctcctgtctcagcctcccaagtacctgggattacaggtgcctgccaccacgaccagctaatttttgtatttttagtagagatggggtttcatcatattggtcaggctggtctcgaactcctgacctcaggtgatttgcctgcctcggcctcccaaagtgctgggattacaggcatgagccaccgcctctggtcaggtgtgtatatttcttaacactcatctaagtgtacatctaaaaggcatgcattttattgaattttattgtaattatgtctcaataaaactgatataaaaatacatggcaataaaaaaatacaaaaagcaaatttaaaaccttaaaaatacacacaaataatacaatcacacacaaataacacataaataactacaatcaacctccctagtaatcaaagaatttcaaataaagcagagataccattttattctatcaacttgacaaagatgtttaagaattagattctttaaaatactgcatgtcacgggacaatgctcgaaaaacagcacgtgaaaaggcaggtccaaagcaaatcctatcccagcttctacaggtaaaaaggcaggtgcaaagcaaatcctatcccagcttctacaggtgaaaaggcaggtgcaaagcaaatcctatcccagcttctacaggtgaaaaggcaggtgcaaagcaaatcctatcccagcttctataggtgaaaaggcaggtgcaaagcaaatcctatcccagcttctataggtgaaaaggcaggtgcaaagcaaatcctatcccagcttctataggtgaaaaggcaggtgcaaagcaaatcctatcccagcttctatcggtgaaaaggcaggtgcaaagcaaatcctatcccagcttttatcggtgaaaaggcaggtgcaaagcaaatcctatcccagcttctatcggtgaaaaggcaggtgcaaagcaaatcctatcccagcttctacaggtgaaaaggcaggtgcaaagcaaatcctaacccagcttctacatgggtggttctcagtggttttcttgtcttaatcgtttcctgcatctcccagcagtcctccagtgagcaggcgtgactttcacaaccagagagaggagcaacaaaacagacaggggtggtgaggaggcgctcgggcagcaggtgctcagaaagctcgcagaggtgcttacgccggccacagatgtgcagggcgcccaggcacagaggaggcggggcacacaggaatggctttgggctgcaacatcaggctgaacagggtgcgtgtgctgggactacccagggaatctcctagagccgcaggcaccagggcagggccttaaggagggttgctgggcacagtcactgcagccactccctgggatcctcactgatgacctgcctcgcctcctacttaggaatccactccctgggatcctcactgatgacctgcctcgcctcctacttaggaatccactccctgggatcctcactgatgacctgcctcgcctcctacttaggaatccactccctgggatcctcactgatgacctgcctctcctcctacttaggaatccactccctgggatcctcactgatgacctgcctcgcctcctacttaggaatccactccctgggatcctccgtggctttcacacccactctctgcctggccctcccacctctccacacaggtcacagcaactctgggctgcaaaggatggttacagcttcaatcacgcaagtcagtgcctatttagataatgcattcttcctccatttattttttgtgcatgttacacagctgtccccaaaacccacttacagggttttatgtaaaagcccagaaatgggcaggtaccctaaaaaacacaagagggccgggcgcggtggctcacgcctgtcatccccagcactttgagaggccaaggtgggcggatcacgaggtcaggagctcaagaccagcctcaccaacatggtgaaaccctgtctatactaaaaatacagtaattagcttggcgtcgtggaggcacctgtaatgccagctactcaggaggctgaggcaggagaattgcttgaacccaggaggtgggagctgcagtgagccgacactgcgccactgcactccagtctgggcgatagagcaagactccgtctcaagaaaaaaaaaacacaagacatcaagacatggaatctcaaacgtaaaaggaagcttgagtgatctaatccaagtttactgaagttcagagataattcaccacatcatcagggtgactgccaggagtcttcgcttgctccaagctggagcgaattcggttctcactgctcaaacgcgggatcccaccagcttctctcctctagcaccctccatcatatcagcacccctttcaatgtatcactgaaaatgacaaccacacccctccatggaatgtcaaccagaagcaatcagttcctttttctagacaccaattctattaatccaacccggagttggcatgagcctttggggtggcctcttcacatagggatacccagcaggatctcagctcactaagtttctttggagtcctgcaagctggcctcacttcacagttccacagactccacagcagctccatcccctccgggcttggcaccgcaggggacagcaccatccagcggacacactacacatgagagtcaattgagaagaaaaccccacacatgcggagcaagaaaagaacgcccctccccctcctggcaaatttcccgatgccccctcccactcctgacgaattgcctgacgcccctccccctcctgacgaattgcctgacgcccctccccctcctgacgaattgcccgacgccccctcccccccagacgaatttcctgatggattactttataagaacaatctgaggatcagaccttcattcaaaactaaaccagtgctgaaaccccgtctctactaaaaatacaaaaaaattagccaggcatggtggcgggcgcctgtagtcccagctactcaggaggctgaggcaggagaatggcgtgaacccgggaggcggagcttgcagtgagcagagatcgcaccactgcactccagcctgggcaacacagcgagactccgtctcaaaaaaaaaaaaaagaaaaaaaaaaaactaaaccagtgtgtctgcatccaagtccgcttcaaaaaatgacagaggagaaccgagcgctgccactgccgtccccaaccagcgagggaacacaggcctggggcctgctgcagccccatagatggggcgccccccgctgccctaactgcgctggggcggggcctcctttcactgcctgcatgggaaccccaccagagtctcatcctctggctgacacaacggactcaattaactttttgtggcagtagccaaatatcaccgttttctacctaaaaggggaaaattttctataaaaagattccacgtccctctttagaaaaataaagctactttaaaaagcccatttatatttgaaaccccaacaggcttctcaaaactgctgtcattcctaaatacgaagtcttaaaaaatccacatgtcctcctcagccagaggcctatggacagcacaaaatacaggggaatgtcgtggtggcggctgcctcgaggctcagcagctgcgtgcaggatggagctccaagcagggcaagctgccaggcagtgtcaccaccaggcccctcgactgggccgctgtggtgacatttacagaaaactctacatgcttagggtacagtcagaattaaacactctgcatgcaaacgcttctctgagttaagcactctgcatgcaaacgcttctctgagtgactttacagtctacaccttacaaaattatacaacatacagtcacgcactgcttaatgacagagacgggttctgggaaacaacacatcattaggcgaccttgtcattgtgctgtccgagtgcacgcacacacttctggaaggcacagcctgccacacgcctgcactgacgggagagcccaatgcttataggctacaaacctggacagcacagtactgtcccagacactctaagccactgtaacacaatggcaagtagatgtctcaacacacagaagggaagtaaaaacacagtctgatcatcttagcggaccaccagtatgtatggtccgtcgtgaacagaaacatcgtgaggcagcccgacagcaggaccactgctgcaccggcggcctagagacatctgctgagcaaaggagcaattcctgccggatccctgagagtctagtggctcatcctcagactagagagcccctgtctttcaaaagcagttacagcacagccagggagagccgtgtgcatgcacctcccctaccatttcaaacacatgccttggaaacttcgccctgcttttccgagtatcaagtccatcaaataacaaatgatagtgtaaagacagggcacttaatcacgttatgtggcatgattagtagccgtctccagaattcaggcaacttataaaccacacccttgtctcatcttaatgattactactcagagaaaaaccaccatttgtgtttattctatgccaggcacagtccttttatgtgcatttatcctcacagcaaactcgtggtgcagatattacctttattctcattttacagacaaggaaatcggccgggcgcggtggctcacgcctgtaatcccagtactttgggaggccgaggtgggtggatcacctgaggtcaggagttcgagaccagcctggccaacatggtaaaaccctgcctcttattaaaaatataacattagccaggcatggtggtaggcacctgtaatcccagctacttgggaggctgaggcaggagaattgcttgaactcaggaggcagaggctgcagtgacccgagatggcgcctttgtactccagcctgggcgacaaaaaaaaaaaaaaaaaaaaaaagataagaaaaccaagactaacaagtcaggatacccaggaaagcagtcagtggcacagccagaatttgaaccaaggtgttctggctgtcaacactgattaagacactaaatgacatcacatgaagttagaggcctcagcactgaaataaacctatggctcaaaaaccacttaccctaggccaggggcggtggctcacgcctgtaatcccagcactttgggaggccaaagcagccagatcacttgaagtcaggagttcaagaccagcctggccaacatggtgaaaccccgactctcctaaaaatacaaaaattagccgagcgtggtggtgcgcacctgtaatcccagctacttggaaagctgaggcaagagaatcacttgaactcaggaggcggaggttgccgtgagccgagatcacaccaccgcactccagctcaccttcccggtttctctacaaatcagtctttttttttttttttttgagacagtctcgctctgtcacccaggctggagcacaatggcacgatctcagctcactgctacctccacctcccgggttcaagcaattattccacctaagactcccgagtagctgcaattacaggtgcccaccatcatgcctggctaatatttttctgtatttctgtagagatggcgtttcaccatgttggtcaagatggtcttgaactcctgacctcaggtgatccgcctgcctcggcctcccaaagtgctgggattacaggtgtgaaccactgcgcccagcccagtctctctaagtacatgtgggtcccacctccgtcctatcagagatagaaactatcatccgtcagcaaacagcacaacggggaatccatacacaccccggccttccagcagggcaggttctgccttcatgagctactgctgtttgctgtcgatagaccccaggttactgtggagtcagagagcttcagaccatgcaacccaacccaccacccagagggcagagcagggtgtgtccattcctatggtgacctgtacttcacacctgagactctcagaggccagtcactgttagctaactcgttgcggtccttcactacagaatcgtaaagtaacggaatcatcctgccgaggagccttctccaggaaactgactttcactcagatgcagctttagctgaggaccaaatgaggacccttcctcacatcaggagaaaacagtgcgtatgcctgcgcacacacggacgtgcacacacacacacacacacacatctatatcttcatccaaccaaacagtaccgatcatctcccaagtgctccggtgcatacaaagatgtatgcactgtccgtgaactttcacagcaacactgcaagagcagaaaagtggaaacaacccaagtgcccaacagaaaaccaaaacgtggtccatccacacaccagcacctcatccacacaccagcacctcatccatccacacaccagcacctcatccatccacacagcacctcatccatccacacaccagcatctcatccatccacacaccagcatctcatccatccacacaccagcacctcatccatccacacaccagcacctcatccacccacacaccagcacctcatccatccacacaccagcacctcatccacacaccagcacctcatccatccacacaccagcacctcatccatccacacaccagcacctcatccacccacacaccagcacctcatccatccacacaccagcacctcatccacacaccagcacctcatccatccacacaccagcacctcatccacccacacaccagcacctcatccacccacacaccagcacctcatccatccacacaccagcacctcatccatccacacaccagcacctcatccatccacacaccagcacctcatccatccacacaccagcatctcatccatccacacaccagcacctcatccatccacacaccagcacctcatccatccacacaccagcacctcatccatccacacaccagcacctcatccatccacacaccagcacctcatccatccacacaccagcatctcatccacacaccagcacctcatccatccacacaccagcatctcatccacacaccagcacctcatccatccacacaccagcatctcatccatccacacaccagcacctcatccatccacacaccagcacctcatccatccacacaacagcatctcatccatccacacaccagcatctcatccatccacacaccagcacgtcatccatccacacaccagcacctcatccacacaccagcatctcatccatccacacaccagcacctcatccacacaacagcatctcatccatccacacaccagcacgtcatccatccacacaccagcacctcatccacacaccagcatctcatccatccacacaccagcacctcatccatccacacaccagcacgtcatccatccacacaccagcacgtcatccatccacacaccagcacgtcatccatccacacaccagcacgtcatacatccacacaccagcacctcatctggccacgggagtgaagtgctgatactcgcaacagcaggacacgtcctgacagcaccacgcggaaagaagagcccgtcacagaggccacgtgttttgattccgcttttatgaaatacccagaagaggcagatccacagacacagacagcagggaccggggacggtggggtgtctgctaaaaagacggtttttctttctgggggatgaaaatgcaccaactttagatcatggtgttggctgcgcaattctgtgaacatgctaaagaccaatgaatgacacattttaaagggtgatttgagggtatatgaatcacatctcagagaaagctgttatgaaacacctatcgggcggggtcctaaagtggagtcacagatcatccctcagagggcactggcccagaaaccaatggagggagacgaatctcccccaaccccctgcaccttctccaggggacaggaagagaaggtggcaagtgcctggagaaacgctggctgtgatgtgtggcaggcagacctaaccaaactctgaatcttcaaagccagcaagctcagccggcagggcaggcccaccgtgactgaggagggaaatgagagagctccagtgatcccacccgacatgtgtgcatcccgaggggaccaccggctccgctctgctccctatcccagaggcccagggctgagcagcacaacgggagattgacaagttgtgggggtggggagaggggaaaccctactttgggggttcccaggagcagccgcctcccctcctgctccagagcctaatgctgggaggatccaggccggactgggcaacagggcctctctcccgcccagcccagcggagggtggctcccaccttcctgggagctgcctgcacccccagctgtgacccatctccaccaggacacaccttcgtcaaaggaaaatgctctgcaaacaccagatgctggtgtttttagtgtttcacagtttccagtcactcttgccaataaccgcagacagactttcagtcaccagcatctgtttacatgcgagggaaaaggggagtcttacaaccccctcctcttcccagcccttcccacgccctccataattaacaccactgccctgagcacagctcctgctgttgcatctaactcccttcaaactcacatgagcgcacacacatttaaaacaaacacacagaaacaaaaataagaaacagtacggagatctatgctgcaaagtcgcaatggggcagctttgcaggcaactcccactcaagcaagagactgaagagatctcaaaatagctgctagcgctggccacacgcagccctccaacgaggcacggatgctcccgcacgtgagttttggtcttgaggtcagcattgccattacccccctcatttccaaaccattatgacgtcaagtatatgtgtctgttgctagaatggagaagatgagggactgttacaaagtatccacatgatgtcctgtctgttgctagaatggagaagacaatgagagactgttaaaaagtatccactagtcatccaatgtgctacaaaaacacccgccagccaaccaaccaacacatagcagaaggcagccagccagcgctggcctggacagaggcccaggcgccctgctgcctgccagttggaggtccatggcctgttaggaatcaggtcgcacagcaggaggtgagggggccagcaggcatcaaaggctgagccccacctcctgtcaaagcagcagcagcattagactctcacaggagtgagaaccctgttgtgggctgcacacaccatagatccaggttgcggaatctaggttgtgagctccttaggacaatctaatgcctgatgatctgaggtgcaacagtttcatcctgaaaccgtcatccctccccaccagcggtggaaaaactgtcttccgtgaaaccagtccctggtgccgaaaagggtggggaccattgctatacattaacacaactcaaatcagattatcagcatcccaaaatatgcatcgctgttaaaaatgaccagataacaggagggactctattctgccttcctacaagaaaacccttaaaagccaaggaagagactgactactccagatactgaatccagactccctgcgcctctaccaatatttaattcccgccaacttcacatcctcggctgaaaaaccaactcccccacagaagtaaaaaatattcactaaaaaatgaatgcgcagtgcagggctgcgtcatggtagcaacgcctattccgtttcctgatgagctcttcctggacttctcaaaagacataagcccaccccacagggattcccacgtgctctgcacgaggcctgacacagcaatcttccccagaaagggcaaaaaccgtctttgttgtggctgaatctcctgacctttccttttagatcaatttaaaaaaaaaaatgacagaggaaaaacagccagagtagtcctctctcagcagcggccacatagtgtgtgaacccccaagcccaattacaggcagcagcagcactgcaccaggatgccacacaccgcagcccagcccatgaaatcaacaggccgcctgcacccttcagtcccctgtaccatccccagctacactagcccctgacgatccggccacatagcactcagagcctgacctgccaaaccaccgttaagagaatgctttcattctgcaatcattagtaacttacaaaagcaaaacctacactactttcattattaaggatctaagaggtattttacatgaatattcttacttcttttaagcagcaactaaaaaacttcacatcagttgaacaatattcaaaataagcatgccttccaccagtcacagaggctgatggatcagatcacaactggaccccgtctatggtccacagctgtcaggatagggatcgtggagagggtacaaggagaggttagggtaaaacacagattcctcaaccacacatcaacctgctctgaatgggactgatgtccggagtgggagggcaggaaggagcagtctcctgggctccctagggtctacgtggagtacgaagacttgagaaccactactcaagatcctcttctctgccagcagacagctctgctggccactgtgccaggaaaaccccccactgttctctaagttcagaatcaaaacacggcccctccagacgagttgccctaacgccttcctatcagggaagggaagactcattctgcaaggcgccgcagctgtagtccagtgtctgccacaggtatgaagtgacgacgagcacggagaacacttgaggaaaactgtgaaacaggagcacctgcacaggcatcacgccaagagtcagccctccacacgccagcaccggcaccaactggaggcttttgggagaaccatcagacatgaggtcaaagactttataaatgtgtatgccttgcattctgatgtttcgttaagtcacagggcctcacttgtggcccaggttgcagtacagtgatgcaatcacagctcactgccaccttgaactcctgagctcaagtgatcctcccaccccagcctcccaagtagctgggattacacacacaccagcacacctagctaacttctttagagatggggtcttactatgttgtcccggctggtctcaaactcctgggctcaagtgatgctcccacctccgtttcctaaagtgctgggattacaggcatgagccactgcacccggcctggactctacaattctacttcaggccattttaaacttgactgaatattaaaaaaaataaacctggccaggcgccgtggctcatgcctgtaatctcagcactttgggaggccgaggtgggtggatcatgagggtcaggagatcgagaccatcctggctaacacagtgaaaccccgtctctacttaaaatacaaaatattagccaggcgtggtggcgggcgcctgtagtcccagctactcgggaggctgaggcaagataatggcgtgaacccaggaggcggagcttgcagtgagccgagatcaaaccactgcactccagcctgggagacagagcgcgacaccgcctcaaaaaaaataaaaataaaagtaaataaataaataaataaacctaacttcccagggtgtttagaggtcaggatttgacactcttaccaccatagcccaggtttaaattcttaaataaataaaaaaaccaaatggagacatacacaatgctcccgatggggaggaatgaggggtatgatgctgtcactgcctaaatgcgatttatcagcaaacgcaatccagtcaaaatccttctggacttttaacattagaatttgagggccaggcgtggtggctcatgcctgtaatcccagcaatttgggaggccgaggggggcagatcacttgaggtcaggagttcaagaccagcctggccaacacggtgaaaccctgtctctactaaaaatacaaaaattaaggctgggtacagtggctcatgcctgtaatcccagcactttgtgagaccgaggtggggggatcacctgaggtcaggagttcaagaccagcctgaccaacgtgaagaaaccccatctctactaaaagtacaaaattagccgggcatggtggcgggcatctgtaatccctgctactcaggaagctgaggcaggagaattgcttgaacctctgaggtggaggtggcagtgagccgagatcccgccactgcactccagcctgggcgacgagaatgagactccgtctccaaaaaaaaaaaaaaaaattagccaggcatgatggcagacacctgtaatcccagctactcgggacactgaggcacaagaatggcttgaaccagcgaggtggaggttgtagtgaaccaagattgtgctactgcactccagcctgggcaacagagctagactgtctcagaaaaaaaaaaaaaatagaatttgaaaaactgatggtaaagctcataaaaacaaaatacatgaaaaaagcaaagactttaagtaaatgagaaaaatcctccaacctatcaaaatataccataaagctacagtaattaaaatagcataaaaaatgataccaagaaaagatcaatgaatcagaaaaaacctcagaaacaatacagaccttctcccttctcctgtgcacgtacagtgtgcacgcaccaggttctccagatcactgcgtcagcacacacttgcaagtgcacacacacgagcacacacacgctcacacgcatgcagtcacacacatgcatacacaggcatagacaggcacatgcactcacatatgctcacacgtgcacacatgcaatcatctgcacacacgcggtgcacacacgtgtacacatgcaggcttttttccaagcatatgttgttctgcatcctgttttttgtatatatttttgtacgaaataagaggaagcatttctttagggtataatccttaaacttgggggtcaggggacacgcacatttaaaattccaatgagcaggtgccacccactgagcggtgggggcatgttctctccaccctcaccctacacccatattgcccagcactgctctcacaacacccgccctggggccggccatagggtgccctctgctccgccttctgctcttgcagcacccgccccggggccacctcttggtgcctctgcccagcccatactacccagcactgctctcgcagcacccgccccagggcccgccctgtggtgcctctgccccgccttctgctctgctgcagagggcaccacctcccggaacgtgagctccgcctgatgctgcaggtaccttctccccaccagtcaccatttttaactttccctgtggcatcatcttccacacaaagaccttcctgtttcatatgggcaaatccatccacctcttctggcttctgctgaatgtcttgctcagaaaaccttagctaagatgcgcttggagctggtacacaacagactgcagtcaactgtcaccgcaagagaagcgttcactcgcactgaaggtcttcaagacgacattggggcagggtgggagagggcaggctgaggccatggggacagtcaaggcgcctggtgtttatgagggcaagggctcagcaccccgagctgactacagggtgggagagaatgcggaaagggacacggacatcagctgtcaaagaacatctcctgcagaccatttgtcaccgctgtgcgtctcgtcagggtcttaacaactgaataaggctcaacattaggcatctcccaatcacaaatacattaagcagcagtaaccgaatcctgctgagcagtagaaatacagaaattaagcagctcagcctggcacagtggctcacacctataatcccagctactcaggaagctgaagtgggagaatctcttgaggccaagagttcaagaccaacctgggcaacatgacaagaccccatctctaaaaaaagaaaaaaaaatttaattagcccggcacggtggtgcacgcctgtaatcctggctactaggggggctgaggcaggaagaccacttgagcccaggagtttgaggctgcaataaggtgtgatcacaccactgtattccagcctgggcaacagagtaagactttgtctcttgaagaaggaagaaagaaagaaaggaaggagaaagagagagagagaaaagagacagagaggagaaaaagacaagaccacaaagagagaaagagagagagagcgagaaagagagaaagagacagagagagaaagagagtgagagaaagattaagcgcacaccctccattccctgacctccaaatccgtactcacaacaggctgtgtctccttatcagacgcacactccacacgaccttccaggaccaagggtgacctgcggaaccacaccctggctgccaaggcaaacgtctcaaagcaatgctccgcgaggtatctctgttcatcccccacacaggtctcccttgctaatggttacttaggccaaggagaaccagaaatcaccaccagagacagatgcctccacaaagggtgattctggcaaaaagaagagagtgaagcacataatgaccctgttcctgccccaccactccctctagagactggaactgggggccaagaatcgcaactacattgtatgtttgcaggatcactattaaaaaaagtctaatagcttctacaatatacctttaaaacaggtctcctgttttaattaccattagcaagcattcgaggaatgaggtgtctgtttatcagacaatccagacccagggcagctgccacggatgtcccgcgtacgaccgagcctgcagtgtgggatgcagctggagctgcacacgaggtaggggctgccatccgcagctgccggcccaagagaggggccagggccactcccaaagtgaccaggtacccacagtgcatccctattcccttggaacagatacccacgatccgagtgacagaaccagcaaagcctgaaggcacgagagagccctcatgtcacagacagctcagagtcaccacagagtcaccacagaggcaccggagccaacaccagcctggcgggacttgctgggttgggtgctgggttagccgcattctatcacagagacttcactctcctcacctgtcaattgtgaacaagagataccaaagctgacaaaatgctattaaaaaatcaatcgatttgccaaagataaacaagcaaatcagtaacaagcgggctccaaaaggaataaagcaaaaggacaactgtgtgctgagtggaaatacgtgagcttcaagatatacacaaagaaatccatttttagcatgaaagtaatttcccaattgctgcgcctactaaaattacgaacctttctcaaagcaagcatgagaaaagggacggaaaagcctgggaacacagtaacccaccccacaccacagcaccttccgggtcccactgtaaggctatggtcatgtcctcctccagcaggtgggcccagggcagggaatctgtctgcaccctccccacccacagcagactcttcatttgactggttaacattcccggcctagagccaggcagagcagtgcagccagcgaacaggactcaacaccctgacaaggctcactgcaatacagctggggaccaaactccagaaaacacccggaactggctcattgtgacataaccaagcccgggctccagggagcgccgctgccctccggctgaagccccaggatgtggagaaggcctgtgtgcggcggcctctatcccagaagcaagggcacttccgctctgctgctttaatggcagagagatggtgtgcgtaatggtgggtcatggccgcagcaatcgagccaggccacacatagaaggacactaacaactctacttcagtctgtcattcgactagacttcttctcttaaataatttatatgcaaacatgccatctggctctctacacggagagacaaacatgtagctcttgactaatgggagacacccgtgcgtggtaaacatgcatcagaaaccccatcagcaacattcccgacagaggtggaaatcaagaggctgagcagggttcactgaagagaaatgtcaacatccttcctgtctcataccagctccacggtttctacaccaactcgacacagaaagaacgtgccttttagtcaatgacacatcgctatggggccccccttccaacaagctgggcacccagagctgcctccaatgatgtaaacagaagaccacaggagaagagctgcaacacaggcagcgagaggctggtggccaacaacaagaggaacctggagaacaacaccaggcagctggcaccccccacacccggcccaggcttctgtatgaagggtccagagaaaatgtggtctcccaggacccagcgaggctgggctccaggactgtgacccaagttcctctgaaccctggtattctgaggtctgctccgagcactcgggctcagcacacaagcacagaagagccatgcccggagctcagcttctcatctggcttcttacttgacttgttcccaggtcttggtggccaaatgcaggacccagagatccttgtagtggtagaactgctctccgttgggagaggcaaactcccctccaaagacccacagctgtccgccaccttgaggcactaccaccgcctgtgaaaagaaaggtgacaggtcagggcacagccacacagcagaagggccagtgtcatgggtgaccggtagtggtgagcgcttcagtactatctcggatgccctgcaacatgaccagccccacactcagccactttcctctcctgcctctaaggggaggattccagacaaacaccctcgtaggaaagcacgtcctcagtcaagggtctaataaaccttcatgtatccctaggttgcaagataaacatccatttacatgtagacaatgccatatcccattaaagtggacacagctagttacttcaaacattaacaacggtgtggtgcaacctagcagtgttttccttttattaatatccacaataaagctgtctgcctgctctcgttaatccctctccttgctatcatgtgccaactaaattagcctcagaagtacaatgtgcacgtaaaagaaagtgtttatgtgccaggcgcggtggctcacacctgtaatcccagcacttcgggaggctgaggtggacagatcacgagatcaagaaatagagaccatcctggccaacatggtgaaaccccatctctactaaaaatacaaacattagccgggcatggtggcatgcacctgtagtcccagctgcttgggaggctaaggcagaagaatcgcttgaacctgggaggtggagggtgcagtgagccaagactgtgccattgcactccagcctggacgacagagcgagactccatgtcaaaaaaaaaaaaaaaaaagaaagaaagtgtttatgttttttccttttagagaccacgtcttgctctattgcccagactggagtgcggtggcgccatcatcactcactgcagcctcgacctcatggtttcaagtgaccctcccacttcagcctcctgagtagcttggacgacaggcatgtgacatcatgcccagctgtttaattttttgcagcaatggcgtctacgctgtccaggctggtctcaaactcctggctttagtcaattctcccgcctcggcctcccaaagcacactgggattacacacacgaaccaccacacccagccttacgtgacattatgaatgattaataaagactcagcaccacagtaaaggtgaaggagcgcagcgggagtgatgccctctgggccacacacggcaaagcactccggcagcaggggatgctgaggagagagcagaccaccaatcaaaaacaacggcatccctgacgggtcatcagacaccaccggctactccacatgaggccctccgtggcccactccctctcagggcccccaagaactgcgggaggcagagtctttaggggacggcacacatccatctgtggaaagagctgcttggacagactgctgggctacaagcaatggcagagaccaccaagctccacggggtctttcctccaaacctgcaaattaagcagtagctggggtccaggatgagaaaagcacgctcctaggcagtctgtgttagcaaccacgctggaggggcccctcagtgctgcatctccacaggtgagagccgcccaccctgcccagggtcacgcagcccagcttcgcctgactgtaacgcacctagtggcataattaagagagaaaaagcgacctgagcaacctggcagcaggtgaagccccatttcccagctcagccgtggtcattgcagagttggttctttcataaaagcctcttgttttatttcctctcgtttcaaggtaagagtgaggatctagcaggacgaagaatggttccacacagggcgcagagagggctggtaaatgagagtgccaacccgtctaaggtcaagtgcgcctcgggtggggcagacagtggtcctcagcaggctccctcccggcacctctgagtcggtgttccgcccgcccgcacatagaaacggccacagtgccgcccctctgcaccgatgcggttccttcctgggccagacagcgggcgcaggtggtagcagcacacagggggtggcgtgtccctctccaccccacccacttccagttgttctttgcatctgtcatctcagcacagaggacttacctgtaaagggacaggccaggtttcctatcattctaaaagcccagtagttccatagggagaaactgaccaatttacacctttacagcagacatgatgactggctcaaggccgaaacctaacaaatgttttgagtctagaggaagttaggtggcacaaccatgccacacagtaaatagagttttaaactatcatctcgggaagactattcaatgccacagaataatcctacaataatacatcaacggtaaaaaacactatagaaagaacacatacatgcacgctccagttagcgtgaaatagatgcatagaaatatgaactggctgggcgtggtggctcacgcctctaattccagtgctttgggaggccgagggaggtagatcatgaggtcaggagtttgagaccagcctgaccaacatggtgaaaccctgtctgtactaaaaatataaaaattagccagacgtggtggcatgcgcctgtaaacccagctacttgggaggctgaggcaggagaatcgcttgagcctgggaggcagaagttgcagtgagctgaggtcgcaccactgcactccagcccgggcaacagagcaagacttcatctcaaaaaaaaaagaaaaaaaaaatgaactttatgtgcagagaaaacatgcagaaaatacaaattcagtttagggagaatagacaatggacttgccttttaattcttttcatttttttcagaatgaatatttacaccttacataatcagtccctaaagccattcctggccaggtgcagtggctcatgcctgtaaccccaacactgtgggaggctcatgtgggaggattgcttgagcccagtactttgacaccagccttcacaacaagcaagaccctatttctaaaatataaaaaataaagccattcttaaaaaatgaagtcggccgggcacggtggctcacgcctgtaatcccagcactttgggaggccgaggcgggcggatcacgaggccaggagattaagaccatcctggctaacatggtgaaaccctatttctactaaaaatactaaaaaaattagccaggcacggtggcaggtgcctgtagtcccagctactcaggaagctgaggcaggagaatggcatgaacccgggaggcatgaacccgggaggcggaggttgcagtgagccgagatcgcgccactgcactccagcctgggcaacagagtgagactttgtctcaaaaaaaaaaaaaaaaaaaaaaaaagaagccaaatggccaggcacagtggctcacgcctgtaatcccagctctcagggaagcagaggcaggaggatcgtttgagcccaggagttcaacacttgcctgggcaatatagcgagacccgttctccacaaaaaagaaaaaaaaaaaagaccaaaaagaaaaaaatgaagtcaaactccaggcaagagtgtaatccacaatccgatccacagcactgttttttctttttttttttttttggagacagagtctcgctctgtcaccaggctggagtgcagtggcgtgatcttggctcactgcaacctccaacgcccctggttcaagcgattctcctgcctcagcctcctgagtagctgggattacaggcacgcgccacgacgcccaggtaatttttgtagttttagtagagacggggtttcaccatgttggccaggatggtctcgatctcctgaccttgtgattcgcccatcccggcctcccaaagtgctgggattacaggcatgagccaccatgcccagcccacagcactgtttcaacatcctttcctccatcttagttacaatcccaggcttgacccagtccgacccagaggaccacccaaaggcaggctgatcagcagtctaagagcttcgtatagcctacgccccaaagataatgaacaccagggaaaaaaataaatatgactcaagggaagattaaaactacggagacccacagataaaacttctactcctgcccacgatggagcaacctgtaccacgttagctccgcaccatcaacaaggaaaaaaccagacgaaatctaggaagcaacaacctccagacaacaggaagcgggaagtgcaggactgtgaacctgagagccaggaaacacgccacgcagccctgacccatgactccagcccctgcaggcagctccttccctggagcagggacaaggggcacaggcagggcaggtggtcttgcatagctgaggagacaaggactggagttcagggacgcagaggcagctaaaagtggcagggcagagcactggagagaggaagctatgggagaaaaagccctggaaatctgcacgggggcgtcccctggagtctctgtacactaaactgcaccctgggagggtgagaccaaggaaccaccactgtgaagacaaaagcatcttctgatgctgagaactatcagagcttacacagggcttggaaacaggcaagttccaaccagacgaggtgaaaagatgtcactgaccacacaggtcattcactagagactgcagaaaggccaccactgagggctaagccagccctagagagagcgtcaaagatcaagatgatctgcaaggaactgaatcacctcaggacaaaatgcaacactgtttgataggtgaaaaaatccagacactcaggctgggagcagtggctcacgcctgtaatctcagcactttgggaggccgaggtgggtggatcacttgaggtcaggagttcgaaaccagcctggccaacatggtgaaaccccgtctctactgaaaatacaaaaaattacctaggcgtggtggcacacgcctataatcccagctacttgggaggctaaggcaggagaatctcttgaactcaggaagcggaggttgcagtgagccaagatcgcgccactgcactccagcctgggcaacaagagagagactccatctcaaggagaaaaaaaaaaaaaaaattagccaagcgtggtggcgggtacctgtaatcccagctactcagcgggctgaagcaggagaatcgcttgaacccggcaggcggaggttgtagtgagatgagatcacaccattgtactcttacctgggtgacagcaagacaccatctcaaaaaaaaaaaaaaaaaaaagtagccggacgtggtggcatgtgcctgtaatcccagctactggggaggctgaggcaggagaatcccttgaacccaggaggcggaaattgcagtgagctgatataatgccactgcactccaggctgggagacagagcaagactccctctcaaaaaaaataaaataaagattcaaatgtagaaggcaccttagccacctaatacaatcccagtcaggtgtggtgaggggtgcctgtaatcccagttactcaggaggctggggcaggagaatcacttcaacctggggggcagaggttgcaatgagccgaaatcaggccattgcactccagcctgggtgacagagcaagactccatctcaacaacaacaacaacaaatacaagcgtatacaaatctgatttttaaaccagcccaaatgcctgcaagcctgcatctgcacgggatgttcacacagctcaggcaggcaggtcctcctcaccaaaccaacttcattagcaggtgagttctaagcacacaatcagcaaagggggaaggaaatattgcacaggaatgcatgtatcatgctgtggtcacctgatgcgttgatctttctctgcactggagaggcaggcactcattcaaattttctgtgcgagtctaactgtcacagagttgaacaatggacaaggacagagttcccatcctcacagagcttacagaacgtctaactccggaagccccttccctgacaggagagcgacagctgacactgctctcctgggtaggaaaccagctaaccacgtgctaagtcagtgccacttctctgtgatccggttaccactcgtttccgctaatacaattgttttccttccaccatgcacacctttcctgaacatccagttctcctgtcttcaccatctagtccagaccgtgggcctagggggagtgagcattctgccagtggctgcgacacaccaggaacgacacgagctattttacatggaatatttcatgtgatcctcatgccacctggggagcaggtgttctcctccccgtctcacagtgaagaagctgagtaaggaatccaagtgagcaaacagcagaaccaggcgatctacagggcccagcccctccgcaccagctgcctgtcacctatcaactctccgtgtgtctaccagactcccacgtgggaagagggagggtggctgagagtcagtgctgacattacctggtgagcacagcgcctcggaggtggactggggatgtcaactttggtccaggtgtcctttctggtattgtagacatagagctcgttatacaaaaaagtctacaggaaggaagaagaatgtcagtgtcacaaatgatacgcttccaaggaagtggtgagaacaatcttaatcatgacaattccctgggaaactgacatgctaaaggaatgtaaaccataccagcacagggaggccatgggctgggtccccggggccattggggatgacgacacaatgaaaacgaccgaacgcccaccaggcccatcaatctggaaggtactgaaagccctcgttgttattaggactggtcattctcctaattccagcctagtttttttgtttttgttttgtttgagatgaagtctcgctgttgcccacaatggagtgcaatggcgcaatctttgctcactgcaacctccgcctcccaggtgcaagtgattctctgcctcagcctccaagtagctaggactacaggcgcccgccaccacaccccgctaatttttgtatcgttagcagagactgggtttcaccacattggccagactgctctcaaactcctgacctcaggtgatctgcccacctcggcctcccaaagtgctgggattacaggcatgagccactgtacccagtcaagcctagtttctaaatgcacgaaaactgagagacgaagatggacaaatgcagtcaaacccccaaggcccatcccgggctgcagggaaggtgagctcctgcttttgtgtgtcacacacaattgtgaaacacaggtcttactggcctgctcaaaaataaaaattagccctaaaatttatcagcactttccgtgtttaagacaacctgaaagctgagtgtgaaacctggaaacccgctgggaggaagaacagcacagacaaccacaaagaggggtgcgcccgccaagagtgatgacggcagagctgggcctcagcctaagtcccaggaatagagaccccaggaccactgaagtcatcaacagtcatgccagggcctggagcatcctggcgacgtctcacatcaggcctgacggctcaagcgcgtgatacaaggggtgaaggggctaacgcatatttgatgtcactgccttaagttaactttctgtcaaatgatactcacgcaacatgggaagaaaagaaaaaaatatatactttactttttggccgttgaaatattcacctccaaaaaggattaactcatctttctcaggatgaaccgagagggaggcatttaacctacaagacacacaagcggcaggtcagcaagatcacccccgatacccacctgagcgctgtccccttcctcacagaatcctctgtcaccacaaactggctgcctctacacttcctgaaaggagagcctggcatcgagaaaggaagcaaaggtgccacttgaacaccaacccctctaccagtgcccagggccacactccaaggacaaccatggagctggactgacacagtgtctggttgtattaacaaaaaaaaaaaaaaaaaaaaaattccccaggcaggaataagtccagatgcccctactgatgtatcaaatgttccagaactgtttttttgatttgttttttttcatttttgagatggagtttccctcttgtcacccaggctggagtgcaatggcacaatctcagctcaccacaacctccaactcctgggttcaagcaattctcctgcctcagccctccgagtggctgggattgcaggtgcccaccaccacacccagctagtttttgtattttttagtagagatggggtttcactgcattggccaggctggtctcaaactccggacctcaagtgatctgcccacctcggcctcccacagtgctgggattacaggtgtgagccaccgtgcctggacctcagaactgtcctcttttaagagcctatcctgtcaaatcacctcaaaaccattctaaaaagtccagtaactaggccaggagcagtggctcctgcctgtaatcccagcactttgggaggccgaggcaggcagatcacgaggtgaagagatcgagaccatcctagccaacatggcgaaaccccgtctcaactaaaaatagaaaaattagctgggcatggtggtgcgtgcctatggtcccagctactcgggaggctgaggcaggagaaccacttgaacctgggagttgggggttgcagtgagctgagatcatgccattgcactccagcctggcgacagagcaagattccatctgaaaaaaaaaaaaaaaagtccatatgtaagtacttcaatatacatgccagatatcttccatctagaaaatacaaacaactttctatttatttcacatgagaacaaaagaagagctacaaggaaattacataataatattatgggccaggcccggtggctcacacttgtaatcccagcactttgggaggctgaggcgggcagatcacctgaggtgaggagttcaagaccagcctggcaaacacggtgaaaccccccgtctctactaaaaatacaaaaagtagccaggcatggtggtgggcacctgtaatcccagctactcaggaggctgaggcaggaggatcacttgaacccgggaggcagaggctgcagtgagccaggattgcatcattgcactccatcctgggagacagagcaagactgtcttaaaaaaacaaaaaataaataaataaatacatagggccacttcagttgaaagtaatgaaagacacagtgactatctggcgaatcactgggaaagatcctcccttcagagtcctctaagacggcgttccccaaggcgtgctccataatgccaactccaaaagatgtttctcaaaggaaaaacaggtttcaaggtcaagtgagtttgggaaatctgagaactctattttctattggggatttatttgcatagaaacatgtcataggctgggaatttctgcaggaaagaaaccagtattaaaagctaaacacagaatcaccacataatccagcagttcgttcccaggcattagctcaaacagatacctgtatgcaatgctcgttacggcctcacaaaagccaaacagtagaaataacctaagtgttggtctgcagatgagtggacaaacacaatgtggcatacccacagacggaacaggatttagccataagaagaaataaagttctcacacatgccacagaactgatgaacttggacataccaggtgaaggaagtcagtcacaaaaagacacttctatgactccacttacgcaaaatacctagaataggccaattcacagtgacagaaagttgaccagaagtcaccagggggctgggggaggggaaacagggagcaaccattgaagggtctagacacttctcccatcttttggcttccctgggctacaatggaagaagaattgtctcgggccacgcataaaatacactaacactaacaatagctgatgagctttaaaaaaaaatctcatcatgttttaagaaagtttacaaatacgtgtcacgctgcattcgaagctgtcctgggccaccagttagacaaggttggtctagagtttctatttggggtgataaaacaatgttgcaactggttagtgctaatggttgcacagcgacatgaagtaattccactgaactgcacagttttaatgattaaaatggcaaattttggccaggcgcattggctcatgcctgtaatcccagcactttcggaggccgaggcgggcggatcacctgaggtggggagttcgagaccagtctggccagcatgaggaaaccccatctctactaaaaatacaaaattagccaggcatggtggcgcatgcctgtaatcccagctacttgggaggctgaggaagaattgcttgaacctgggaggtggaggttgcggtgagccgatatcataccattgcactccagcctgggcaacaagagcaaaactctgtctcaaaaaaaccaaaaccaaacaaaaataaaataaaatggcaaattttgttaaacattttaccacaataaaaaaaactttttaggtcgggtgcagtggctcacacctgtaatcacagcattttgggaggccaaggcagttggatcatctgaggtcaggaatttgaggccagcctgactccagaggttgcagtgagctgagatcgcgccatagcactccagcctgggcaacaaaagcaaaactccgtctcagaaaagaaaaaaagaaaaaaaaaaactttttaaaaataataaataggccgggtacagtggctcacgcctgtaatcccagcactttgggaggccgaggtgggtggatcacctaaggtcgggagttcaagaccagcctgaccaacacggagaaactccgtctctactaaaaatacaaaattagccgggcgtggtggtgcatgcctattgtcccagctactccggaggctgaggcaggagaatcacttgaacctaggaggctacagtgagccgagatcgtgccattgcactccagcctgggcaacaagagctacactccgtctcagaaaaaaaaataaagagtgtttcccaaattcctctgaccctgaatcttttctcactgaatacctattgattttctgcagaaaagcaccaaacacaacttcagaaacgatctacacggggcccaaactgaggtccccacccagccaccagcggcaccagcccaggtgttgccgccgcacaggcaggtgaggtactgaggcagctggtgtcatgcccccattttccaggtaggtcacatcagagccaatcctgacgatatgctcatttagaaactggtcattctcacaaggttttaaagtaatatgattaagaaataggaagttggaagatattaaggttaccaagcaaaagatcttaatctcaggataactgctccctcctattaggaagcatttccagctgacccagggaactgccaacaccttaaattatatcctgacatgaaatctgactttcaggcaacattacttatggaaaaattctaaaatatcattaaaaaaaaaaaaaaagaaaaaggccaggtacggtgacttgagcccaggaactcgagaccagcctggacaacataaaaaaaagtctctacagggccgggcacggtggctcacgcctgtaatcctagcactctgggaggctgaggcgggcggatcacgaggtcagaagatcaagaccatcctggccaacatggtgaaaccccgtctctactaaaaacacaaaaaattagccaggcttggtggcgggtgcctgtagtcccagctacttggcaggctgaggcaggagaatggcgtgaacccgggaggcagagcttgcagtgaaccaagatggcgccactgtactccagcctgggtgacagagtgagactccgtcccaaaaaaaaaaaaaaaaaaaagtctctacaaaaaaaataaaactaatccccattcaaagtggctttcctcaggagtgctatatatcagaagcctaagatcaaggatttatttgctccaataactcaaatgaaaatgtacatttacagccaggcacagcgactcacgcctgtaatcccagcactttgggaggccaaggcaggtggattacctaaggtcaggagttcacgaccagccaggccaacatggcaaaaccccatctctactaaaaatacaaaaattagctgggtatggtggctggcgcctgtaatcccagctacttggaaggctgaggcaggagaatcacttgaacctgggaggcagaggttgtagtgagccaagatcatgccactgtactccagcctggatgacagagtgagactccatctcaaaaagaaaaaaaaaagtacatttaccacatgtaacttacatttggccctgagggcaacatgcaaactaaagggaaaaagaaaactaaaatcctaatggacatgaagtgaaaaccaggaaggacactggcctttgggagtggctccaacaccactcactctgctcaggggctgatcaccgtgctcctcccacctctgggcaggtgatgataaccctgcctctgaggccggtgggtgggactcgggcaccagagccatcacatgcgcctcattaatgcaaacgcagcacaatcgtgaccctccactcccgatgggctgaaccccggcttccactagggcctgcagcagctttattaaaagggtaaatcctgcaaggttaatctcctactgagggaaataaaccatttctcattccagctcatcccacacgtgtatgaaatcctacagactcggaacgtttttacgtaattttcaaatccatttaaaatggcttatactcaatttatgtttaacaaacttttcacatgagaatttgaaagcattacaaacacatcaaaaggccacagtgattttcagctttctgcctacagtacgcacttttaaaataccttaagaaccaaagaaaagctcactggggcaaaactttcatccccacgtcacgaccagtggaggagctttcaaagttggcaccggagcccagaggcagcagctgtgctgtaggccctgctcccaggttccatgacagtaaagcttacagcctcattccagttcttcagcagaaagtgaccaagaacaggttttaataatgaaaatgtcccaagtgcctggtcatttacgaaacctggtgctatttaaagcagtttttcaatgtatagaagaaaaggaaacatacaatatgaaaaatgctacttgctcaccttggtgagggtggggggcacggaagttccacagtctgagtcctcttggcatcgagtgtctggaaatgggctatgagcgcttccaggtcttcctagggcaagcaagcaggcacacgtgagacttattcccaggacccgccgcggagccacagcccgctcagctttcctccaatcagtgtgattcgactgggctcagtcacatctgtgaattgcaacatactgtgcctgtttgaaatgcagagtttgacacattcgaaagtaaccagagcttgacctcaaaggcagtctgcttaaagggtagatgtgtgcaccaagtattatctccacacccttaacgctccctctgcaagaccttccacttagacaagcccgttgtgacttcactgcagacactctcagcacctctcataacccagactcgagccgtcgcacctgccagccttcctgtctgcagagcagtgtctgacaagaacttccacttagacaagcccatcgtgacttcactgcagacaccctcagcacctctcagagcccaggcctgggccgtcacgcctgcctgccttcctgtctgctgagcagtgtctgatatatttctcttgcttatttgtttcctccaccccaacaaaataataaaatatgagctccaccagagcaagacttgtgtctagttaaaacactgcctgcacagcaagagctcagcaaataccagctgcagtctatccaagtaagaaggtctcaacttttactaccatcgagagtgactcaaggtactgatgtgccagcacagagggcagcactggaacccagtgttcccgcctcagtcccagtgcccatttcccaacatttacgagacactcccatgcacacccgagcctggcatttcaagttccttctagccttcagtgtcctgcttgcaactacacacacctgcagaccatcttccctcccccacacccacctctccaacctcacctcccacctggcctcactctccaagatacaccagcgtcctctccgttccttcaatgaaaacgccaggttccctcagcctgccacgccccacctcgtgcttccttcagtctacctctcatctcagggtgaatgtcagcagggtacactgcttagtattctaaacgatgcaatatttaaaacacacaagttaacagaactttatccaagacattcctgtatacggttcccagggtaaggaataaagtgtcacccacatgtacccacccacacattccctcaagtaaccactatctggaactcgatgcttattagtctcacgcttttcttcaatcttttattacacatgtgtatccctaagcaacatatagtattgttttacatttttaaatgtcattaaatggactgggcacagtggctcacgcctgtaatccccgaactttgggaggccgaggcaggtggataatttgaggtcaggagttcgagaccagcctgaccaacacggtgaaaccccgtctctactaaaaaatacaaaaattagccggccacagtggcgcacacctgtagtcccaaactactcgggaggctgaggcaggagaattgcttgagcctgggaggcagaggttgcaatgagctgagatcatgccactgcgacacttgctctgggtgacagagcaggactccatctcaaaaaaaataaaaaataaaatgtcattaaatggtatcatactgtatattctttcaacttgctttttttgctcaacgaggttaaacaaacagttcaaatactaacgtctatgtaccgcgaaagctttgctgctgctacttagagcggtctttgaccttggctgaacctcatcatcattgggtgactgaaggagagcaaggtggtagggtctgggtgacgccagtggcctagccagtgacagcctctccaaagtgacaataagctgaatgctgaaaagacgactcagacggagtatggttggggtataggtaagaccacagacacaacttgccatgtttgagacactaaaagacactgtggctggagtgagcccagggagacagctggaaagacaggcagaggccaggactaagtgaaggtgcgaaccaggtgacctgatacatgagttctgtgggagcagaattccaaactgtccccaatccttcccccaataattgccaggactgtgaaagaatgggataccactcttgtgattaggttgtattacagacacagctgaatttaagaaagagatgatcctctgtgggtctagcctaatcagacgcccacttattttaaaagtttgttttgagggttcattcagataacatacaaaccccaggcctgacaggctctctctcttaagggaagctactgttacaatcaccttagtattgggtactggagggagacatggagatgagtaaaaatgacaggtaactggcggggcaaggtggcttacggcttgtaatcccagcactttgggaggccgaggcgagcgcatcacctgaggtcaggagtcccagaccagcctgaccaaaacggtgaaacccggtctctattaaaaatacaaaattagctgggtgtggtggtgcatgcctgtaatctcagctacttgggaggctgaggcaggagaaccacttgaacctgggaggcggaggtgcagtgagctgagatcgcaccattgcactccaccctgggcaacaagagtgaaactccttcaaaaaaaaaaaaaaaaaaaaaaaaaaaaagcagaaagcagctaacagctggttactgagtgcttactttctgccaagcaccattctgaagataccacacagatgaactgacttcctgtgccacaaccctagccagcaggtcatgccactgcagcccagcctaggtgacagagcaagactctgtcaaaaaaaaaaaaaaaaaaaagaaagagcctaagaggagtgtgagggaaaagtccaactccattatttaagagatgaggacatggagagatcaatgacttaggaagaaaagggacaaaggactgtggtcaagagctcctgattcaggacatctggtcacatcccagttccataccacttcatggttcacctgttggtcttcctgtcaaatgggaataccagtgctacggaactgacctgctcgtgaggagtaaagcccagggagctgtgcctggcgcacggcaggccataaaactggccccggttagggaatccatgagcagcagccgcagaacactcaaccccaaggtcaggacggatcctcctgcagaccccgggctgaggaccagagggaaggagacaaccgtgatggccgccatcagctgctacgggataccccgtggctccagtgccttcttcacttaaccatctgctgctcactgctcagggctgctgtgatgattatttgccctcttttgaaagaaaagtaaggttcagaaaagttaagagtcttactcccagaccacacatcatgcagaggcagcccccggctcaacctcaggtcttcctgtgccaaacccctccctcttctcaccacccagcctcccttcagagggagggtggagggagaagggaggagggggaggaaacgcagaaaaacgcccgtgacaccacactaagaaaagcaagcacgttaaagggggcagctccgagaagcggacagacacacgtggagactcaggagggggcgggccccgtctgggctgcccggacgcggcgccggggcagttcctacggcctccagctctcccgcagggccggcgcggctcccacggccgacccgtaaccccggggggcgcagggagtcggccgaggctgcacggccgcgacgtcgggccgctaagcccggtctgacccgctcacctcctccttccgcgagcgcttagacaccttcttctccatcttggcggccgtcttctccgcgccgcggcccttcttctccttcttgcccttcttgcccatcttgccgggtcccaagccgcgacgggacaccaggaaagaaaacggcccgcgctctccgctcggaaacaggtgctcgtggggcggagctcggcgcacagaaat

SEQ ID NO: 1824 - DNA, 58182 bp, Homo sapiens; identical to SEQ ID NO: 1823

SEQ ID NO: 1825 - DNA, 58182 bp, Homo sapiens; identical to SEQ ID NO: 1823

SEQ ID NO: 1826 - DNA, 212707 bp, Homo sapiens
cactgggcggcccttagacccaggctgcctgctgtctctggcaggaactcaagtcgctggtcatcctcagagcggtgttggcccggggccttcagtggcctttgtgtctgggtgagaggaaccctggatggccactctgccctgagtgtgtgggtccccagaagtgctgggttagggggcacggagggccagaaagtcccctttggagcgctggactctctcgctgactcctaccccaccccggcctggggtttcagagaaggggtccaggcaggagtgtcatcttttctcaatggggatgtggcttcagtctctgtccaggtgggtgcattgctctctttccggctcctcccaggctgcttaaatgacctgtgacgaggcctgcgccatggccggggccctctgcttttcccagcgctgcacctgggaaccaggggttgggccccggaagccgaggatgtccctgaatgccatgcctgggcacctgtcctggccaggcgaggcgtgttggggcagcggctgagatgggagcagcagcattgcctgccaggtttgagatgggccccgggtgagtgtggttaccaggaagggctgggcagagcaggcgggtgggccgcccctggggccttgttccgcagatcaacctgatccgcaccctggggccggggcttcctttcacagccttcccatgaactatggctcctgtttccatcccaaatcagatcccagaagaggaataatgtccatgtaacccaagccagttggaagtgggttacatccaacccctgtcatcttccagcttgttaaggacttgactaactcaacccagagggatttggagggttgtctgcaaaacccactaataacagggaactttagctctgtagccacagggtctacagaggtgtcgggctgtcgggttattgctgggaggtgagccggtggcgtagacaccatggaggcaccggtagtggaagagctgcaagtgcacacagaggccggcaccgaggggcggggaggaggaggtggtggatttctcgccagtgttggcatcatgttgcctccagcatcagagacccaaggtgtggctgaccttggctggggcgatgagtcattggatagcagagccttcctggtagctgggggttaacgctttaactgccgggactttgtattatgccgcttcttttttttgttttgtttggtttggtttggtttggtttttgagacggagtctcactctgtcacccaggctggagtgtggtggctcaatcttggctcactgcaacctctgcctcctgggttcaagcaattctcctgcctcagcctcctgaatagctgggattacaggcacgcgccaccatgcctggctaatttttgtatttttagtagagatggggtttcgccatgttggccgggttggtttcaaactcctgacctcaggtgatccacctgccccggcctcccaaagtgctgggattacaggcatgagctaccgcgcccagcttgcatttatgcttttttttttttttttttgagatggagtttcgctcttgttgcccaggctggagtgcaaaggcgcgatctcagctcactgcaacctccacctcccgggttcaagcgattctcttgcctcagcctcccaagtagctgggattacaggcctgcgtcaccatgcccggctaattttgtatttttagtacagacggggtgtccccatgttggtcaggctggtctcgaactcccgacctcaggtgatccgcccgccttggcctcccaaagtgctgggattacaggcgtgagccaccgcacccggcctatgctttttattattattatttaattttttaaggaaagcaatctaaactgtacactgtatcttttctttctcttttgctttttgttgtcagttttctgtattacttattgccaaacaacatgaacaggaaattgaaaggaaaacttcaacaatcattggctgtagcatttcttctgtgttccattcagtgcttgtctcctcaggaacatgacatagggtttgatttaattatgaaaggcgtatattttcagagttttatactccccatagaatgaatgttgaattctgttcttttcacttgaaattagatctcaggcatggatttcatgattatcactataatggctcttcagagtggacattgcatcttgtagggaaccaccctctccccagctgctggtgtggacgctcctccttgatggtgtgggtctgggcccctgaagggtggtgtcctgagtaaagatgttacagtagccatgcttatagctttgggcctggggctaggtggagactggcttcaaccctagagcttgctgtcttaaaataaattcttttttttttttttttgagatggagtctcgctctgttgcccaggctggagtgcagtggcgcgatctccgctcactgcaagctccgcctcccgggttcacaccattctcctgcctcagcatcccgcatagctgggactacaggcacccgcccccacgcccggctaattttttgtatttttttagtagaggcggggtttcaccatgttagccaggatggtctcaatcttctgacctcgtgatccactcgcctcagcctccaaagtgctgggataaaataaattcttagggccgggagcggtggctcacacctgtaatcccagcactttgagaggccgaggcgggcagatcacaaggtcagaagatcgagaccatggtgaaaccccgtctctactaaaaatacaaaaaattagctgggtgcagtggcgggcgcctgtagtcccagctactcgggaggctgaggcaggagaatggcatgaacccggaaggcggagcttgcagtgagccgagattgcgccagtgcactccagcctgggcgacagagtgagaccctgtctcataaataaataaataaataaataaataaataaattcttatacccacttgcattatttattattattattattaaacagggtcttgctgtgttgcccaggttggagtgcagtggcgtgatcatgacctcccagtctcgacctcccagtttcaattggtcctcccttctcagcctcctgagtagctgggactacaggtgtgcgctgcatgcctggctaattttttttttttttttttttttgagacagagtcttactctgttgcccaggctggagtgccgtggtgcaatctcggctcactgcaacccccggctcctggattaaagcaattctcctgcctcagcctcctgaatagctgcgattacaggcatgtgccgccacacctggctaatttttgtatttttagtagggacggggtttcaccatgttggtcaggctggtctcaaactcctgacctcgtgatccacctgccttggcctcccaaagtgctgggattacaggtgggagccaccgcgcctggcatgcctggctaatttttaaaaaatttttgtagcagccgggcgcggtggctcatgcctgtaatcctagcactttgggaggccaaggaggtcgggagttcgagaccagcctgaccaacatggagaaaccctgtctctactaaaactacaaaattagctgggcatggtggcacatgcctgtaatcccagctactcaggaggctgaggcaggagaattgcttgaatctaggaggcgggggttgcagtgagctgagatcgtgccacggcactccagcctgggcaaagagagtgaaactccgtctcaaaaaatttttgtttttgtttttgtagcgacagggtcttgttttgttgttgcctaggctggtactgaatttccagcctcaagcgatcctcctgcctcagcctcccaaagcgctgggagtacaggcgtgagtcactgtgcctggcctccacttgctttggctgcctttctctgtcttaggtaaccatacatttctccaggtaattaagaaaagattgcgcatgatgagtcccttttctggtatttctgggattgcccccaaaaccagacaagtgttcttaccttgacattttattaagactttaatgaacagaatgccgtttgccctcagtctgctggtccccctgcgaaggcccagggcttccttgtttgaaaagtcatccccttgtcgaggtctttgattccttttcaccacggcagtcatgccgagggtccacagagccaccccttccccatctcttcctcggcccctcaagacgcatctgtacccccggagatgtctctttgttttcttgggccacctctcctggccgtcactcaccctgctgactcattacttgtgcaacagtttcttctggaaccctcaggctcctgccacctaccctctgcagtccccgttttgttcctcttgcctcagtcttcctccccatcacccctctacctgttggtctccatctctgtctatggcacatccctgtgttatactctgatggctggataaaggttgagtgaaacgcatctacccctttggtgactggggtgcccattaatcagaagggatccaaggctggcgtagccttttcccgcatcctggggtatcgtcctgtggctcttccttgttggagtctgcagttttttgtttttttttttttaaattttttgagatggagtctcgctctgtcgcccaggctggagtgcagtggtgagatcccagctcactgcaacctccgcctcccgggttcaaccaattctcctgcttcagcctcccaagtagctgggactacaggcgcccgccaccatgcctggccaattttggtatttttagtagagacggggtttccctacattggccgggctggtctcgaactcttgacctcaggtgataggctcgcgtcggcctcccaaagtgctgagattacgggcatgagccaccaggcccggccgttgagattaccttcataagccaccaggcctggctgtagttggcagtttttgaccactggtctcgctccacgtgatctgtgatcttccccttggccccctggccctgccctgttcatctgctcacctttctcatgcatgcggtttgttcatagggtatgtaatggggtctaaccaggaaatggaaaccgcttgagcatttatttatttatttatttatttatttatttatttatttttcccaagacaaggtctcactctgtcacgcaagctgaagtgcagtggtgtgatcacagctcatggcagccttgaactcctgagctcaagcgatcctcccttctcagcctcccaagtagctcggactataggtgcacactatatgcctgcctaattttttcttttatttttgtagagacagggtcttgctttgttgcccaggctggtcctgaactcccaacctcaagcaatcctcctgcctcagcctcccaaagtactggagctacaggcatgtgccatcacgccttgctaatttttgtattttttgtgtgtgtgtaaagacaaggtcttactatgttgcccaggttggtcttgtactcctgggtttatgtgatcctcctgcctgggcctcccaaagtgctgggattacaggcgggagccacagtgcctggtccacttgagcatttagaacagaaggacttaaaggcggggaactagttacacagatgatgggagaggtgaaggccagacagggaacagagaggcaatcagcaggaaatcaaagtggtgtgggcttatacagccctctaaaggtatggatgcaatgattcatttagaatgagaaaataaataacagcaaattataaattataagcagctgttaaatatcacaaacatcactacatgcagaagagtaccagtcaactgtcagtcatatctccaaagttctatttctcccacatttttggcattacttcttcaatatgatgactttgtaatatcgttttctatttcgagaacagaaaactgatcaggctggacacagtggctcgtgcctgtaatcccagcactttgggaggccaaggcaggtggatcacttgaggccaggagttcaagaccggtccgggcagcgtggcgaaaccccgtctctactaaaaatacaaaaactagcagggcatggtggcatacacctgtagtcccagttacttaggaggctgaggtgggaggattgcttgagcccaggaggtcgaggctgcagtgagccgtgatcatgccactgcactccagcctgggtgagagagtgagaccatgtctcaaaaaaaaaaaaaaaacaacaaaaaaaaacataggctgggcgtggtggctcacgcctgtaattccagcactgtgggaggttgagatgggcggatcacttgaggtcaggagtttgaaaccagcctggtcaacatggtgaaaccccatctctaccaaaaacataaaaaattagccaggtgtgatgacgcacgcctgtaatcccagctacttgggaggctgaggcaggagaatggcttgaacccaggaggcagaggttgcagtgggccaagatcgtgccattgcactccagcctgggcaacagagtgagactccatctcaaaaataaataaataaataaagcgaatgaatctccttagttgatcaaattttgtttttatttttggtagttgggatgtatacaaaagtggcggtcaacatggagttggtggtgctgctacaattgttttgttcaagatacacaggaattctggtaaatcctgtttttttctttttttttaaatgtgattcccatcaagaaagaagtaggaaaatgggggagatttctaactgcatatgaggcatttgtgcatgtatttctgaccagagagacttttctgttttgactccacattgaaggaactgaatcctttgcttacaacttcacctctggtgatgggagtaattttccacagatttgcttctggacccgtgcatttcaaatcttgcttctctccactgcgcacgtttttccggcgccaggcaccgcaggatatgttcgtgtcttgtgatttttgattctgcgcggtaggtggaattggaacggtgagtggagcgagtattgctggaatccgtttccacaccgggatagcgagcagtaactgaactatacatggaaataaatgggaactacataaatataacccgaccaaagccaaactaaatatctttccagttcaacttctccttagcaggagcccccacgtggcagcaagcctccgtttccacctcacacaagagaaaatgtgacgggcaggaactcaagactggaaatgaacggggacgttaattgattgtagggaaaatattttccattttgtaaattttacaaaaaatgtttgaccctgtggacatgtggttagggcccttctcagtgccttgagagggaaccatgcaggtagagggagggttcttagcattgtgggggtgacctggagattggcagcagggtgccaccaccacccctaggtggggatgagagggaggaagtcctgtgaccagagtccaggggccagagtcacctgctgggagcccaaacaaaggtgggactctggcaggagctggaactacacagaggaccacctctcctgctggagaagctgtctgaggcagaggaggtggagagctcccgcgccctcccttgcttccacctcccaggttcctcccaagcctctcgttggttgaacccagcccaaagccagcaggcctggggacctggacacctgagccagcagaggtcggcgtttctcccacacaaaggagggcacaagaagtgggaggcacggagggggatcaggccaggacccacacaggatgtgcaaacaggagctcccctctcttcccaccccaaatggcatctgcagccggcctcacttccctgctgttagacaggaagaggaaccttgttcccggcaccagctgcccccaccgccccccaccccacggaggcccctttcctctctggcctttgcttgcaatcattggcgacgctgatggaccatatcttctggggagtttggtcatgaacatggtttcccatttgttgtggaccaaactgtgcccttccccttgaattcctgcgttgaagccctaactcccaatgcagctgtaattgaagatagggcttttagggaggtaattaaggttaaatgaagtcatagggcaggaccctaatctaataggattgatgtccttataagaagagggagagacaccagagatctctcctcccccctcacttgtaaacagaggaaaaatgacggaggacacagcagggaggtgggtacaagccaggaagaggggcctcgccgggaactaaccctgacggcaccttgatccgggactttgggcctctcaaactgagaaatacatgtctgttgtttaagtcactccctccacagtaatctggatggcagcctgagcttaccaaggcaccgtctgcatcagccagggctctccagggagacagccaataggagatggatggatggatggatggctagatagacagacaagcggacagagagagagagagacaggcagacacagacagacaggcagacaaatggctagatagacaagcagacagagagatagagacagacagacacaaacaggcaaacagacaggcagacaaatggatagatagatgatagatagccaggcaggcagatagacacagacaggcagacagacagacagacagatgataggttgggttcagtgactcttacctgtaataaccagcacattggtaggctgaggccggtggatcacttgaggccaggagtttgagaccagcctggctaacagggtgaaaccccatctctactaaaaatagaaaaattagctgggcgtggtggtgcatgtctgtaatcccagccactcgggaggctgaggcacgagaatcacttgaacctgggaggtggaggttgcagtgagctgagatcacgccactgcactccagcctaggcgacaaagtgagactccatctcaaaaagaaaaaaaagatagatagatgaatggatagatagctagatagatgacagatggatgataggtagatagataattgataaatagatataaatgaccgatggacaggcagacatagatacattgattaggtagatgatagatggatagatagaagatagatggtggatgggtgggtagataggcagatagacagttagaaagatagatgatagatagataggaaggaatttattaggggaattggctcataccattgtggaggccaagatgtaccacagaaggccgtccgcaagctggaggcccaggaaagccagtatcgtggctcagtccaagtctgcaggcctcaggactgggaagctgttgatgtaactcttagtttaaggccaaaggtttgagagcctggggaactgctggagaactgggagttctaagtccaagggcaggagaggaaggcatcccacctccaggagaaagagggaattcaccttttctctgcctttttgttgtctggcaatggaatggtgtcatccatattgagggaggatctttaccactcagcccaccaactcacatgcccatctcctccagaaacaccctcacagacacacccagaagcgatgcgttaccagccatcccttaatccagccaaactgacacctgccgtcagccaccacacaggctcagaagaatcgtggttgcatggtgatggtctccatcccgtctaaagaagttgaagatgaactgttggcacaagccatcgttctttcaggctccttccagtcgttcattcttttaaaaatgtattcattgagcacctgctgcatgccaggtgctgtgacaagcactggggcacagcagtgagcaaacaaggactcttgtttcttggagtttacatgcagtagaaggaaacagaatcaatgaattcatcagttctagaaactatcaaaataggactaagagctgtggtgagaattaagataaggtgattgcatagaaagtgactgatggctgctttggaatgagtggtgaggggtcacagagatgatgacagctgagttgagattgggaagacaggaaggagccagcagtgcaaggactaggctggaagcaagcttggtgcattccaggaacagcaaggaggccagaggggctgcagtagagcaggcgaggaggaggagggagacgcaggtcaaagaggagcctggggccagatggaggaccctccctccaaagctcagtcatttcctccttaaaggagaatgtgttacctccaaaagtcacatatgccagcacagtgtctggctcatcatatgccttcagtaggcggtgagcatggctgttcttgttattactacatcacaattactaggaataatggagtcaccaggctttgcatttacagcaatgtgagggagtcagcaagcttccctggggaacccatctcccctcactaagttcataagagcctgataaccaggtcaatgtagtgagagctatagctgcccagtgtactggactctttagccacgggccaggacactttcatctcagcagaaacctctaaggggactggggagtgtgctgtggatgtttctgggttactcagacctcctggggagccttccccaccgcagctgctgcagggagctcagctgcagtgatgaactgcggctcagccttgtttatgggaaaaccctacatgggagatgggacggtttcctgttggttctctcggcctcaggttgctttcacaagtgcagggattctcacctgggtgtgtgaatggggctcaggatgccccaagggtatgtggagatgggggtcagctgtcttctctgatgcctctgaacctcctccccctgcctttctgcatctcattgcttcctggcctctctcactttgggtgctttggaacaacatgcaatccaatacacaggctgactttattattttgttttgttttattttattttattttggaaacaaaggctctgtcattcagcctggagtgcagcggtgcaattgcaactcactgcagccttgaacttctgggctcaagtgattctctcgcctcagcctctcaaagtgctgggattacaggcatgagctgctgtgcctggcctaggctggctttaaaagctcctcactctctctgcatcctgatgatacctacctcctggagcaggctcccagccattggcttcggatactttgtagctattattggccagttgtggcatgtgaagctgaggctcaggagaagggcagtcctgtccaaggccacacggctcagtgctaacactcagacttcagtgtttttatctccctcctggtcgcttccacccttagtgcatctctggaggcccaagggagctaaaggccaggctttggtcagctaagaatttaaaaaagctgtctctgtgctcctctgtcaatccatcactccattatctcccccgacaatgaattcagtttgaatttcagataaacaaggattaatttttagtataagcatatcccacaacagacttgggatatacttatgcctaaaaatgattcattgtttgctggccttagtagctcatgcctacaatcccagtgctttgggaggctacagttggagaattgcttgagtccaggagttcaaggttacagtgagccatgatcatgccactgagctccagcttgggtgaagcagcaagatccttatctcttcaaaaaattgttgattgtttatctgaaatccaggtttaactgagcatcctgtattttatatgagaaccctatataggtgagacccagagtcccaatgcccactggtaagcctttgcagggaggctctgtgggtccttggctggcactgatgccctgtgatgagcagggccatctggcaaggtggacgcctgctgcccatgcaggcagagcaaggccctgggcaggtatgagctgatctcaccttccccagcctgggagccagatactgttggcagcttgccgtcaagagaggggctggtcaccaagagaggggcggcctccatgggccttctttggcttttggctctcccccagccctcctcctaccccaaacagaggccaacggcaccgcaccagaaccagtgtgctgcctcctttggttggcattttgtagttgggtagactgtttccttctcacaggagctggtggtgccccttccgcttcacagggaggatggctgagacccctgaccttgacacagggtgctgttctttttttgttttgagacagagtcttggtcttttcacccaggttggagtgcagtggcatgatgttggctcactgcagcctccacctcctgggttctagcaattcttctgcctcagcctcctgagtagctgagattacaggcgtgcaccaccactgagaacaatgccttctacagtgtttattctcctgtaggagcaagttcctaaggcaaggaggttgctcccctcatggatgaataaattgactttgatccacagccccacgtgtcagccttgagggtggggaaaggttgttctgtgtctaggcagggggtgggggcaaggccaggagggcctggtgcccagtgtacctcttcaggacacaactccaggtagcagaggccaaggacagaggggaggagaagagggaggtggccattatctccttatctcagcttcctttggagataagcttgagtattttagttgtccactaagtctggagataagtctggaatttaaacctttgactttgatccagcccttcacagctcctgtgagcaaactgagcctcagaaaaagggagtgaagcctgtgcatcctggacgcccccaccccaggctcaaaccgcccccaccccaggctcaaaccgcccccatcccagctcaaaccgcccccatcccaggctcaaagcgcccccatcccagctcaaagcgcccccatcccaggctcaaagtgcccccatcccaggctcaaagcgcccccaccccaggctcaaaccgcccccatcccagctcaaaccgcccccatcccagctcaaaccacccccaacacaggctcaaaccaccctcaacccaggctcaaagcacccccaccccaggctcaaagcatccccaccccaggctcaaagtgcccgcaacccaggcttaaagcgcccccaccccagctcaaaccgccctatcccaggctcaaaccgctcccaccccaggctcaaaccacccccatcctaggctcaaaccgcccccaccccaggctcaaagtgggaaggagccacagggaaacaaacgggggaggcacggatgaccaggatgagggtctccatgacccacctttccccaggggctatctcaagagctttttaaacttttattattttttaatagagatggggtcttgctgtgttgcccaggctgatctccaactcctagcctcaagccatcctcccacctcagcctcccaaactgctgaggttacaggtgtgagccactgcacctggcctctctcaggagtttcaagaaaaaaaatgggaatagatttgtgtgtgtgtgtgtgtgtgtgtgtgtgtgtgtgtgtgtgtgtgttttgagaaagagtttcgctctgtcacccaggctggagtgcaatggcacgatctcggctcactgcaacctccgcctctcgggctcaagtgcttcttctgcctcagcttcctgagtagctgggattacaaacatgcaggctgattttgtattttcattagagacggggtttcaccatgttggtcaggctgatctcgaactccggacctcagatgatttgcctgccttggcctctcaaagtgctgggattacaggcctgagccaccgtgcccggccaggaatagattcttttctgtagatgacttctgtcattattgaaaatggatgtttatgcacaattgaattgtcataacgcctcatcctaaaaagctcctttttgagaaaatgtgacttttgatagaggagagactgtccaggcctcattcattgtcagcacaaaggcagagcaggggtgtggcggtgtcaccctcctctgagacagccccatccctgctctgcccaggggttcagaagtctggtctattcgagcccacagaggggtttggagtggctgtcttacatcacaggtggggtctgtaaggatctgaaatgacctttgagaaggcgggtgtggtgggtgcatttcaatcattaaagtaacaacaatgatacatcaaatagtgtctgctcagattctgagtgcctgtttaaacatttccatcttgtgacttgccagattctagcataacaacccaggtaaaagaaaaaatagctgggcgtggtggcttgtgcctgtaatcccagcgtgaggccaaggcaggaggattgcttgagaccaggagtttgagaccagcctgggccacctgagaccccacctctgaaaataaacaaaccaataaaagaccttcatgctctatgtctttcttatatctaggttccccaaattatatgcattggggaaagtccattaagagaagcccctggccgggcgtggtggctcacgtctgtaatcccagcactttgggaggccaaggtgggaggatcacaaggtcaggagttcgagaccagcctggccaacatggtgaaaccccatctctactaaaaatacaaaaattagccgggcgtggtagtgcatgcttgtaatcccagctacgcaggaggttgaggcaggagaatcacttgaacctgggaggtagaggttgcagtgagccaagttggtgccactgcactccagcctgggcgacagaaaaagactccatctctaaataaataaataaagggagagaagcctctgggctcctagatacatgggtcagtgtccacccctgcaaagctgctgtgcccaaagaggggctgtacttggtggaattggggcaaaagagcagggagggcactgggcagttgacctggtctccactactggaaaggggctgtgctgctggtgccctgagctggttccacaaggaagacactgcacagggcgccctaagtttgctctttctgcctaggctcaccctttcctctccaggaccagggagccccgctcgtctcctgtcttcggcatctgctctctggcttgtgagcactgcatttctttctgcttggaacgccggcccatggtgggtccccggactcctgccttctgctgtcttttgccatatctcgtcaaagtgtgttttatttatttattgttattattttttgaaacagagtcttgctctgtcgcccaggctggagtgcaatggtgtgatctcggctcactgcaacctccgtctcctgggttcaagcgattctcctgccttggcctcccgagtagctgggattacaggcgaatgccaccacgcccggctaatttttgtatttttagtagagatggggtttccctatgttggtcaggctggtctcgaactgacctcgggtgactggcccacgtcagcctcccaaattgctgggattacaggcgtgagtcaccatgcctggccaactattataatattgatattataataatatcacagccagataacggtgactaacgcctgtaatccgaacactttgggaggctgaggcaggcagatcacctgaggtcagttcgagaccagcctggccaacgtggtgaaaccctgtctctaccgaatatacaaaaattagccggagcgtgatggcaggtgcctgtaatctcagctacttgggaggcggaggttgcggtgaactgagatcgtgccactgcagtccaacctgggtgacagagcaagactccatctcaaaagtagtaataataataataataataataatatcacttattgagttttaattttgtgccaggcactgtgctagtacttgcgccatgtgacctcattgactcggaacaacctatgagtaagcaccatctctgtccccaaggaagctgagactcaggaaatggaagtcatctcccagggcccacagcaagggcctggcgaggtctgcgttcaaattctgatcatctgactccaggctttcctgcctcctttgcctcccaaaaactcaaatactttcatctgggatgactccagacagctagatttcaattgtcttctctccttctgagtatgttttattttaaaatcacataaagataactcacttctcaactggagccacggaatcgttagatgtcttggagacttttctagctacctctttgctggactcagacacaggcctgaataattaggtccaaggagctgaactggagccgctcgtggccagaggtcccttcctgggaacagcagtggcggcagcggctgcgctgagcctggcaatttgttcaagagcaggggatgctcaggctgcgctcgcccccttcttatgaacggtttgctttgcgtcttctctgtgccaagggctgccaggcaccagatgcccattttaggaaatcagaaaaataaacagtgtaaataaaacaaaaactccacccaagaaatctgagacagatgctgttttccccaccgtttctccacccccatgctgggtttggagagagtgggccagcatgtttcctacggataagaggccctggggtatttaacctggatggaacctcttctattttccttttgcctggtgctagggggcagaaggcaggggtggtgtccatctggcccagggaggaggatagggcagcctttgtcgccggcatcccctgcagagatgtctcagccagaagtgactccatcctcaggaacgtgtgtcctgttctttgctgggcggcccctccttaccccccattgtttccacagtggggtgtgctagatttatgggcagagttctggttcactctcagccccggacagcagaatgtcccagtagtgcactgatggtgtgtgcgtggggatgtgtggaacaggggatagtgaccccgtgtgcgttatatgcagtgcggcttccagtcgggtgtgtgaagggggtgctcatggccatcgtggaagtgagctcagctggggctggagggtccaggctcactgtatgccactcagcagccttgggagtggggttcatcctcctccccgctcctctcccctcctggtcctgggcagcccaccggagctgcactctgggccatctctcctggtcttaaggaggctgtcatttctgggaggcagatgctggcccttccatccttgcttcctggagatctgcgccgaggtctgcctttctgtctggagggactggccaggaacccctgggttttcctggtggggtttttgttgcttagcagtgagcagagtgagtgggcaccaagaggaggatgctgggtgaggtcacggacatggctggggcaggctgggggtgctggaggtgaattccgcagctgtgcgaccttgggcagtttgcccagccctgggcctcgcttcctcctctatgaaatggggcgggagcacctgcctgctggggttgtgggttgggtgaatcggagctaaggtacagctcacagcctgccgtcagaccctcgcaagcagaagtgggtgtccctgctcagcgtcctccggtccctccttcaaggctcagctttgtcctcatctcctccatgaagcctccctggttactccaggagtcacgacccacaccctctttggagccttgtgtcacacgcatttctcacggtgttgctttccctggaggatgggttcaactaaaattggggcccatctgggggttccctccagcaccagagaagctcaggcttagtagagatgggtaccctgtcaatactagttccgcgaaggatacactgtgctcattctgctgccagttgctgagtctggtgtcctgtagttatggaacatgtgtacaggcctgggctgctggacacgaaggccagatgggcagttcactctgcctccgctctgagcctttagaaacaagctggctgcacccatttccatctggtcacagtttaggagtggggttgtggaatggatggaaggaaggatgagtgggtgggtgggggggtgggtgggtgggtggatggatggatggatgatgggtggatgggttgatggatgggtggattaggtggacaggtgaatggattggtgggtgggtgggtgggtgaagggctgaataggtgggttgggtggatgggtggatggatgtgtggaggggtggtggggtggatggggtccatgggtgaatggatggatggatgggtgaatggagtaaatgagtgggtggatggatggatggatgctgcaagagcctttctggagggttccagggaggaactggcatctttgaccagcagccagcatggtgatcagatacagggaggtgtctgggtctgcctgatcccttatctcactgttggtgggactgggctggttatgtgtccctgaagctctctgaagggtggctgtatggcattgcccaggggacatccccagagtgccgtgctctacagcaatagggtggccgcctgtgctcccagggccgctcctcctggcagcctttcgggtttgcttggcttagcacctcagcaaatctcctcgagttaggacttgcctgccatgagcctctccaacaagcagccccaggccaaggcctgtgtgtgggcagagggagcgcatgccgcgggaggctgcattaatctgaggttctgtttttgttccctcctggggcaaaaggtaaaaatagcctgtcccactccatccccaaatccagcccggctgcacccagccctgggagtgaagggggctgggtcaggactgcccgtgagttgtagaccctggtgtagggaaaccctgattcataagacgggtggacatggaggaaggaggagactccgtccagcagagacacgcttgggtgcagcccagcttggagtctgatggacgtgggctcacctgtgtgcaactctcattcactgtgtggccacagggaagtgacactctgtggagactcagattccttatctgcaaaacaggggtagtagggcttgggggaggatgtgtgtgaaggtttggcccagggcccctccagcagccagacagcagtggctgtcatccctccagcgtccagggttacctgggggagtagggcctctgtccccagatgggccccgtttctggctctggaactcacagcaggagcaaaggcgaggacattcctggtgttaatcatccacccggagggagagcgccagtggccttgtgtgacctttgccctttgtctctgtctttaggaggcacgcggacctccagtggccggctccggaggcttggtgactccagtggcccaggtaggtggctcgctccgctctggccccacccagctcatgggtgtgtttgtgctggggtcccttcattctggtctgggacctgcctccccacctggcttccctggatgagtggggccacttgcccatttcccagggagacgcagtctttgacggctttggactcaggtggcttccaggcctgtcgacgctgccctgctggagatgatccttgtgggggcaggggcagccacccccaggctcagggagcaagcccgtgtgtgcgggacagaggagagaacaggagatagatagggctggatgatttggtttgagatgctgaggggacagatgtgccatggacaggtggctttggccgtgagcctctcggtgttggttcagtatctgtgggctccctgcaaccttgcaggatggaagatgctccaggatagagcagatacgtccggtgttatctaggaggaaataagtgggcctctggcagtggtcactgtgctactccttgtgctttttccatgtgtttggaaattttccacactaaccagtagggaagggaaacagatgcacccatcagagctctggggctggccgtccaggacacgagttacagcttataggcttgaagggactctaccaacactgggtgcagcctgggcaagggagtgggacagagaggtcagggctctgcctccagcccttgccccccagggctgagtctgcgcgtcatcttctccccactgggtgtccctgatctcccctgcctgaccccagtgtggccatgctagtgcctctgtttctgggagcctacgttgttcttggctgtcacttccagcggccaggctgggacaggtgcccatctagtggcttttctatttggagaggatgatgggtcacagcaatgaatggacttacctcccctaggagacgaggagctctgagaagagcagagatggcgtggtcacctgtgcatatgtgctgggggccaactgggtgccagacccctggctgccatcatggtggcagacaggcagggactgtgccttcatgaattagccattctagaggagacaaagttaccaaaggacacggacccggagtcaaatccacacaaatagagcgcctgtggaccagggctgccttcagaacaaggtgagacagccgtcctgccaggacaaggcgcctacgggggcaagggcatgtgcccatctggagccgccacctccatgctctagaccagctccgtctaatagaaccttctgtgatggtgggtctgttctatacatctgcactccgccatcctgtatggtagccgcttagccgcctgggtctattgcacactcaaagtataaatgtttacgtttactttattcactcatttacttgcatagaattatttatttattttaaatggatttccacttatatctacgtgtggctagtggctatgaaactgaacagttccagaccacactggcacctgagacctcagaattctagacccaaagcctgcttctgatcctgagcttgcttctgtggggacagcacagacgcctcctaagtctgccttccagaggtggatgcagtgcccgtggactgtgcaccaccaggcctggacagtggagagggtggctttttacagggagtgggagtggaggggatgccgtgtccacattgagtgcatgtgaggccccttgcagtacaggatgggactgtatgtgggaagaggggggtgatgctctggctggaggcccctgggcagctgcatgattcagcgctgtggttaagaggggctccgcccatcgcagtcatgttgggcactaaccactggacagcccagccgctgctgtgtttctggggagcttttctccggctccgcatctgatctgcctctccatctccttccctctcattggccagcttctggtggaatgggtggggagggtcccccagttcttgtgggggttgcatcttgggaacctggcaccctgggctgcatggacacagcctcccccggcggttgcttccctctgctcagactggctggttctgtgctgtcagcacttggcagccacgatcacagctcagcttggaagcctaaggcataatttgctgaatcccaaagctgcaagctggtgatctgggtttgcgtgggactgcctgctgacacacggggtcctccctctgtgggcctctgtgggctctggcccgagacaccctttcctcatcttcttggcttctttctttctccctgcctcccttttgctaagaccctggtccaggcaggagttcattcctagacgccccagcatctccggcctccccatttgacactccccagacgactgtctgccatcccatcctcccagcccagcttctctgtagatccacatctggccaatctcctatgtctgggactcttgccctccccagaaggacgaaggctcttctcgaggttgtgtttgggactgggccagggatgacatttctggcaaaagcttaaatgacaccatgatcaacgctttggtcagctcacacactttctttccttttaaaaaaaaaatggaattcttagagctacaaaacaaaaatgtaaagaataaggtaataaaacacctgtgtactcaccatcccgcttaagaagtgagacattgcaggtgtagccgcagccctgggtgaccttctccatcctagccccactcctgctgcggtgcccgcccctctggattgggatctggccccgggcaggcacatctgtgctgggcagtggtgtgtctgagaagcctaggtctccttttttttttttttgagatagagtctcgctctatcgcccaggctggagtgcagtggcaccatctcggctcactgcaacctctgcctcctgggttcaagcgattcttctgcctcagcctcctcagtagccaggattacaggcacccgccaccatgtctggctaattttttttgtatttttagtagacacagggtttcaccatgttggtcaggctggtctcatacccctgacctcaggtgatccacctgccttggcctcccaaagtgctgggattataggtgtgagccaccgcatccggcctggtctcctcttgcatacggtcatcagcatcgtgtgactgagcagcctaggtctgtctcctcttgaatgccgtcatcagcatcacatccttggtgcctcactggagtcagtggctgccctgcctgtgcccacaacgtgacggcgtggagacttatccgtgtagatccacgaagccttggttcacttattttggcagctagcgagtgttcctctgtgtggggaggcagagtttgcccgtcccgtggcccactggtgacatcgccgaaggtcttctctgttactagtgctgccgggaacgtgtgtttccccaggtggatttggctgggctgtggagatgcgcttctcagcccttctagatgttaccaccacgccctcccgagtggccttctggtaggctctcccatgttcgctcattttctgtgcctcaggcagccgcctctctgactgagcgtccagcggacttttgccctgtttcccacggtgcacggagcatttcatctcagtggtgcctgagcttccctccctctggccctcagaccccggctgggatccttggagccaactcctctgcctgacatcccgtgtcgctaggtcctgctcttccatcttccaatacctctggggtgtgtggccttttccccagtgcccccatcatcccttctgtcctaggttgaaccgtgtcccccacaaactcatgtccaccaaaaacctcagaatgtgacctgggagttggagatggggtctttgcagatgtaagtagttaaggatcttgagatgaggtcattctggattagggtgggccctaaatccaacaactggtgtccttaaaagaagcagagaggccacagacacaccggggagagccacgtgaaggcaggagcagatgatggagtgacgcagccccaggccagggagcgtctgggaagaggcaaggaaggaccccccccccaccccaccccagagcctccctagggagtgtggccttgctgacaccttgattttggacctctggcctccagcatgggagagaacccgcttccattttttcaagccccacagctgtggtccattatggcagccacaggacactgatgcacctcccacctggccgctgtggatggacgaccccgcccgcaggaagtctccctcaagcactgcaggtgtctctgccctcacaggggacgcctgcacaagtaggtgtgaaaaaagggccctgtgggggcaaggcctgggctggtgctcgctgcctcccttcatcctatgctagttcccatgcctcttccggcaggagtgcctggctccacctggtgaatcagagccaaactctcctgacaattggctgtcacttatttaactgccaccatccccaggagacagaaaatgccagaagggtggggcctgtgcagtgcctcctcgctatttccccagggcaccgtgccacgttgcctcaatgcacagagtagctgctcaaagtgtgtcggacgaacaggtgccccatgcccagccatgcagacaaaagtgtgccacgtggagggagctggtcgtggaagagaccaccagcatcttggctgcccgaggaccttgcccctgggctcttgcaggcacccctagttcattacttcctctctcacccatagctacccactcttcctctatttctctgatatcagccttgccacccacccaggtttgcaagcaggaaatctcagagttgaccttgacctctgcctccccagcacccccaggtctcaacaggctgccaagatctcatcaactcgccctctgcatactgacccttggacaggctgccccggtcacggtcatgtcttggttgggcctccatcatccctccttggaccagcaggtgccatcctccccacccctgccctgctgtggctccttcccctccacggccaacatttagaggacgattaccacttccctccctgtgtgctggggaccgggtgataggatccctccacccgatcatttccattagacctgggccgggtcttcttactcatagagcccttagtttccgcccccaaagcctcgagggtggattcgtgctgccgcccagcctggccctgataccgctttccagcctggagccccctgcttctgcgctcctggctctgagtgctcgggccccccctggatgggttgccacttgtcctctggaaagcagggcttccatgctcctggacctcctagctgactcagtgactttgggccatcttgtcacaccccttctatcagcttggccttggttatttctgtgtcctccatagcctcggaccagagccacggcgggatgctttcctggtgcgtggcaggcagtcaggaaatattgctggactgaccttgataggagatgcttgggagaattgcccaaaaaactagcttaaaatgcaaatattggccttcttttgcgttggctaaagagtagcatttctccgtttgcctcccgggtaagaaattgatggcgaatgcaatgtctctagggaggagaagaaggtgacaaaaagggtctgtataacggggcacacgctaggcatttgtgactatttaagtttaaattataacataaatgcgaaactctttgccttggtagcccttccacattgcaagcgttcactgccacatgtggctgccatattgactacggcagatacagaacattgacatcattgcggagagttctatgggggggcgctggtttagatcatcttcacgttggatccacaaattcattgtttatccagtgaacggttactgggcacctactgagcaagcaggatgaaagacacccgctctcgggggagtcttccgttggctgcagagaagcttaaactcaggggacctggggcaaactctgcaagggcccttggcctctgcacccccagacctccctcgctctgcaggggcagtcgggggccccctctaggaatggagcgccagctccagctcctgtcaggctacagcccagatggttggctgagcacgagcatgtgagagtggaattgggcccaaccgggctgcttctccccgttgtcttggtttccttccacgctgacctggaaggactcctaaagcaacaggcctgcccaggcggtttgcaccagtaaaccctgcagcggccccaagggcagagatagctggattgtatttatttaggaacagccaaagtctgaggcacaataaaaagtggagaaagattccagagaggaatgcagctggcctcagcctgggaatccgtcttgcttgggaggctgtaggcgggccaggctggggccagcctggagggtcttggctggctctgctggcaggtacagtagcagggtcagcaggagggagtccaggacggagctccttcatttttaattcagggaagcaaacttcagtggttgagtctgaggatgagcaggaaatgaatggaaaagtcttttttttttcttttttctttctaggcagggtctttctctgtcccccaggctggagtgcagtggcacaattatagctcactgcagcctcaacctgccaggctcaagggatcctcctgccttagcctcctaagtagctgggactacagttgtgcgccaccatgactggctaattcttaaaagaaatgttttcaggctaggcatggtgacccatgcctgtaatcccagtacttttggagccgaggtgggaggatcacttgagctcaggtgctccagaccagcctgggcaacatgacgagaccccgtcttgactaaaaatacaaaaagttagctgggcgtggtggtacagccctgtagttccagctacccgggaagctgaggctgcagtgagttgtgatcacgtcactgtcctccagcctgggcaaagggagtaaggccctgtttcaaaaaaaaaaattttttttttttttgaggtggagtcttgctctgttgcccaggctggagtgcagtggcatgatcttggctcactgcaatctctgcctcccaggttcaagtgattctcctgcctcagcctcccaagtagctgggattacaggcatgagccactgtgcctggactttttttttttttttttttttttgtagagatgggatttctctatgttgcccaggctggtcttgaactcttggcctcaagtgatcctcccactttggcctcccaaagtgttggaattacaggtgtgagccaccacacccagcaggaaaagtcactttttaaagcgagaggttgtgcgtcctctatagcttggcgctcatcagcatggaggatttactggaacgtgtgttaggtgaggggacatggaagatggcagcaaatccgagcccagagcatcagaaagcatgctttcagccaaagatgcgttctctccacctccgcgcagcacccttccccagtgtgtactcctggagcaaggtggggccgatcctacgaagaccctttcccgaaggcccctgctgcccacatcagtgtcacctggaccgcctgctcccttttctggatggctggaccagccccagggcctcctggcctggtgtggggagcacagtccaccctggggaatgcctggtatgtgtcccctccccactgggtaccaggggatgaagctgtgcttcgtggaaggggacagaggcgctggtgcccaggatggtgcacctggggcggctgaactggacctggctcctactgggcccctgtggagcccagattgttgtgagaaggggtggggaaaggcaggtgatccgcacctttcacttttgtttcacatgggaacaggggcttatcctgcacacatattcagtttggagtatgaatttccatgaagaggaaaatctctattaggctctgatgtcaggattgtccgtgagggccgggccgtgttctggggcaaggacaggagtggagggggcaaccagggaaggcttcctaatggaggaggcatttgatagcatcttgaaaaagaagcagttcctaggccaagccagagactgaagaatgaccacctaacttcttttttttttttttgagatggaatctcgcgctgtcgcccaggctggagtgcagtggcgtgatctaggctcactgcaacctccacctcccaggttcaagcaattctcctgcctcagccttctgaatagctgggattacaggcatgcgccaccatgcccagctaatttttgtatttttagtagagacggggtttcaccatgttggtcaggctggtctggaacccctgaccttgtgatccacctgcctcggcctcccaaagtgctgggattacaggcatgagccactgcacccggccacgaccacctaacttctttctacaagatgccccctggctgacgcaaagcaggttgagtgagtgtgacacttccttcctgtctgtgggttccggcctttccagagcccggccagtgctattggagacaaagtggccttcgctcttccttcccgccctgccaggcccagcctgtgccgctgagccccactttgcaattaagaggagctgtgaaccagtgatgctgatgtcgcagaaaagtggccaggggtctatggggggtgaaggacagggatgccgccctgagaactgtctggaaggggcttttgggtaacagtgcccactccagggtgtgggcaggctggggtggctgggagctgggctcataggctggcacaaccagagtttcccaaagccgtgggcctgagggccctgccttcctgggacagcaacctttggtccaatttgggaaaaggtgggttaaaccaagcccggctccctcactgtaggattactcagtgcgtttagtatgcaaatgtgcctctgaatctaagacaggaccacagaaacctcttcagtgttcctctggagggagggaccgcgggggatccaccgcaggggcctgggtctgcactggcctggtgaagtgcccccttagtgcttacaccatgcgcggtgagaggttggccctcgcctcccccaccctctgctggccttacctcaccacctctgcactcgcctcccagccggctcatgactaactcctgcctcttcagagccaatcggtgctgccaggttttccatttcaagtgatcccccgcctgggccaaaatgtttggattttcaggcacggaggggagatggacctcaggccaaaccatgctgggtaaaactgagggtcaaggctgtgctcagcaagtgctccagccctggccgtcaaacccatagtgtgcacagcgtgcaggaggtggctgggtgaatgaactcagtcatagcccggcccctcactcggggctgttcccaagttcccaccgccagccaggctgggtcagagcctcgtggggccttcctgggcttccctgccccacagcaggagttcgtatggagagtctcgagtgaggttaatgggttttcttcctcttctttttttttttttttaatttgagacagggtctcactctttttacccagccagggtgcagtagtgcaattatagctcacagcagcctcgaactcctggcttcaagcaatccttccgccgcagcctcccaaagtgctgagattacaggcacgtgccaccttgcccagctggggtttctgctttttactttttctcttgtttctaaactcaatacaaagaaagatattacatttataatcagaaaaaccaacaaggaatattatttcaaaattggaaaagggattaaagaaacaaaccaagaaacctctgcgattcctgcccatcggagtcagtggttgttagtggttggcttaacacaatgttttaggaagaaatagaataacagaaagcaactccagtgagctgagccctggctccgtctgtggcgctgcatcagtttcctgcagctgctgtaacgagtggccacaagctggctgggtcacaacaacgcccagccatcctctcacagctctgcaggccacacatccgagatcagggtcaccaggctgaaatcagggtgtccactgggcatagccctctggaggctctagggcaggggttcccagccccgtgtgtcctattaggaactggcctgcacagcaggaggtgagtgactggcaagcgagcgaagcttcatctgtatttacagtcactccccattgctcgcattactgcccaagctctgcctcctgtctgatcagccatggcattggattcttataggagagtgaaccgtattgtgaacggcacatgtgagggatctaggttgcgtgcttcttatgagaatctgatgcctgatgatctgtcaccgtctcccatcaccaccagatgggaccgtctggttgcaggaaaataagctcagggctccaactgattctacattatggtgagttgtataattatctcattatatattataataataatagaaataaagtgcacaatcaatacaacgtgcttgtggccgggtgcagtggctcacacctgtaatcccagagtgaaactctgtctcaaaaaataaaaaataaaggccaggcacagtggcttatgcctgtaatcccagcactttgggaggccaaggctggcggatcacgaggtcaggagttcaagatcagcctggccaatatggtgaaaccccgtttctactaaaaatacaaaaattagccggacacggtggcaggcgtctgtagtcccagcttcttgggaggctgaggcagaagaattgcttgaacccaggtggcggaggttgcagtgaactgagatagtgccactgtactccagcctgggtggcagagcgagactctgtctcaataaaataaaataaaataaaataataaatataatacacttgaatcatctcaaaaccatctccccactccctggtctgtggaaaaattgtcttccctgaaaccgatcccaggtgccaaaaaggttgggggccactgccttcatcgcctgcccctttgagcctctggtggctgtgggtgtcccttggcttgtggctgcatggcccttaccttcaacaccagcatctacagatctctccgggccccatctccacttggccatccctgtctgtgtcaaatctccctctgcccccgtcttgtatgagcaccgagactgcctttagggaccacctagaccatccagggtgctctcgccacagcaagatctgcaactgaatcacagatgcaaaaactcttgttccaaacaaggtcccatttgcaggtctagggattaggacatgctatccctggggccattattcagccttctctcgtgactatgatccctcccttcctccccagcctcccacctcggctgagatgctgtccccacctccctcactgtctggctgcctgtggggctgtcctccaggctctttgggaggaggtggttgcttgatgtctcccagaaggctgggaatggtcctccccaccccccaggaagatgtcctttctgccaaggagattgcatttggggtcctatcccaggcagagagcggacgggactgtggcctgaagtggcacttcagggcctttggctctgtcatctagccgagggctgtgcatgggcctcacctggtcacaggtaactcacctggctctgtggggcagggattgtaaactcagaggcctgcggggtgtgtcgaggtagaggggtgcaaatattgtaaatttgttgggggccttggggagcagcacagactgaaaagtgttttgtctgaagagcagaactgtcttataccagccctgtgcggccaggcaggaaggcttccgtggtgcggccacgcgtcctccctttctcaacagaagctgacagtctggagttttcagagagattgcctgagttctcagccttggcacaaacacacattctctttaaacaggcttgggccaacagaaccagcctccgtgtctcgggtttgaatgaacccttgaggtgaagcttaaagacagagaggatgcccctgattcccaccccagggacccacattgtaaacccccacctgctctgctgagcccttggcctcagcatggaccctgaccatgtgctggtggggaccccccaggtaagtaagcagcctctgaggaccccggatgaacagtggggaacagcactgatcccccagtggggccccgagttcccggagaggaagactcgctccctcccaggggacggctagagactcactgactcatgcgtgtgtggtaggaatcttccaggaagtccccgtcccgttcgccctctctgcctgggcggggacggcaactgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcaggtacgcagacagccccctccccatcggccgccccccactgccctggactcggggctttatttatgcctgggggaataagcatgcaaagggcgcttttgctcatttttcacagaaatatttcttttctttttgacggttccaagctcgtgggatgaactccgtctcagaagctaagctctcctgagtctggcttttatttaaactcggctctcctctctcctggctacttccctttcattttccagtgtgccattcttgcatgtcatggccactgtcaatgctgaggctgttggcgccgaaaccttgggagggtgtgggggacctgcccccctggctcgggtctggggcggcggcgcttggacctggctggtggttggtttgtccactgtgtggtttgttttttgcttccagccaaagtctgtcttcaaggctgcctcggtctcctacctaaaatagcatttctgtgccttcctggcagttgattatagagggggaagctcccggcgctcagaggagcctggcgtgtgtgtgcacgtgtgtgtgcatgtgtgtgcgtgtgtccattcacgctggcagcccccttgccgcaggcacagacccatcagggcgtgaacaggcaaatgaagagaaagggggctcccctgcctttagttcaccccagctttccaggccctccctcccaggcccagcctccttggtcccttcactcacatgcggtgccgtggctgccatctcacgtggccagcgccgtcatcggtaattagcagtgatgacagtttctgccgctcatgccgccctctgagcccagcgctgggagacatggggtggctgagccaagctccaggctttgggtattctgaagtgacctacgggccatggagcgggaggtcgctaagagtgtcaacccctacgtgccttgggccctggtctgttggttgccactatgtgtgtgttggggggtccctgagaggcctgagagagggaggcccatctcggtggctcctctctaggacgtgtggtcccctccaccactgctcccagggccacatctttttttttttttttctttgagacggagtctggctctgttgcccaggctggagtgcagtggcgcgatctcagctcactgcaagctccgcctccctagttcatgccattctcctgcctcagcctcccaagcagctgggactataggcgcccgccatatttttttgtatttttagtagagatggggtttcaccgtgtcaaccaggatggtctcgatctcctgatctcgtgatccgcccgcctcagcctcccaaagtgctgggattacaggcgtgagccacggcgcccggcctcagggccacatcttgattgtcacgttgggactggtggagcgggtgtgtgttgtgccgctgagcacacccagtcgggcacagcaggcggacctcaggagggggccaggggagacggcagaaggcttgggtggcagtgaaactgcatcttatctgtttgagctcgggggctcaggcccgctgggacgggtgggtgtggagcccagcgtcctgctctccgcccagcaggagccgcagggcagggagcgctgagagggaccttcgtcaggcttgcacagtggagccgtcctcggagtgaccaccccaccaggcagcctgggcagaccacagtgggtcccctgcctcctgggccaccagccccaggaggacgtcactccacccgcctggctggcaggggcctcggggagcctcgggttcggccttcactttatagatgatctagccgaggcccagatgggtgaccagcaggggatctgagagctgagcagagaggcgtgggtttgggggtggtgctccctggggagctggaagtgatggcaccctcccaggctcacaaaacacgggcttttcatgaactgaacaaaacactctttgaaagcagccagtgctgtgccccagagaccactctgatccctgctgcccttggctgaggacagcacagccagggatgaagcggggacctcccctcgggctgtgccttgatgaaagatgctttctacaaaatcccattcggatgtgttttcatgtaagaaaacgtacatttttagaaactcagttgtaaactggctgccttccgaatgaacacgacagtcccggagctgtttcccttaatgaggttctcgtcctgggcaaactttagcgctggtctttaattgtcactgaactcccgcacagtccctggggaagtgacttccttcctgtccctgctgggtggccttgagcaagccacttggcagctctgggccgcagttccgtcatctgcaaggtgaggggtgggagcggcacggcccctaggcagcgcccccacctcctgcgggtttctgcgcgtgtcctgagttttgtgggcgcctcttccctcactgaggggctcttcttctctgcagggcatggctcacgccgcgttgtcaggctgcaagccactgcgagagctgctctgatccccaagcatgctctggcctgaggaggagccatggggaggacgctgtgcctgtgtgacagaggcctgcccggcagatgccggcccgctgacttccagacgtggctgtgggtgcctcatgccccactgggctggcgtgtgaggcgtgtccagctcaggctgccctacagctgcccaggaagggtttgtgggagggggtggtcctaccctggtgagtccacggtggtctgccagccccagggaaggcttaggagccccaagacctgccctcttgtccctccctcggcagtgtctggctccggtctggtttgtgaacgggggcctgggtactctcccgccctccctgggggctgtggccttcccctgggaaggtgctggagggtttgtcagcagggccggcatgagtcatggagtggtgactggccgctgaggcatggaaggccactccttccagccaagggtcggagctttttttttgttctggaacggctttgtggcttttacaaattaagcagttttatcttgttccaagagcttgtatttcagcagggagagagtctccaagaagggaactttccactggggagctctgttgggctgggaggctaggaacaggccacgagggagggctgcaggcaggggaagtggccgtctgtgcatggtcatgaatgcaggcccggggtcctggagggggcttggccacgctgtcgctggacgtctgtccccaccagggtccatctgatgcagtacggcacagggtaaagcccagctcctcttacggggttcctgggtcatcagtgggcggggaaccgaggcctcctggagggcggtgcctcagccctcacccctccctcctgtccctcgctgtgctgtccccgatggcctctgccatcccctgggagttcttacccctggacgctcggtgcctgtccggtctcaacctctccagctctgcttttccatctccgaggtgagaggcctggcctgacgcgctctgcacccgcttcctgcccagccccgtgggaactctggtccctgtagtggtttcctggggctgccatcaccaagtgccacaaactgggtggctcaaaacaccagacatttcttctctcgccgttctggaggccagaagtccgaaatcacggcatcagcaggcctggttctttccggaggctccgagggggagcctgcttctcgcctctggcagcttctggcggctcccgaaacccttggcgttccttggctcgtggccacaccactcgacctctgcctccgttgtcacggggcctccttctgtgccctaaatctccccctgtctgtctctcatacggacagtctttctcggatttagggcccactgggtaacccaaaatggtcccatctcaagatccttaacttcataacgtctgcaaagaccctttttccaaataggccatgttcataggctctggggtggatgtaaattttaggggccacctttcatccccctgttgtccccgtgtgtctggatgcacagcatggttccatgtcccagactccttgctggacccctctggccctttggggtggcctttggccttttccactcgtttctgtgctcctggtgaggtgtcggggtcgggcttagcccctgcaggaattctggggacagcatggagccggcaactccccaccaggcgtcttcctacctgcccagagctcatggttgtgaggggtctctccttgtggttttgatttgcaattccccagtggttagtgatgttgagcatcttttcgtgtttattgctcatttgcacatattcttgcagaaatgtctgtccaagtcctttacctgtgtttgatttggatgattgttgttgctgagtgttaggagatctgtagattaatatccagatactaatcccatatctgacctatgatttgctgccattccatggattgccttctccccacgttgttagtgccctttgatatgcaatttttttttttttttttgagatggagtctgactctgttgcccaggctggagtgcagtggcatgatcttggctcactgcaacctccgcctccctggttccagcgattttcctgcctcagcctcctgagtagttgggattacaggcacccgccaccacacccagctaatttttgtatttttagtagagacggggtttcactgtgttgactaagttggtctcgaactcctgacctcaagtaatccacccgtctcggcctcccaaagtgccggagttacaggcgtgagtcaccgcacccaggctgatatgcaaatattttaaacttctatgacgttccactttatctatttgttcttctgttgcctgtgcttttggcgccatatccaagaaatcattgccaaatgcaacgtcaggaagcttttcccctgtgttttcttctaagagttttgtggttttagctcttgagtttaggtctttgatgcaagttgagttgatttttgcatgtggtgtaagggctggtccagcctcatgctctgggctcttgattcacttctcttcttttctcacgcccagctggttccgctgggtggcggggaggagtggggaagtcccgggctgggcctgcactcgatcatcccctctcaggccagccagggagtctcagctcctgcccaggacctggctggacgtgctccctaccgggaaagcctgggccgtctttctaggctgatggcagggccagcccggggcgtcctgaggcctgccctgcggacatgccccttgttctaggtggtgtggctgcccggcctgcgtgtgagaccagctgtctgtgcttcaggccatggaggctgagtgtttccagcctgtccccttgctcggctctccctctggggaagcccctgcagcccattctctgcctccgcttctgccatctgtgcctttgtctgcttcctgtttggaggtggtcatccctggggccacccctcatgatctggacacaagtctccatcctgaagccaccacccaaacccctgtgcctcaaacccctcccacccaccacatgggtttccactgtgaccaactcagcagctgatgaagcttcccttggggctctcctagcaacggggagctggctttcccggaggcctggcctctccctaagtggaagtggggcgtgagggtgtcagcctttttctgctgcctggtgctctaggttggcttgtcacccctggaagcacttgccatccttatacagcaccccacacccacctccccgcctcctaccccttcttccaaggggtcatctctgcttccctccccacccaacctcacccatgtggtccgcccagcaacctttgacccccaacatgacaaaataaacctcccttgccggtcactcattcattcattcagcattgggtgctccctgtggacttggcgctggggtcccgtggaggacaaagccagacacagtccttgccctcatgggactgcacaagtgcaagaccacatcagtaaacgtgaaacacaggaagtgacaggtgtgacaaaggggaccagtggcaggacagaacctgcggttcgtaggaccaggtcaggagggctgcctcggggggacaccttcgggctgagcgcagaaggatgaggggagtaaaccaggctcaaacccagcaggcagaggcgatcgctgcaggcaaccggcaatgtgttcaaaggccctggggcgcggggggctgaggccggcagcacggcaggaagtaagactggggttgaaagagactgactgtcatgttgtgaaatatacacttggttttcatctccatttcctggcacacaactcctaaaatccttggaatctccaaagtgatgtctttttggatgctcatgattgacagaccagctggcagcttcaggatggttcccagggaagaccaggtagaatcacaaggttcagcaccaccccgcaacctccaggtaggggagaggggctgaaggttaagcagatcatcagcggccaatgattgaatcaatcatgccttcgtaatgaggcctccgtgaacactcagaaggatggggttccgggagcttctggatggatgagcatgtggaggctcctggagggtggagcgcctggggagcacatggaagctctgcgtccctcccccataccttgccctacacatctcttcccctgtatcctttgtaatatcctttataataaactagtaaattccatgagccccaggaacatgtgtaaaagaaaaaaaaaagaataaaccatagctgctgtagcaagttaatcctaccagcactggctctcatctgccgaccttacctctggcaatgcctccctctcctgggctcctgggacccctccggccccaccacccctcctgtagtggtctcgctggctgctgccctcaggttagtttatttttacccggcctgctcccaccaggggctgaggcctccttgctcactccagcttcctggcccgtctcttgctctgggcacccccccactccgaacggccagagcttctgaagccgctcgctgtgtgcccccgcctggccccatgcatcccgcacggtgctccccagggtctcccactggcaagggcattggcatagattctggggctgccttggttcaagcccaccctgacttggagcctgagggtccctgagggggtcctgaaggccagggcaggcaaggctggcatgctctgggcagtgggggctgggtatgggaggggatcgtgggtggggagattcctcttaaccagcggcccacgtttggagactgatttgggctccaggctacgccttgaaattgggacagagagtggcgcagatctcagcccggagactccctctgcctgtggacgccctcatacctccatccgtggagccaccctcctctttttttttctaaatggggaaactctgacttgaacactgaataaacaacacaccctcgaaatcagcgaagaggcactggctctgaaactttgccatgaaagcttgaaaatgctctttggaccgatttgctggaacagacgggtgtgatggggctgcggggtttcaggtggcaggaggcgtccccgtgcctagggcatcccgatgctcagagtttccccgtgcccagtgtgtccctgtatccagggcatccccatgcccagggtgtccccgtgcctagtgtgtccctgtatccagggcatccccatgcccagggtttccccgtgcccagggtgtccctgtatccagagcatccccatgcccagggtgtccccgtacccagggtgtccccgttcccagggcgtcctgtgcccagggtgtccccgtgcccagtgtgtccctgtatccagggcgtccccatgcccagggtgtccccatgcccaggcactgcctctccccactttcctaatctccctccaccaacaggtgtcagctgtgaaatgcctgctgtgtgtgtcctttggttgagttcatcttgtgctcttaagttcctgttagacacaggcaggctgctttagttcttctggcaaatgttttgttgttgttgtttgatacggggtctcactccgtcacccaggctggagtgcagtggcgccatctcgcctcactgcaacctccgcctcccaggttcaagcgattctcctgcctcagcctcccaaatagctgggatgacaggcgtccgccaccatgcctggttaatttttgtatttttagtagagatggggtttcaccatgttggtcaggctggtcccgatctcctgacctcaagtgatccacccagcttggcctcccaaagtgctgggattacaggcatgagccaccgtgcctggcccgtctggtgaatgtttattgaggcctactatgtgcagcccctctcttaggtgcttggcctgtaatgaggagcaacaaagacacagtcgctggtcgcttgttacttaacagttggaactgagaggcagtccacaaatgagcaaatccataggtggttttagatgaggactgtgaagaagctaagaacaggttgctgggggtgcatatctgtgtgtgtggcgaggggattaatggaagccctttctgagtggtgacactgagctgaagctgtaatgaccagaaggacccagccaggccaaaatccaagggaagagcaacctggcaaaggaaacagcaggtgtgaaggcccgaggctggagcctggggaaggtgggagtggctggagtgtgttttcagagacgggccatggtgacaccaatgcgacaggcagggccaggtcgtgccgggccttggaggccctggtgagggcttgattttattctcactatggtgggacctcagtgccctgtggctgctgagaatggccaggggcaggcagggaggcctgctagggaggaggctgctgcaggccctgcagctggagagggaggatcaggatctctttagagaggaagttggagagggaggatctctttgattgctggatggacccacctgcctggctgcccccgtcagcatccagcagaggccactggatgctgacaggtggccggccctgcccagccttgcactgccctgtgctgccctggtggctgccggctttaggaggagcgcttttggtgtctgagcccagtggtcctggctgtggtttggtacacttggccgtgggtgaggccaaggtggtttggatcctgggaaggttgggtacctggcagcctcaaggcaggagctggggtgttggaggaggaagcacgctcatccctcgttccttcctgtttcgtgggatgctgagtctctgggcagggacatggtgagccctggtgtgatgcacttaacacctgctggtgcccccatccccaagcaggaaccctggtgcctggtgcctgaggactgctgtccaccgtcccaccatccttcaggtttcttcccagcctctgactcggggcaaggttcagatatccagaacattcttggctggctcttggagctggggtgaggcagaacctccctcccatatttacagcaccagccaaggcttcggggtttggacaccatccctgggaggggtgagcaggacaagtgaggtctccagacttggggtggcttcggactggccaggcaggtgggtgggggctgcagtccatgcccccgctccaggcaacacagtcgagctgcagcccccgctccatccccagctggggctccctgtgctcaccttctgcttccttcctctccctcggaatggggggtggacactccaagactagcctcccagccactctccctgcctcctgcctcctctccttcgggacagacccctgtgatcgctgggtgttcctgatgctctgtcccctctgcgtcctgtgccgtgggtgagagagggcttcggggggacttccccctcttggagcacctgctgctccgggtgcctctgggggcgggcccccacctcacattgtggagctggtgtaggaaggaaggtgccgggagccagctccaattcacgtgctggctgtggccctcaaggtgtggatggcaggaggtggtgagacagggactcattgatcatgggactgacaccccctcatgttgatgtgggccctgagccataatctcaccagctcctgagttttggcgctgctcttggcgatggcgtggactcagccaggctctcgggcagcctttcctggattcttcctccgttctcccctgggcagtgtttctgttcacctggaaaggatgggtaggacttggagacaacagggattcaaagaagtcgggagtgggggcacctgtgcagctcaccctgcagaacagacaatttggttaaagcctaaagcctgctgtcaggagcctcgcttgcctctcagagagcacatggcttgaccatcacggggactgggggagaggcacaggcatgcctgtccggcagcagaagggaaccccgggcctgggcctctccattctgtggcgttgtctttcctcagagttgcactgtctccttcactgtccctgcctggccccagtgctcatgtggcttgtggccctcagtctgggcttggtctcccgcaattcaccctgcccagccccacacagcttgtccctccagctgggaatcggagctcacctggagtcccaggcagcagattcgatgcagtgatgcagggctgtcagccatgccagcaggccctgctgctcacagagggatgggtattgctgttgacaataattaaagaactacggcttcaggctgggtacagtggctcacacctgcaatcccagaactttgggaggccgaggcaggagaatcaattgaatccaggagttccagaccaggctgggcaacatagcaaggctttgtctttacaaaaaataaaaaataataataataataaaaactacagcttcagaatgattgacttcagcatgtttataaagtcaagggtcttcagtgtcctgggcctatgtcactgcgtcagagggagagaggaagaggctggggtgatgggcactggggcttatgctcctcctggaatgggtggtcttggactgtgcctgtgtgatatgtttgtcgagcgggggcggtgtccactgaggactggatgttgaggtgtgggtggggggaggttatgaagcactgggcatttcccgtgcaccagtgccccgagattgcagagaggggacccgcccagcctgggcagggaggcgggtggcagcgaggaaggggagaggaactcgggtgcagaaagcctttcctccagcaggtggcgccgcaagctctcgagagtccagctcctgcggggtttgcattttcactgaatttgtgggcagaggctgcctgggtgtagtttccgccaactgtgactgctcactgcgggcgaggggaagtggagtgcagagaatgcaccggagggcagatgaccagcccccgcacaggcacgggggtgcctccttccccgcacaggcacggggggcccgagcccttggggttcctgtcctaactgggcggggaaagggagggttggaagctgagttagggggaaagggggtggtctcctgccatctcttttattttatttttcctatttttggttgataggtttcaatcttttttacatttttccaactttttgccgtaaaacttttcaaacatagaaaagatgaaagagggctgagtgtggtggctcatgactgtaatcccagcactttgggaggttgaggtaggaggatcacttgagcccaggagttcaagaccagcccgggcaatatagtgagatcccatctctataaaggatacaaaaaattagtcaggcatggtggtgcaggcttggagtcccagctactcggaaggttgaggtgagaggattgcttgaacctgggaggttgaggctgcagtgagctgggattgtgccaatgcactccagcctgggcgacagaacaaaaccctgtctcaaaaacaaaacaaaacaaaaccacaaaaaagaaaccatgaaagattctaaagtaaacacccatgcacctaccacctagattccacagcaaccattttgctgtttgcttcaccacaaatccctctggccaccagcatccacgctggttttgatgcacttaaaataagctgcagaaatcagcacacaacatcctgtcaacacctcagtttgcatttcattaactagagtccggcatttgtctgtgattatttttgtttttctttgaagtaaaatgtatataccctgagatgcacaggtgtgaaacgttccgttctttgaattttaacaaaggtatccacgtgtatcccagcctgaccagaacatagaacatcactatcaccccagtaagttcctcatgcccctccaggtgcatcacagtccccaccttccccagggcaaccacaattgtgctttttttccaccacgaaataattttgccagtttgagtgtttcttagagctacccatgttgctgcaggtgccagcgatttgttctgttttattgctgagtaacgtccactgtgtgaacattctgtgggtttttagtcattctcttgttgaaagacccctggctgtttccatctggaggctcttatgagtaaacctgttacgctggttcttcttgtacaagtttttctgtgcatatgggcgttcatttattctgtagaaacacctagagtaggtatagggtaggtatacatttagttttataagaaactgccagatcttttcccaaagtggcccttccatttcacactcccaccagcaatggatacgagttctagttgctccacatcctggccaacatttggtgctgtcactctgtgaaatcttagtcattctggtgggcgtgtagtggtatcatctcattatggctttaatttgctttggcctgatgactaatgcggttgagcacattttcatgattggctcttcatatatttttcctttgtgaaatgtcttttcaaatctgttgctcattttaaaattgggttgcttgactttttcttctggatactgatcttttgtcagatacgtgttttacaaatattttattccagtctgtggcttgcctgttcattttctttcctttttcaagaacaaggtctcgctgtattgcccaagcaggtctgaaactcctgggctcaagctgtcctcctgcctctgcctccccaagagccggttttacaggcatgagccaccatgcccggcctgttcattttcttagtggtattttccaataagcaaaagtgtgtcactttaatttttatgaagtctaatttaacaaactcctttctttgtggttctctctctgtgttctttgtaagaaacctttgcctaccctgccaaattgcaaagatatttatgttttcctttagaaggcttagagttatatagcttttatgaattaacttttgcatatggtgtgaggtagagggtcagggttcattttgttgtcgttttatgtgtttattcagttgttccaaacttcatttttttttaaagcttttattttgtattttcttggtgacttatgaggtcgcacaattttccaagatccttgttggtcatttacgtattttcctttgtaaaattatctgtccacgtcttacttctttttaaaattatgttgtttcaagatcgagtgatttctgaagccttcattttataatgcttgaaagaatgaacaccttgttccccagctacaggcttctgctctttgtcctgcagctgcacagtggggtaagacttgggttttgttttgttgctgctttgttgtttcttcatttgactgtttccccatgggtctcatttaaaaaaaaaattggccgggcacagtggctcacgcctgtaatcccagcactttgggaggccgaggcgggcagatcacgaggtcaggagatcaagaccatcctggctaacacggtgaaaccccatctctactaaaaatacaaaaaattagccgggcgtggtggcgggcgcctgtagtcccagataatcgggaggccgaggcaggaaaatggtgtgaacctgggaggcggagcttgcagtgagccgagattgcaccactgcactccagcctaggtgacagagcaagactctgtctcaaaaaaaaaaaaaaaaaaaaatgttgtttcatatgttttttatatattctggatataagtcctttatcagatatatgtatcataagtttttttttccacattgctcctttccttttggttttcttaatgatgttatttaatgagcaagagtattttgttttcataaagtccaatttatcaactttttccagtttcgatttatgatttttgtgacctatggaggaaatctttgcctacactaaggtcaaaagaagttctcttattttctagaaattttatagttgtatattctatgattccttttattttttaattttttaaatttttacattttttaacctattatagccgtcaggatgttgtatgatccattttaaatcagtttttgtatttggtttgaggtcagggttaattcttgtttttctatactcatatccagttctagcaccgtttgttgaaaagacataccttactctattgaattacctgacacctttgctaaaaatcattgactgtatatgtggccctatattagtatatgtacgtatatacatgtaggccctgtgttgactgtatgtgtggtcctatattagtatatgtacgtatatacatattggccctatgttgactgtatatgtggtcctgtattagtatatacatatcagccctatattgactgtatatgtggtcctgtattagtatatgtacatatatacatgtaggccctatgttgactgtatatgtggtcctatattagtatatgtacatttatacatgtaggccctgtgttgactgtatatgtggtcctgtattagtatatgtacatatatacatataggccccgtgttgactgtatatgtggtcctgtattagtatatgtacatatatacatgtaggccccatgttgactgtatatgtggtcctgtattagtatatgtacatatatacatataggccccgtgttgactgtatatgtggtcctgtattagtatatgtacatatatacatgtaggccccatgttgactgtatatgtggtcttgtattagtatatgtacatatatacatgtaggccctatgttgactgtatatgtagtcctatattagtatatgtacatatatacatgtaggccctatgttgactgtatatgtagtcctatattagtatatgtacatatatacatgtaggccccatgttgactgtatatgtggtcctgtattagtatatgtacatatatacatgtaggccctatgttgactgtatatgtggtcctgtattagtatatgtacatatatacatgtaggccctatgttgactgtatatgtggtcctgtattagtatatgtacatatatacatgtaggccctatgttgactgtatatgtggtcctgtattagtatatgtacatatatacatgtaggccctatgttgactgtatatatatatgtggtcctgtattagtatatgtacatatatacatgtaggccccgtgttgactgtatatgtggtcctgtattagtatatgtacatatatacatgtaggtcctatgttgactgtatatgtggtcctatattagtatatgtactgtatacatgtaggtcctatgttgactgtatatgtggtcctatattagtatatgtactgtatacatgtaggccctgtgttgagacactattgtgttttcttgatattttgtccattcctttgctgatgccacatcttgattaatgtggctttacagtaagtcttaatataaagtctctcaaatatctaaaatattactttgaatattctaggtcctttgagtttccttataaatttaagaagtagcttgttgatgtctacaaaaatgcagtgtgaattttggttgagattgtgttgaatctgtagatcaattaaggaagaattggcattttaacaatattgagtcttttgtatagatggtatatctccgttttaaaggtccttttgtatttcttttatttctctactgaaaaaaaatctctacagaattacattgttttgtagttttcaagaaaaagatcttgcatgccatttgttaaatttattcctaagaattttacttttggcactattttaagctgaaatagattttaaatttcatttttaattatttgctgctagtatgtaaaaatacaatagatttttgtatgtaaatcttatatcctatgatcttttccaaagtcatttattactctggtaatggttttgtaggtcttttaggatttaaatacatagttttacttctttctgatcttgatgccttgtttttttttcttgctttattgcactggttagagctgccagttcagtattgaatagtagtgattagtggacatccttgcctgtgccaaacttataatgttaactttagatttgtcatatatgacctttgtcagattgaggaaattcccttctattcttaatttgctgaaattttttaacatgaatgggtatgattttagtaaatgctttttctgcatctatggaaatgatcattgttttgtcttttattcgtttaataggataaattacaatgattgatttttgccccccgttttttttttttttttttttaaagaaacagagtctcactcttgcccaggctgtagcacagtggtgccatcgtagctcactgcagcctgaactcctggacttaagcaatcctcccacctcagcctcctaagtagcagggactataggcacatgccaccatgccaagctaatttttaatttttaaaattttttgtacagatggggtctcattgtgttgctcaggctggtctgcaattcttgagcttaagcaatactcccacctctgcctcccaaagtgctgagattacaggtgtgagccactgtgcaggcctgattttttaatattgaaccaaccttgcatttctggaagaagtccaacttgcttatgagatatcatcctttttatatattgctaaatttgatttgcccagtttttaaggatttttgcgtgttgattcatgagggatattggtgtggtattttctttgtttgttagtttgtttcggtaatgtctttgtcagcctcattttggcttcataaaattagtttggaagtgttcccttctctttgttttctgtgttttcataaggttgatgttgtttcttccttaaatgtttgatagaatccaccaagaaaaccgtctggacctagaattttctactaggaaaggtgattgtttgtttttaatcacaaattcaatttaatgtatagaaagagttattcaggtttttttacttccccttgtcttacttttggtaagttgtactttgaaggaatttgtccctttcaggtaagttgttgaatttactcatttaaagttgttcgtaatacaagcatacctagggtttgcttccagacctcggcaataaagcaaatattgcaataaagcacgtcacacaaactttttggtttcccagtacatataaaagttatgtttaggccaggcatggtggctcatgcctgtaatcctagccctttgggaggccaaggtgggcggatcatttgaggttaggagtttgagaacagcctggccaacatggtgaaacctcatctctattagaaatacaaaaattagctgggtgtggtggcacatgcctgtagtcccagctgcttgggaggctgaggtgggagaattgctcgaacctgggaggtggaggttgcggtgagctgagatcacaccactgtactccagactgggtgacagggcgagactccatctcaaaaaaaaaagaaaaaagttatgtttacactatactatagtctattaaagtgtataagatcattatgtctttttgctaaaaaatgctaataatcatctgagccttcagcaagccataatctttttcttggtagaaggtctgcctcaatgttgatggctgctgaccaggtggtggttgctgaaagttgaaggtagctgtggcagcagtttctttgtttcttttttctttttctttttttttgagacagagtcttgctctattgcccaggctggagtgcagtggcacgatttcagctcactgcaacctctgcctcccgggttcaagcaattctcctgcctcagcctcccgagtagctgggactacaggtgcctgccaccacgcctggctaatttttgtatttttagtagagacagggtttcaccttgttggccaggctggtctcaaactcctgacctcaggtgatccacctgccttggcctcccaaagtgctgggattacaggcgtgagccactgcacctggccggcagtttcttaactgaagtttttgacatgggttgactctttctttcatgaaagatttttctgtggcacgcattatgtttgatagcatcttacccacaatagagcttccttcaaaattagagtcaattctttcaaccctggccacggattgatcaaataagttgatgtaatattctaaatcttttgttgtcatttcaacaatgttcacagcatcttcgcctggagtagatcccatctccaggaaccactttgtctgctcatccataagaagcaactcctcatctgttcaagtttgatcatgggattgcagcaatccagtcccatctccaggctccacttctaattctagttctctgctatttccaccacatctgcagtgacttcctctgctgaagtcttaaaccgctcatccatgagggttggaatcaacttcttccaaactcctgttaatgttgatatttcaacctcttcttgtgaatcacaagtgttcttaatggcatctagaatggggaatcctttccagaaggttttcaatttactttgcccagatccattagaggaatcactaactatggcagatactgctttataaaatatatttcttaaataataagacttgaaaatcaaatttatcccttctccatgggctgcagaatgggtgttacattagcaggcatgaaaacaacattcatctttacatacatctccgtcagagctcttgggtcacaaggtgcattgtcaatgagcaataatattttgaaaggattcttttttcctgagcagtaggtctcaatgatttttttttttttttgatggagtctcgctgtgtcacccagaatggaatgcggtggcatgatctcggctcattgtaacctctgcctcccgggttcaagtgattcttgtgcctcagcctcctgagtagttgggattacaggcacacaccaccatgcttggctagtttttgtattttttgtagaaacagggtttcaccatgttggccaggctggtctcgaactcctgacctcaggtgatccacctgcctcagcctctcaaagcattgggactacaggcatgagccactgcaccgggccctatttgttttttttttgttgttgttttttaattgagacagagtctcgctttgttgcctagactggagtgcagcagcgctatctcagctcaccgcagcctccgcctcccaggttcaagtgattctcctgcctcagcctcctgagtagctgggactgcaggtgtgcactaccatgcctggctaatttttgtatttttaatagagatgaggtttcaccaccatgttggccaggctggtcttgaactcctgaactcaggtgatttgcctgccttggcctcccaaaatgctgggattacagctgtgagccaccgtgcttggcccttttttgtttttttgttttttttcaaattgagacagagtctccctctgttgcccaggctggagtacagtggcacgatctcggctcactgcaacctccgcctcctgggctcaagcggttctcctgcctcagcctcccaagtagctggaattacaggcgtgtgacaccatgcctgaataatttttgtatttttagtagagatgcggtttcaccatgttggccaggctggtctcgaactcctgacctcaagtgatccccccgccccagccttcaaaagtgctgggattacaggcgtgagttgccgcaccaggcctcaatgggtttttaatattcagtaaaccatgctgtaaacagatgtgctgtcaagtagggcctgttattccatttctgaagcatagacagaatagatttggcagaattcttaagggccctaggatttttggaacggtcaatgagtattggctttaacttacggtcaacagctgcgttagcctctcatgagagtcagcctgtcctttgaagctttaaagacaggcattgacttctcccctctagctatgaaaatcctagatgacatcttcttccagtagaaggtgggacatctatgctgaaattctgttgcttagtgtagccaccttcatcagtgctctgagctagatcttctgggtaacttgctgccgcttctccatcagcacctgctgcttcaccttgcacttttacattatagagatggcttctttccttaaacttcatgacctgacctctgctagcctcaaactttccttctccagcttcctcacttctcttagccttcataccattgaagagagttagggctttgccctggattaggcttttgtttaagggaatgttgtggctgatttgatcttctatccagaccactcaaactttcttcatatcagcattaaggctgttttgctttcttcttcttcatgtgtgcactggaatcgcacttttaatttctttcaataactttttcttggcattcacaacttggctagctatttggcataagagatctcacttttgcctgtcttggctttcgacacgccttcctcactcagcttaatcatttctagcttttgatttaaagtgagagacgggtgactcttcctttcacttgaacacttagaggccattgtagggttattaattggcctaatttcaatattgttgagtctcagggaatagggatgcctgagcagagggagagagagcggggaacagccagtcagtggagcagtcagaacatacaacgtttattgaataagttcactgtcttatctggatgtggctcgtcatgccccaaaaacaactgcaataatggcattgaagatcactgatcactgggcgcggtggcccatgcctgtaatcccagcactttgggaggccgaggcaggtggatcacctgaggtcaggagtttgagaccagcctggccaacatggtgaaacctcgtctctactaaaaataccaaaattagccaggcgtggtggcgggtgcctgtagtcccagctactggggaagctggggcagaagagtcgcttgaacctgggaggtggaggttgcagtgagccgagatcacaccactgcactccactgcactccagcctgggcaacagagcgagactccatctcaaaaaaaaaaaaaaagggccgggcgcagtggctcacgcctgtaatcccagcactttgggaggccgaggcgggcagatcatgaggtcaggggattgagaccatcctggctaacacgatgaaaccccgtctctactaaagatacgaaaaaaatagccgggcgtggtggtgggtgcctgtagtcccagctactcgggaggctgaggcaggagaatggcgtgaacccgggaggcggagcttgcagtgagccgagatcgcgccgctgcactccagacagagcaagactctgtctcaaaaaaaaaaaaacaaagaaagaaaaaagaaaaaagagatcacagatcaccatagcagatataataataatgaaaaagtttgaactatttcaagaatcatcaaactcctacacagagacacagtgttaacatgttgttggaaaaatggtgccagcagacttacttgatgcagggctgccacgaaccttcaatttgtaaaaagtgcagtatctgtgaagcacaatgaaatgaggtgtgcctgtgttccttgtcactgtaatgtcggtaggatccgtaaggaaaacacttcattccttttattgtgactttatgttcgccatctccctctcatcagcagcctggctaggaggttatcaatctagatctttttaaagaaccagcattggactccccttttctggtgtccatttccttgagtttctctgttatcttcattacttccttccttgtacttgcttcagcgcattagtcagggcccagtcaggaaacaaaaaccacaccggcaatttgaatagcaacttgtaatataaagtgttcttaactgtaagaggtagttaactattaaagggatcacaaaggggtgacattgtgatataagaaagatgtatttgggctgggctcggtgcagtggctcatgtttgtaatcccagcactttgggaggctgaggcaggcggatcccttgagctcaggagtttgagaccagcctgggcaacatggtgaaacctcatgtctaccaaaaatacaaaaaattatcctggcgtggcggtgtgtgcctgcggttccagctacttgggaggttgaggtgagaggatagtttgagcccgggaaggcagacgttgtggtgagccgagattgcactactgcactccagcctggatgacagagggagactctgtctcaaaaatcaatgtatctgtctgtctgtctgtctatctatctatctatctatctatctatctatctatctagtctctgtcccccaactttgtttggcatgtagctcctaaaactcttgaaatctccaaagtgatgggtgtctttttgtttgctaaggaggcgactggtggctggaggctcctggacagcctggggataagggctggttgccaggggacccagccttgtgattagaaggctagaacttgcagcctttcccatccacctcctgcgaggcaagaggggatgaaggttgagttgatcatcaatggccaaagatttcatgtcatgcttatgtagtgaagcctccctgaaaacccaaaaggatgaggtttgtagagtttcaggttgttgaatacctgcaggtgctgggagggcagtgtaccctcccgtggaagctccatgccgcttccttcatacctttcttatgcatctcttccagttggctgttcatttgtatcctttgaaatatcatttgtaataagtcagcaattttaagtaaactgatttcctgggttctgtgagtcactcaagcaaattattgaacctgagaagggagttgtgaagacctcaaatttgtagccaagtcagacagaagttatgggtaacctggtgtcttaccacttgcgactgatctctgaagttgagggcagtcttgtgagatggaacccttaacctatgggatctgcactaactctggttggtgtcagaattgaactgaattgcaggacacccagttggggactgctgagtattggagaattgcttgggggtcggcgggaggaaaccacacatctggtgtcagagctgaagcactgagtgttgtgaatgagagtggagagatagagtttgttttgccttatgcaagaggactctaaggagtatagaaagagcaaatatgagaagcagctactttagaagaaaacataggaggaaagcttcgtgacattggagttggcaatgctttcttggatgtgacaccgaaaatacaacaaaagaaataaatgataaattggacttcaccaaaacttaaaacttttgtgcatcaaggaatactaccaatggcgtgaaaaggaaatccacagaatggaagaaagtatttgaaaatcgtatatccgataaaggactagtatccagaatatataaagaactcctacaactaagccacaaaacaaaaaaaaacaacccagtgaacagacatttttccacagaagacataccaatggccaagaagcacaggaagagatgcgcagtgtcactaatcatcagggaaatgaaaatcaaagccacaataaaatatgatttcacaccctttaaggtggctgttagccaaaacatggataacagcaagtgttggcaaggatatggagaaattggagccccgtgcactgctggtgggaatgtaaaatggtgcagctgctgtggaaaagatataacaattgctcaaaaaattaaactcagaatgaccataacatccagtgattccacttctagatgtatactccaaagaactgacagcagggacttgaacaggtgtgctacattcttgtttgtagcagcacttttcccataaccaaaagatgcaggcaacccaggtgtccaccagcggatgaatgaacagacaaaatgtggtccatctgtacagtggaatattattctgccttaaaaaggaaggagaggccaggtgtggtggctcacgcctgtaatcccagcgctttggaaggccgaggtgggcagatcacttgaggtcaggagtttgagactagcctggccagcatggcgaaaccctgtctctgctaaaaatacaaaaattagccaggcatgggggcatgtgcctgtaatcccagctactagggaggctgaggcaggagaatcgcttgaactagggaggtggaggttgcagtgagccgagaccatgccactgcactccagcttgggcgacagagcaagactgcctcaaaaaaaaaaaaaaaaaaaaaaaaaaaggagattctgacacatgctatagcatagatgagccttgaagacatgctaagtgacagaagccagacatgaaaagacaaatactgtatgatttcacttttatgaggtccctagagtagtcaaattcagagagacagaaagtgggatggaggttgccagaggctgggggaagggagaatgaatgggaagttggtgtttaatggggatagaattgcagtttgggaagatgagatggatggtggtgatggttacacaacagtgtgaatgtgcttcatgccaccaaactgcacacctgaaaatggttaaaatggtaaattttctgtgatggatactttaaggcatgtatgcaaacacacagaagcagttactaccactggggttgatggaaaagaaaccaagaactcggagcgtcctccacaccttgccacgtcttacgttcaggccttgttggagagtgtgtgactgccacagaaacctgcagcctactggtaacaaaaaggttcttgccagaaggtgtagaaagagtggatctgcaggatcagcttactgggtagccgagaaacctactagagggtatgggtgggcaggagctgggtgtctgagaagtttgctgaggtcccattgggctagagctggggtgctggagaaactcagtacagagcaggccccactgggcacacgccactggcagctgtgccttcagaggaaaaagagaccctggaaccaggaagagaagctgctacctcagcaaggcctggcagctccccacagtgttgtcccctgtggatagagcctgacatgactgtatttggccaaggagaaagactcataaggcctcggtccagtatcacggagcggggcctggcaggatgtatgcagagttaagaggcaatacatgggtaactggcatatttttccagattctttgttttttttgttgttttgttttgttttgttttgttttgttttgttttgagagagcatcctgctctgttgcccaggctggagtgcagtggcatgatctaggctcactgcaacctccacctcccgggttcaagccattctcctgcctcagccttctaagtagctggagatgcccaccatgcccagctaatttttgtatttttagtagagacagggtttcaccatgttggccaggctggtcttgaactcctgatctcaggtgatccacctgccttggcctcccaaagtgctgggattacaggcgtgagctacactgcacctggcccatttttccagattcttaaagcagatccttaggtctttttttttttttttttttttttttttttacttcttttctaatataagcacttacagtttccctctaagcactagcttcagcctacgtattttagtatgctgtgttttcattatcatttcatttgaaatattgtaaaatttttcttgtgatttcctctttgactcatgggttatttagaagtatgttgtttaatttgcaaatagtcaaggctcctctgagtatcttagagctattgatttctaatttaatcttactttggccagacaagcatattttgcatgcttttaaaatttgagacttatggcccagaatgtgtatcttggtgaatgcactgttttcacttgagaaaaaaatatgtatatatattctagacttcctgagtatagagctttataactgctgattaggtcaattgctagttaccagtgttcttcagattatctgatgcttgtttctcagatgttgagagaatggtgtttgctatggcctacctgtttgtgtcccccaaaattcatatgttggagcttaatctctggtgcagtggtgttgggaattggggcatcagggaagtattggctcatgagggcagagtcatcgtgaatgggattagtcccttctgccatgtggggacacagcaggaaaaggacatctctgaagcagggagctagctctcaccagacactgagcaccctgattttggacttcccagcctctagaactgtgagcactacaatctgtttataaattacccagcctaaggcattttgttttaacatcctgaatgaactgaggtggtgttaaaatctccaactatgcatccaggcgcagtggctcacacctgtaatcccagcacttcaggaggccaaggcgggtggatcacctgaggtcaggagtttgagaccagcctggacaacatggtgaaaccttgtctctactaaaaatacaaaaattagctgggcgtggtggcaggctcctgtaatcccagctactcgggaggctgaggcaggagaatcgcttgaacccaggaggtggaggttgcagtgagccgagattgcaccattgtactccagcctgggcaacaagagtgaaactccgtctcaaaaaaaaaaaaaaagagtctccacctatgattgtggaattgcccatttctccctttaattctttcaggttttatatcatgtattttgaagctcctttggttaggtgcatacacatttatgattataatggtgtctcgatgaactgatcatttaaccatgatgaatgtattcctttatctcgtaataattttatcttggactcaactttattgatatttatgtagcctctccagccttcttaaacatgctgtttgggatgcataagaaggctggagaggcttatggagaaacttatgatggtttgacttacagtttttcaactttaccatggtgcgaacgtggtatgtatacagtagaaactgtactttaagtatgtgtgaaaccattgtgtttctcactttcagtacagtattcaataacttacatgagatagtcaacactttattataaaataggctttgtgtttgttgattttgctcaactgtaggctgaagtaagtgttctaatcatgttaaggtaggctaggctaagctagaatgttcggtaagttagatgtattaagtgcatttttgagatgatatttattttccacttatgatgggtttgtcaagacataactccatcatcattcaagcagcatcagtatgtctttttccaaacagaaaatttcaacctgtgtttatactgaaacagcatcttttgtagatagtatatagttgagtcttgctattttattcattctgacagcctccgccttttaattggaatattcaggctatttctgtttaacatagttatagatatgactgggtttagagctactaccttgctctttgatatttatttctttcatcttgctttcttggcttcttttatgttaattaagtattttttagaattctattttaatttatgttttttttttttttttttttttaagacagagtctcactctgttgcccaggctggagtgcaatagcatgatcttggctcactgcaacctctgcctcctgggttcaagtgattctcctgcctcagcttccctagtatactgggattacagacgcctgccaccacggccggctaatttttgtatttttagtaaagacggggtttcaccatgctggccaggctggcctcgaactcctgacctcaggcgatccgcccaccctggcctcccaaagtgctgggattacaagcgtgagccactgagcccggcctgttttgactttttaattgtatctctttgtattgctattttagtagttactttatagattctattgcacattcttagcttttcacagtctacttagaattaacattgtttttcttcatggaaaaaaagtgtaagaactaggcaatcctatgggttcatttaccactttccatcctgtatgtgatggttgttagatatttactacatccatacacattgtaaactagacaatacaataaggaaatttttgctttaaacagccccatgcattttaaagaaattaaaagtaaaacagaatcttttctatttgcccatgtatttgctatatcctgtgctcttcattccttcctgaagagctgagttcccatctggtctcatttcccatgatcttggagaacttgcttcacggtttttgtagtgcaggtttgcagacagctaattccctttcattttcacttatctgcaaatctttattttgctgtcattctttctttttttatttttatttttatttttgagacagagtctcactctgtctccccacaggctacagtgcaatggtgtgatttcaaaactcctgcccaatctcaactcaccaaccttctcctcccgggctcaaacgattctcctgcctcagcctcccaagtagctgggactacaggcatgtgccatcatacccagctaatttttgtatttttagtagagatgggatttcaccatgatggccaggctggtctcgaactcctgacctcaagtgatctgcctgctttggcctcctaaaatgctgggattataggtgtgagccactgtgcccagcctgctgtcattcttgaaccataatttcactggttatagaattctgagttgtcagttttttctttcaggactttaaaatatagggttccagtgtctttggcctccgttgtttctgtcaaggaatcagcattcatctagctattcccctgtagaccacatgttgtttttccctggatgcttttaagactttttatccaagtttgattgctcagtacctacctctgggcaaaaaagcctccagaaaccagaaacttatctagttttattcccctctgtcaggtgtagactctactccagcttctacctacttgagatattctatactgactccaggctgttgttattttgttctttcaaatattttgtccagagctataatgttttctgcagaattgaccagatagcagctactctctgtgaccaggagccttgatcttccagacttgctgatgggctcacaaagctcctgcccgtggccctcagttggcagtggcctctctgccttgaagttgccatgagtgtgtaaaacctacaggctcaaccttcctcattagtacagtccagaaaagtggaattcctggtctgggtggctatggtgccctagaccactggctagaccagggtggtgactgccagctggccgaatgtggggtctccagcctagcacccttggactctaccccaggagttatggctgtttcagggccaggggcctggcctcagcccctgtcccccttctcttctcctcaagttgcccagcatcaggtcccaaccagcatcttttgcagacagggtgggtcggctcctcactagaggggcagggttgggcgggaagcctgttgagccctccttcctgtgcagcccacagccctggggttagctccagaggggtgcagaaaggagcccccaaaggcagaaactcacccttctctctgttcttgtgcttccagggataaaggagaggtggtcctagctggggggctaccagtggcatgcaggaggcccacatgaccactgtttgctggggcctttccttctctgtgagagagacgagagagaggagagagagtgtgagtcagggtagtgtcttcttccagtaacgcagacttctgcacgtgttctctaggagaaatcccgtcactcgctagagctctagatctggaagaagctctgcctctcttctctcctccagtgcagtgtgtgtgtgtgtgtgtgtgtgtgtgtccccacatgcattacacccttctacagaggaaataattcccgtccaagtgcaaaggttgggattggagcaggcagcatgtgggctaaaggagcagagaggaggaaacgggggcgggggtgagggtgggaacaggaggtgggtagatgccacgaggcatgccttccacaactagaagggctggtggagatgaccagaatgctccagacagaccttttatcaaacttccaaaattcaatcttgtttcatgaagcctgaggaccctgcagagtgaaagacaaggaagggctttcctgcaggggggtgtgtgtgcctgtgtgtgcctgtgtgctgtgtgcccccatgtgtgtgcacgtgtggacctgtgtggtgtgtgcctgcacatgtgtgcacgtgtggacctgtgtggtgtgtgctgagtgtgtatatgtgtgtgcctgtgtgctgtgtatgcacttgcacatgtgtacacagatctcattttccttttttctggcttactaagtgccagaaagaatttccgtgagcctctccacccttcccaaggctgcacatggagggacttgcgcaggcacatgtgcgcgtgcacacaacacacacacacacacacacacacacacacacacacacacacgagtcaggggcgagcactcctgtggattgtacctaggcctggcaggaaaccgggttctgggaaactgtaggccccacctttggcagaaaaccatgtttttgttgctgctcgttgaagggaacattaagtggggctggggacagtttatgttgagaagagcaaattttgcctatggcactggggacattgagtggctcctgtcccgggctctggagggcttgggagacacgtctgcagctctgggcatctctcaaggtcacgggcggccacactcaaggttaggccctcctctgtgtgagctgcggtcagcaggaaggctgacctcagaggcggccccagggcccttggaggccctgcccctgagacatgggccaaggtcagagagccgagaaggctgctgctgaggactctggttggcgcccagcccagcggcccttcaggcgggccctgtgcaggggctgatgaagtcagctgggaaatctgtgaaataaagcacaggtcccccaggcttgcccagagccccggcatcagatgaggtgcagagaagggaactgagctgccaagtgtgaacaggagagaggagccccaggaccacacaggggccccgacatggcaggtgcttggtcagcagcggtgctgcccttactgctggacgtgggaaaatgcactgacacttgctgaccagagccggggtgagcatctgggtgaccctgcagatgagacaaaataagggctgccgtgggggaggggcccttgccgggccaccctgctgaggccctgtgttactgtcctgcggctgtcataacaaaggaccacaaatgaggtgactcaaaacatccgaaatcggccacgtgcggtggctcatgcctgtaatcccagcactttgggaggccgaggcggttggatcacgaggtcaggagatcgagaccatcctggctaacatggtgaaaccccgtctctactaaaaatacaaaaaaaaaaaaaaaattagccgggcgtggtggtgggtgcctgtagtcccagctgctcaggaggctgaggcaggagaatggcatgaaccttggaggtggaggttgcagtgagccgagatcgcgccattgcactccagcctgggtgacagagcaagactccgtctcaaaaacaaaaacaaaaacaaaaacaaaaacatccgaaatgtcttccctaaagtttctggagccagaaatcccagaccgaggtgtctgaaggttcattcctcctgggggttccgagggagactgtcccatgcctttctccgagctctgcggcggccagcaacccctggtattcctcggcttgcagctcggcctaccccccacctggccttcaccctgtgtctcttcttgtgtctctgtccaaactgccctctctgttgtctttttaatttatttttagggacaggttctcattctgtcctccaggctggagtgcagtggcgtgatcatggctcactgcagcctcagcctcccaggctcaagcaatcctcccacctcagccttccaagtagctgggacacaggcgcacgccaccatgcctggctaattttttaatttttttgtagagacgagggcccaggctggtctcaaactcctgcgctcaggcaatgagactttgcctcccaaaacactgggattagagacatgagctgctgtgcccagcctacctctgtcttataaagacacctgtcattggatttagggcccactctgattcaatatgccctcaaataacccaattacatcttcaaagaccctatgtccatataaagtcacattcataggtactggggggtcaggacttgcatatgtcttttgggggaacacaattcaacccacaatgggtctcacccacagaacgaacggcctctccagggtgtgcgcaggtgggtgaggggcccaggagagggacctgcgtggcaagagggcttgtgttcacgtcagagattccagaaggagactggatggggtggctgcatggagcaaggggctacagccactgtctccaagtagttggtgggttgtctggtagaaagggagcatttattttgagttcccccaagatatgaagctagtaccaggtacctggaaggtgctagcgagtagagcttgactctttacagaaagaggtgtttttctcacaatgttcacttgaggacggtggaacaggctatttcacaaggtagtgagttccccatgcctggaagcattcaagcaggggccatgtgggagttgttcaggagtgcatagaagggacctcagaggtccctgccaataccatctttgcttgtcttattttacgacaacttgaatttcagaatgtaatgttattggggatatgtctactagaggggcctccagcatcaggccccacacactatgcatcatttttagggcagggaatgagagcaggctccattctttttggttgtctgtgaggaccaggaggcttgctgctgaggcagcttcctgtggaaacagtgtctcagccccgcaatccattcatcggagctccaacatcttaatgaaacactgtgtcagatgggttctgggcatgtgtgtgcagattgtcacaagtccatgagaatgcacacacgcacattgcatgtgtgtgcacacatgtatgcacacatgcacaagaacacgaagacccgaggcaggtatagtccgtgagacagatccctctaggctgaaagactccccacaagggtccctagaacaaggctccagcctcggcagtccctcccacttctggtgggaggatctccacagagaagaagggtcaagaagcacagctcttgatgctcacggtgtaccaagctctgctttaagcttgtgtcttattttttacttatttagcaaatctgtcgctcttgttttgtgccagatgctgttctcagcactttacaaatattgatgcatgtttgtttcatgacaaccctgtgaagtaggtagtgttaccccgttttatagatgaggaaacaggcgtagagggataaagggacttgcccaaggtctgtctctaccttacacgcacatgaacgctcactcatgcggcaggcgctagtttccctctgatgtgagtcaggccttgagctggttggggtctgggtcccactttggttgtgttttgctgtgggcaccaaggaagcttctagcagcctcatctccctggtatgacctagctccagggactggatttccccaaatgctcctgcccagcctggagcctcctttccagctgggggagggctgaacgacccctcactcttggaggctgccggagcccctcctgcctgcatgcggccgctgccgggtggacaggcctgcttgtgggttgaggctcccagcagctggggtggatcatttctcctcccaagaagctttgggagaagcagctgagggggccagcgtcctcctgaggccaattccctgcctcccccagcgcaggcgcgaagccatctttgcttgtgtgtttgccacagacagtggagggcggtgcaatcgtgacgcctgcttgttgcactttgcgtccttgaggacgttgacccctggccggtgctgggcgcttgctcttcagtcatcttgccctgacctggcgtggcaggcccgagcactgctcttttacaaggaaacaggctcagaggccttgagtcacttgcccgggctcccccagccaataattggctgagccaggatttccatccagctctgtgactccagaagtccaagttcttcccatcacgtcagggccaggaaaggattagaatgcttttctacgtgccgattatttggatgatctgtgcagcttagctcgttgtagttgctcaataaaaatgtggaatgaatgggcctatatgtcccattgtgtgactcagagccaatgactctggctgatcctcctgttttcattccgtggcccagcatctccctttggggtgtgtgaccttggaagcagtgactctctccatcccaccttgaatggtgtctgcgccgcagcaggggagcagctggggattgccagcgcctgttgctggtgggctgtgcgccagatcccgtcttggatgtgtgggtgattgtcagccacatgtgtgtgaagggctgtgcgtgtaggatttgtgcaaatgtgcccctccctgctgccagcccatgggaggctgtcaagattctgcccctgcacattagcccacactctctttgtggcccactgctgtggctgttcccttgtgtcacgtggctgcaggcacagcccccaagtggatggggatcgtgggctgaatgtgcatcagatgctcctgcttcttggtgggtggagaccctcaacccatgcaccgtggctgccgcatctgaaaggccttccatggtgaaggacttggacctgagcaaccctccgcagaggtcttagaagtgctccctggccgggcgcggtggctcacacctgtaatcccagcactttgggaggccgaggtgggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacccaggaggcggagcttgcagtgagccgagatcgcgtcactgcactccagcctgggcgacagagcgagactccgtctcaaaaaaaaaaaaaaaatgaagtgctcccagctcttcctcctgtggtgaggttctgagtttccatcctcagaagaaaacctggctggggagggcatctctagacccggacataaacgccaggagaccagggctgccctctcaggtgaccaatcacagagactcagggaaagtcacgtttggaagaggcgacactgtgtctcagcctcattcatttctccatcctacagacactgcctggtgcccagcccgcaccgcgaggcttcctaagcagctctgggcaccgtgcacctggcatggcctccagccccatctccctgccttgggagacccggtggggactccgggctgagctcctgtggctgtggaaccttggtggtttattgtggtggctgagaacagggacgtggggttggacgggttgagtgtaactcccagtggctccgtgaactgcctgggagccttgggcagctctttctcactctgtgcctccgcttcctgatggaaaaatgggggccaggggggagcgaccttgaaggtattcgtgggaaccaagcgaggtgataaatgtagtgtccttggtagagaactggacacagagtccacccccatgaagggggctgctcctcctccttctatgtttcctcttgttcttatttctcctcttgtatcttctcttcctgctttccctccccctcccctccccccccacatgcaggcacactccatttggtgccccaactgcctttctccattgtccttctgtaagtggttctctaagtgggaactcaggcctggaaagggtgggcaccctgtctggtgggctctggcaggccaggcgctgagcagcctcaggagacacaaccctaggaaaaggctcatgcaggctggctgtcatgacggactgttggtgggagaggggaaggcgccgtggtaggggaagctttggaaacatccactagtggccttatttatgactcaggacacctgccaggtcactagaacacagctgaggaagctgtcggccagacgtccagaagcatcaacctggtggctgggctgtggggggacctctctggacaggcagacaaggtgtcggaggaaggggctgacactcactcagtgtctgtcatgcactgagggcacaaagggcaggatggagagctggcccacgccacctgtggaatcttccaggtgtgggggcagatggggaagcaagggggcttgaagacacatgcgctcattaaatgtccttaaatcccaagaagaagaacaaggacacatccacaggggcagggctgaaagtctgatgcatggtgttttggggtctgctcctgctgcaacagctacagtggctccctcttacctttctcttccctccattctgttgtgaaaatgttcaaaacacatggtcaagttgaaagcattttacagggaacacattcagccatcacctagattctaccactaacaccaagctacacctgctttatcacctcaccgtccatctatccctccttcgcctggccatgaatccattttatttttattttttggtgcatttcaaagtaatttcaggtcatcctgattatctctggaatcactgtcagaaattccctcccttcccctcccctctcctttcctttccttttctgagatgggatcttgctaggtcacctaggctgaagtgcggtggtgcagtcatagcacactgcagcctccaactcccgagctcaagcaatcctcctgcctcagcctcctgagtagctgggaccgcaggcatccaccaccacacccagcttcattttcaaaatttctcaccaactcctcactccttgtattcacccaggaccacttctcacaaagccagggtgctgcaggaggggtcagaaccccaagccctaatcctggctctgtcattaacactgtgcgaccctcagcaaatcattttgcctgtctaggtcctgttttcattcctatgaaacgagggcgttaaactgtatgttataaataatgagggctaccagttaccaagctcctattttaggccaggcacttttcacatgttattatgagtcctttcaatctaggtattgttctcaatggacagcttagtcaacggaagctcagagaggtggtgtaacttgccaaaagtcccactacccagtgaatgtccccacggggtctgcacccaggagtctgacacagagcccaggcctcagcacctggcgatgttttgggggtgtgagcagcccagcctactctgggcacgtgtttacttgctgttccttctgcctcatgtttgtgtttgtcccctctgaagctcagactgttattttccagttccaaataccaaaactggctaggcacggtggctcatgcctgtaatcccagcactttgggagaccaaggcgggtggatcacttgaagtcaggagttcaagaccagcctggccaacatggtaaaaccccatctctacaaaaaatacaaaaattagccagacatggtggcgtgcacctgtagtcccagctactcaaggagaacccagctacccagctactgaggcacgagaatcacttaaacctgggaggtggaggttgcagtgagccgagatcgcaccactcctctctaggctaggcaacaagtgtgagactctgtctcaaaaataataaataaataaaataaaataaaaattaaaaccaaatgccaaaaccaacccacaaaataaaccttggttaaagtagcctgttcattttgctttaactatgtatattgcaccagattctgccaggggctcagcgtataaagatgagacccctgccctgccagacaggtgggatgatggccataccttgagttagtcaaggcaccatctggctgtgtaacaaaagctaaaacatcagaggctgagcagcactcggacccacgtcccagtccaagtgtcagtcgttatgggggcccaggacagcccggacctagttcattcctttggtgcatcctcgacacacagcttccatctcttgagctgagatggttccagctcctgccgtcatgtctgcactccagccagagggaagggaagaagggagaggggaaagggcaagtgtccctctttatttttaagggcatgacctgaaagttaaacacttcagctccttcccactggccagaacccagttgtatggccgctcctgtcatcagggaggctgagcaatgtattcttcagctgggcttccctgtgcacaaccaaaacttcagttactatagaaaaaagggagctcagatattggggaaacaactagcatctgtaccacatgcactgatagctctctttgtatgaacagagctgtggcaggccctatgccagggagaaagtaagattggaaaagagcttaccaaggaggtggcatttgcactgtgcttaaggggcaagaaaaacgtcttccaatcaggagccacaaatgcttggctgaagtgctactgctctttcatcctggagctggaacagacgtcaccagtcaatcatgatggctgctgggtgcactggctaacatctataatcccagcactttgtgaggctgagggtgggaagattgcttggggccaggagtttgagaccagtttgggcaaattgcaagaccctgtctctgcaaaaaaatataaaatgtagctgagtgtggtggcacctgtagacccagccccagctactcgagaggctgagatgggaggatcgcttgggcctaggagttcgaggctgcagtgagctatgattgcaccactgcactccagcctgggtgacagagcaggacctgtctctaaaaacaataaaataaaatcaaagttttaaaatggaaaaaaaatcatgagcacataactccagatgtatcctcaagatagcaaacccgggtgggcgcagtggctcatgcctgtaatcctggcactttgggaggccaaggtgggtggatcacctgaggtcaggagtttgagactagcctggccaacagccccatctgtactacaaatacaaaattagctgggcatggtggtgggcacctgtgatcccagctacttggaaggctgaggcaggagaattgcttgaacccaggaggcggaggttgcagtgagccaagatcacaccattgcactccagcctggagaaaaaaagcaaaactctgtctcaaaaaaaaaaaaaaaaagcaaacccagggccaggtctgtagccacatggccaccttcttccctgagcatggaggcagcctcagaaacctgccccacatcacatcagtgggcagttgattgggtcagcctgccagttgaaccctatttgccacagtcattctccatagtaaggggcattctagacataccccccttcccagggaagaataagccgtagctgcctgagcgttttatccagtggtgtgcatgtcttttcccaactctgtgtttagtgatgtcctgtttgtagcttgaaatttgccacagtgggtgtgtttacaccacaggaattggcaaacactacatatcaggccttacctcctgctccctactagggtaggttgttttttttttgttgtttttgttttttgtttctttttttttttgagacggagtctcgctctgtcgcccaggctggcgtggagtgatgcgatctccgctcactgcaagctccgcctccctggttcacaccattctcctgcctgagcttccagaatagctgggactacaggcgcccgccaccacacccggctaattttttgtatttttagtagagacggggtttcaccgtgttagccaggatggtctcgatctcctgacctcgcaatctgccctcctcggcctcccaaaatgctggcattatgccactgcgcccggcctagggtaggttgttagaaatgtaccagcctgccagtttcagccttgtttgtctttcatcctttttttttttttttttttttttgagacggggtctctctctgttgccccccaggctggagtgcagtggtgtgatcctggctcactgcaacctctgcctcctgggatcaagtgattctcctgcctcagcctcccaagtagctgggattacaggtgcccaccaccacgtccagctaaattttgtatttttagtagagatggggtttcaccacattggccaggctggtatcgaactccttacctaaggtgatccacccgccttggcctcccaaagtgctgggattacaggcgtgagccaccgcactgggcctctttcgttctttcttaatgaaaatcttcctgaaagatttgcctactgatgtctgtgtcaataggtactgcctgcgggacagagcctgccctccttttgaaggtctttctctgtctgggtgaccatctgcatgtcactccctgctgctcagaactaaagatgtagctatgcctggggtaggttgggaaaacctgtgggaatcacagagcttgctgtcatgctgtgttctggatacctgaagcttggcaggcaggtgggatcgagggtgggcattaggaaagtgatgtggctctataggaaggggacataggtcctgagattttaggtccccaattggacaaagctgttttttttttctggataaatgttctagcttattcataatcgagtggtcagttttcttttcttttcttttctttttttttttgagatggagtctcgctctttcgcccaggctggagtgcagtggcgctatctcggctcactgcaagctccgcctcccaggttcacgccattctcccgcctcagcctccggagtagctgggactacaggcgcctgccaccgcgtccggctaattttttgtatttttagtagagacagggtttcaccgtgttagccaggatggtctcgatctcttgacctcgtgatccgcccgcctcggcctcccaaagtgctgggattacaggcgtgagccaccgcgcccggccaagtggtcagttttctcagctgccgggtcttgcacaccttgctggctctggagaccatatgcaccatgtagaccccatttgtttcctaccctcagtgttgggggaggggccaagggcctgtcgatgtgttgacacctggccattcactggccttgaatgtccacattcacctccttgaaatcgatgccccgtatcggaggctccatgtggatttgggggcagaggcctgtactccagatggtggggtggccttcaccaatcaggcagattccctgccctgccctgccctttgggctctgtagctccagatgtgtgctcaagatctgtggccacatggatgggacaagccacagagactcagactccgtggtccctgtgaccagagtagccgtggccctgtctgggaatgttcccaccctgttgctgaaggtgagaaatttctctgtgctggagaacagctgtgctgagaagttggcccatctggcttgcaggactgctggggcaagggaggtctgctgccggtctcttccttcctcctctgactgggtgctccttgtctaggttccttgcagcaaaagaattctctaatttattttgttcccttattgagtctctactccatgaagcccacctcctaatcccagctgactggctcccacctcctcaagaggaaggccaggggcagacgaggctgaaggaggctgactcccctgtgccttcgcagtctgagctgatgctgctgtatgttcacagggctccttcagcttttaaaaaggcttcaacacgttcgtcacacgcttgtggctctcctggatgccacactaactcagtaaggcctgagttagaggctgttcctgaggctgtgaaaatagaagaagggtccagaggagaatcccttcatctgacgatcccaggaaggcttcctagaagaagcagcctctgagctgagacctgaagacagatcaggcctgagtcaggccagggagggtgtgaggggcccaccaggcagagggaacaggatagggcaggcacagaggtctggcacctggcttgtggggaagtgtgagcccctgggcatgaccaaggcggggagaagtggcgtgagaggaggcagatgtggctggcaggagatcggcggccccggccttgctgagctccactctgtatgcaccaggtgacagaggctgcccaggacggtgggcagggaagtgacaggtcacatggtcatcccaccaacagccgggagtccagcttggggggacccaagaccctggggaaggcacgagtcaggggcctgctagagccaggagctagtgggagaaggaaacagtgttgcttatgaattataaacagacactcccgcaactttctctgacgtgatacaatctcaaagtgggccacccagaggtgggaaggtgacttctggctctccaggccttgggcctgtcttttttttttttttttttttttttttgagatggagtctcactctgttgcccaggctggagtgcagtggtgtaatcttggctcactaccacctctgcctcctgcgttcaagcaatcctcctgcctcagcctcctgagtagctgggattacaggcacctgccaccacacccggctaatttttgtatttttagtagagatggtgtttcaccatgttggccaggctggtctcgaattcctgacctcaggtgatccgcccaccttggcctcccaaagtgctgggattacaggcatgagccactgtgcccagccgagcccatcttcaagttctccctggccctcagtgtttctgtattagttcacccttttggctccctgcttttaagagtctcccttaagactgtccccaagtggacaggtccccagaaccaaggagcagccttaggagtccccagttacagacactccagggggtccgtgtggccctcagcctctggcctggttccggcagccttggtcctttgtgctgtctctcacatagcctggccagagctggccaggtcccttggctgggccgagtcatcgtggccagtgactcatgcagggggagaaaagtgaggagggggaacagagtgcgagggggactgtgttaataacaaacccattaggtccctgaggtcacttcacaggagggacaaatggttcatttaggttgatctggctgccggctggcttccagagacactcagggtggggaagatttcattatctggggaaagcaataccagattgtctggaggggcccagccagcgcaccccgcgcttcctgtctgcctcccacgcagagcgttctgttcccaaggcggcaggccaagagcgcgagccgaggctcaggtgcaaagaggggtgcggcatgggggcactgcagggcacggggtgcatgcatttttatttatttttttactgagtgttagggtaatttgttaatggggtatatttggtgacataaaaccttctgtcgattcatggcagtctggaacggagtggaagcgtcccactcctggggaacccccacacacatttggctgtgaacgtcggtgcctttgcactggagcctctttggagtgtgctgggcagagcggagaggttcctcttctctcttctccatcatcctgtggaggtgtcaacatgtagccagagatggtcagtggcagtgaggagaggggggcaggaagagaccagggctgggggcttgccagcccacagttctacccctgaacacccatggcctccctgttcaggtcagcgaggctgggggcagagacgggcaggggtcccccaatgttgggcatctccccgctccctcatactctggatttgccctctggagaaagctctggagcacccagaagtcctggggctgctggctgaggtggggagcagagcccagctgtgcctggaggctccccacttccactcagcttccagggacagtctcagctgtgcaggcccaggccgctgaggctggctccagaaatttcttcacaaccaccactggatggaaaaccagttctctaaagggccccagagccagttttgtttcttcttccacaggttcccatagttagagcatcgggtctttgttagagatgcagaagagacgatgtccccagcccttatgtggttcggtctccactgtggatgttggtgatcttagtctccttctcaaaaccaagagggctgatgccccacattccaggcccccagaaagagccgccacccacccacaccgctacatcttctttccacttttctgttccggaaagagtagagtggatatgcgctcctgtagaaatccatctacagcctgactgcagatgtattttgctcccttattgagtctctgctccatgaagcctgccttgtttgtacctctttctctctctttctctctttcttccctctcttccttcccttccgttcccttcctttttctttccttcctgtcttattctttcctctttctttctttcctctctctctctttccccctttctctgtctttcctatcttttctttctctctctttcctcttttttgaacagccaaagatagaatgaatggcataggtaggtactgagctccctgtaactggaggtgttcaagtgtagggtggatgggcatttatagggcaggcattgaggaaggatctccctgggattgtggatggcaggacaggccctgtggagccttctgagcgggtgcagaagagggagggcatgttcctgctccctgcccttcccgggttgccaggccgccactcccaacctccaccctctttccttccacctgctgggccttacgggatgggcagaggcattgttagaacatggagccgcggtccacagagggccagcagggaggagagctccctggggaccacgtcgcctcagtcactgtggtgactttgaaaataaatgctttcttctctgcttgagtccctgttgttcctgctgacgtggaactagggcaggctggtgactcagccctcatccctgcactgcatcggtggcaagttgcctccagcctcagaccccacagagcagggtgccttcttcagaaaaacagtagggaggccaggacaccaagggccccagggacagcctgtttctcctggctggcatgagttctagccaagcctcctggtaccctgggggtgaggaggtaccagctgtgtgctttagtcactggctgctttgaggctgggtcggtgccaggctggccactccttcttgtcccctagtgtgactttgcagagctcccggaagggtcagagggtttttttccatcactggtgtccatgggatactgtgtccccatctcatttttgtactccagtctcagacgggtgctaggaagttggagactttagccatttcacgactgtgtcttgcggggctggagtaggaacaggagtaggaggaacgctctggtcatgggactgtgtgaagagagaaggatcaggaagaaaacatgagctatcatgtctgggttatacctcagcagagccgctggtggcctcccaggcatctgaatttactaatcacaaagctcaccaggtgtgcaaataaacaaatgctgttcaggaggcacagccagggttctgctggagagggatcatcttggaggggtcatactttccacccagtccttcagtccttctgtcctgtgtgtgtgcagcccctgaccaccaccatccctgcccctgccacttgctcccagggttccatcaggttggatgttattgcaataaaatgtagcaacagaaggtccaggcagtgctgcagtccctggtggtatcatcagagccagcaggcagcagggctggggaactccaagctgattcagtcccaagtgccggagcggggagctcggatgaggtgggggtggggaaccggggagccatggagcagagcatttgctgtgctgaaggccaggagcctccttgggagatcatgaatttagaacactaatactttgtttaaaaagtcccctgccttggagataagagctcaggccgctgtggtcaggttttgctgtaaatgttctgcacaaagcaggctggggggatcactgggaagtctggggaacagattggtcatgtgcttctttgagtgaaaccttatggttgcattgaagcggccaggcagagggtgtgatggggtgtggtagctgcacaccggctcagtcaggctgaatggggaaatgcaaactcaggtggcctgaaagagacttagtggtccacagcctggtggctgctcccagtacaggtgatgtaaagagagaaggggttccgggggcttggcccaggtggaaaccatgcactgtctgtgatcctgggcatgtcgaggctggagcaggtctgcttggtggctggcagaacgcacatgaagaatccatgtgtgttctgaacgtcccctctgcccctttgggctcatgccccatcaggagtctcccgactctgccattctgcaaaggaaactgcgctttgtcattgcacaggatcgaacaggtgtgtgtggagtccctaaagccactgtctcaaggggtctcatgggacaatgggagagttgctgtgatgtttaagactaaagtgatggctgggcgcagtggctcacgtctgtaatcccagcactttgggaggctgaggaggatggatcacttgaggccaggagttcgagactaccctggccaacacggtgaaaccccatctctactaaaaaaacaaaaattagccgggcatggtagcgggtgcctgtaatcccagctactcgggaggctgaggcaggagaattgctccgatctgggaggcggaggttgcagtgagccgagatcacgccactacactacagcccgggcgacagagtgagactgtctaaaataataataatgctaataataaataaaataataataataaaataataaaagcaaggacttgaacaaatatttgcacacccatgtttgtagcagctttactctcaattgctcaaatgtggaaggaatggatatacaaagtgtgtgtacacacagtggaatatcattcagccttcaaaaggaacggaattctgtcactacatgtgaaccttgaataatgaaccttgaagacctcatgctacgtaagcctgtctcacaaggacaaatattgtatgatttcacttatgtgaagtcaaattcatagagaaattggaatgacggttgccagcagctaggggaaggaaggatggggagttattgtttaatgaggacagagtttcagtttgggaagttggaagaagtttcggaggtggatggtgttgatgggtgtacaatgtgaatgtacttaatgtcactaacatggaaacttggttaaaatggtaaatttgtcttttttgtttttgttttttttttttttgagacggagtctcgctctgtcgcccaggctggagtgcactggcgtgatcttggctcactgtaacctccgcctcccaggttcaggcgattctcgtgcctcagcctcccagagagctgggattataggcgtttgccaccacgcccggctgatttttgtatttttagtagagacagggtttcaccatgttggccaggctggtcttgaactcctgacctcaggtgatccacccaccttggccttccaaagtgctgggattacaggcgtgagccatggtggctggccaaaaatggtaaattttatattacatatattttatcacagtaaaaatgcattgctctattagaaaaatgatagatttttacaatatgaattaaattacaagttatgaaggaaaaattaagcaaaacattaaaaaattacttataagtaattatatttaaaacaaaagataataaatacacaactttcatcacctcttaggttttttgcaacatttaactattgtctgtcctgttgcggttatgttcttgaggttgtatttgtatgatagaaacactatattcgtggtgactaaacatctcttctcagtctcacctccaatgatgtcatacagataacttgaaattggccggctgggcacgatggctcatgcctgtaatcccagcactttgggaggccaaggcaggcagatcatctgagttcaaaaccagcctggccagcagggtgaatcctcatctctagtaaaaatacaaaaattagccaggagtggtggcgggtgcctgtaatccgagctacttgggaggctgaggcaggagaatcacttgaacctgggaggtggagtttgcagtgagccaggattgccccactgcactccagaccgggtgacagagtgagaccctgtcaaaaaagaaaagaaaagaaagaaattggccaaggcaggaatattgacaccacaggaataggcaagcgctacaaatcgggaaactgagtgttgttgcttttgctggccccaggtggccggttgttgaccgttaactggcacactactggaggagggaggttcagactgattcgcagagagactagaggtagaaacgcaccatggtttggatgctgagggtgagggaaagagaggagtcaacagtggtgcccggagacttggcttgagcaactaggtggatggtagcaccgtttcctaagatgaggggctgtgggaacttgaggggctgtggaaggctctgccactgacggacccagggctcggcagctctgggaggcctactttgtgtcaggccacgcagagataagaccatctgggccctgcccttgggaagtctctgtctatgaggacacagcctgccacctaatggggtgtcccgtctggagcctcagtgttgctgggagaaagcccctcaccttccttcgctctccgagcctcttttgcttccctgccagctgagcctctccatggaggctgtgcctggaggggggtcatggatatggatgtgtgcgccaaacgctgcttcctcgtggatttcctccccactccgttcccacgctttgtaagcttcatttccccggggcctgacctgtggggtttctctccagacctgctccttcccatttccagaaaggcgtgcaggggtttcctatggctctcttccctgtccccatcccccttcccttgggacagtgatctgctggacgggtgggctacccacagggtttgtgattgcttagacatctttgctgtatgaagctttgacctcaaggcatgatgcagatgggaataaggcacgagtttctcctggctgctgtaacaactgtcgaaactgggtggcttatagcaaggggaatgtgtcctctcacagttctggaggccagaagtctgaaatcaaggtgccagcagggccagcttcctctgaagactccaggggaaaacctttctttgcctcttccagcttctggtggccccaggtgttccttggcctgtggctgcatcactccggtctctgcctctgtcttcacaaggcctttttctgtgtctctgtactttcttttctgtctcttagaaggacacagcattgaatttagggcccaccttatcttgagatccttgcctaaattctttctgcagagacccttaaacagaatcaggtcacatttgaggttccaagtgggcatatctttgttttgggggggatcaccggcccactgtaggtctcgttgtgcactgaagacgcaggcggtccctttggccaggcctgcagtcggtcttgccttcttttgtgaccgtggaagaatgcaccttgctggatgcacaggcctttatagttcttttgttcttgccaaatttcagctcagtttcctctctgctgccggcgtgcatcttctctgcccagtgccccttctgggactgtgtgtccaggccctgaggccctagaaaaggggggtggagggcctcctcactatcctgtagcaatgaggcctcattaaaatcctggagccccagactggacccagcccttagctatgatcaaaggacagctcgggatatgattaaagggctagagaaagatgatttaggctgagaaagaggaggccaaggagcaactggattgtccttgaatgtggaaaaggtaattatgacttgaagggtggtgcccagctgtttcccatctcctctgaggacaggaaaaaaaaggaaataaatgatgtacaattagagcagttggttagatacgagggtgaacttcctggctgggagtatggccaagccctgatttgggtttcctgaaagagctcggggaacctccttacctggaggtttctaggcctggtcatgtggctctgagtgattacattgaaggggcagtggctggggctggagccggtgggctctgagcacagtcacgaaggcatgcgcactttctggctgctctcctgccattgtcccttgggttcccattttggtgaggcgtgcaccctggcggcgctccccagggaactaaatatgtttgctgcactgtgcgtggagatggagaatgtacaattggctgaccctgtgctaatctggtggaactccatgccagccctgggaaagaacaattgcatgggtgtgtccacactcaccaggtgctttttagaaaaacactcgagaataatgctgtggcttaggatggctgttgtgccggacccggcatcttcccaggggggctgtgttgttgggctgagtttcttaggtactggacccccaaatccccaaatacggcgtggacaggtggcccagtaggggctggactatccgataggcccaggtgctggagttcagacaagacataccctggcctggcgtggaagatacggggtgctattaatggcagcaatggctgcatttctgaaacccgggctcccaggccgacgagggtgtgcacgcatctgaaatgtctgtggttttgcagttcccatgtccacaaactcacttggttgaaaatagttcaaaatatccaaagcatgagggagggagtgcctgcttttcttaaaaaggaaggacttgatttcatctacttaaaaagccacccaaacctagaacattttccgcaagagaccccctgccccccgcctctccagaatggctggagagtctcagcactcctgcacatttgggatatttcagagggggtggggaggggcaagtgggcagcgagcgacctcagacccaggatgagctgtcaggcgctccccggccacacattcaagggaccggagtgcagttgtagcgttgcggcctgctgcttcgggggtgggggtgttgttccatgctgtgaattctcacatggcccctgactctgggcagaggccgagggtctaagggacggggtgacagggagagcatgcaggagtgggtttctggctttccagggcgagtggaagaagcgcctctctctcttgtaggtgacagacctggggggcccttcttgaggatgagagcctgttgcttctcaagttctgtgtctaacccaggtccccaggtctaccccagcccctcggccctgcctgccttgtggatgatatagtttaagggtagagaccgctggcctggagggaaggctaggcctcaggttagggcccagaagggagggagaagcccttggggcagctccctttctgctcactcactgcctagctccttccttcacaccttccttcggaaacgtctgctcctgacaaggtctacttcctgctctcaggaggcccttattgtggaggaagggaggcgtcgcccgtccctggcttctctgacagccgtgttccatccccgccctgtgccccttctcccggacagtgccttctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgaggggagacgggagtgcgctgaggggagacgggacccctaatccaggcgccctcccgctgagagcgccgcgcgcccccggccccgtgcccgcgccgcctacgtgggggaccctgttaggggcacccgcgtagaccctgcgcgccctcacaggaccctgtgctcgttctgcgcactgccgcctgggtttccttccttttattgttgtttgtgtttgccaagcgacagcgacctcctcgagggctcgcgaggctgcctcggaactctccaggacgcacagtttcactctgggaaatccatcggtcccctccctttggctctccccggcggctctcgggccccgcttggacccggcaacgggatagggaggtcgttcctcacctccgactgagtggacagccgcgtcctgctcgggtggacagccctcccctcccccacgccagtttcggggccgccaagttgtgcagcccgtgggccgggagcaccgaacggacacagcccaggtcgtggcagggtctagagtgggatgtcccatggcccccatccaggcctggggatatcctcatccgcctcccagaatcgggccgtgggggacagaaggggcctgcgtgcgggcagggagagtattttggctctctcctgtcttcggggtttacaaagtgtgttgggacttgcggggctgctctgtccaagcctgggtctggcgtccgcgtctctgagcctgtgagtgcgtgcgctttcctgcgtcctcttgactgccggtgctggggctctgcgtcctgcgtccgcgggagtaaatacagcaggcgaaggggaagctcacacaatggtctccagcgctctggggcagggcttctgaggggcgggcctgcctctgccgggacctggagcccccgcccctcggagaggctcctaggctgacttgggcagagccctctggtgggccgggagggggaaaggctgtgttgaaatgagcaaactgtccaggtgtcaggccaagctgggaggtgaccagcctgaggtcctccccgctccatggccagaaccagggctgacatctgggtgtcctgagcccagctgcccacacggcccacctggggtcagccctatctgagtgggggaggcggggcctcctgggggaccagaactttggctggacgccaagcagagtgccagtggctgttcttcagggctgggcctgaggagggtgtggggcggcgaagggacgggagggggttgtgatccagtggccactggcgctgtgcagagtgtgagctggaaacatcgtagttactttgtcagcttagtggtgaaagccctttttcaggctctatccctttgcatccctgcttcccagagggaggggaggtctgggtctgcagagctgggagggcttgctgttcccgcccccctcccccacaacacctcctcatctggacatctttgggcacatgctcatactggggtctccctaggtccactgtgttccgttgagcctcctgcagtccccgagtgaatgtgacctccctgcccctgcctctttgcaactcctccctgcgaccgctcctccaggggccttccttgtcccaaatgtccaagtggcacgacttagccggtctgaccactttccagtaagcccttatggagagaggccctgtgttgtgcagagctctcctcctgcctgcgggatcgaggtctctgctctcagttcctaacagaaagtgtcgggcccccagtgggatttctggggaagaactctcgtgtctcaacgggagccctgtggcgggaggggaggccagggtttggggttgtgttcgttgtacagctgtcaccatttgcactatgaaagttgttagtgccccttccttgggtctctgggtgtaactccacccttgcccccatgtgcctccatctggagctgcttctgcggctgtctcccaagccagttttgtgaccctgtaatttagtccaagacaatgggctcattgagaccatcctggtgcagcagttggcaatcctttggctctgggggaaggtttctcagtctcggggagtggggcctcaatctgctggttccctgtgtttatcagtctcccccttgtgtgtcctgaatggttttgctgggaattctggtcttagagccatcaggtggcccgagtcgataggcgtgagagagtgtgtgtgtgcatgagtgcgcatgtgcatgggggctgacctggggtatggaaaggtggccctccctggtgcccaaggagcctggagtatagttggagggtgtgggggtgtgtatatgggagttggacaaccttgggtggacagacagacgtggggaagggatgattgaaggaggtggaggagagagtgtgattcagcccagccaggggtgatgtggacaggcagcttccgaatcagggtagagaaaagtcaccactagctagcaggggagaagtcagtatggaggaggcggaccttgagggagagtaggaattggattgcaagaggaaggagagccttctggccagcagcagccagcagcagtgggggaggctggaatgagctggctggagagggggctggggcataaggaggggcctgcctgtgaagatcatatgggccaggctgcggagggccaggcatgcccgccgggagtgcagctggtccacgggaagcatctggagtggctgggaatgggcgcaggagcagcgccgtgggagcacaggtctctttcccggggcggctcacctggtgtcttggttcctgcaaggtaggccgaaagggtggggaggaaactgccagctccttacagcgctgggatggtggccccagggttcctgaggccagcggatgtgggtgcctgtcaccatgtgggttgctgaggggcggagactccaggggccaccccaaagcaggacgagctctgagccacggcatctctgggggcagttttccaatcgagcagacgtctaggcctggaatcctgtaacagaggccacagggccctgatcagggtgttctgggaggcttagaactagtggcagtatacagggtagacggcaagtgacctggcatggggaaagaggcaggtgcccaggccggcacagcacacccgtaaggaacaggtagacgggaagccgtccgtgggcctgtgtgtgtgctcggagttaaaattctgccaatgtcccatgtcctgggcacatctaccccctccctggggagcacctttctcttcaccttttccttccccgcctgtccccttcacccagggccttccccatccctcccgtcttggggaccgagggcaccatggctttatgttccatcaccgatgagttgcacagggattcagtccttccgctgttcaggccgggtccttcaggctcagggttcccaggaatggagagggtatcagtgtcttccatggactcaaacttcccgcatcccgcctttgctcccccttcaagataggtctccgagcttcaaggttttagggctctgtggaggccgccacgtagcagcaaggagaatgttttgtatttggctgatgagatttttagagtctcattttctacttttccactgtacaaacgggcctccaggcgactgcagcacccgccactgcccgtaatagggtgacaagagggatgaccctttcctctttctcccttctggttggtggaggcacggggctggcggacggcatgtgctttcgtgaattcaggccaaatctgttatcgcaaacacgattacaactcgggtctttgtgtaacaaaagcctttccaagtaccagctgttggcctgctttgctcagcggtgtttgctgtaaccagatttgcacaccgagaaagaatccaaaagtccttgatgtttgttgaaacaatctggcccaggacccacgtgctcagatcccagagctgtgtggcatctgagcttctcccgagcccccactgtcgcccgaggaggacccccagatctgtgttctggaggcagagcaggctgtgggacgggcttctgggtgggaaggaccatgtggatatgccttcttgtctgagagtcccaacacctccgggacgtgggagctggcgcgctggcaggattcaggtgcctctttcctctctagagaaaaaggccccgttgcttggtaataggtgcagacctgtccctaattaatgccagtaggcctcttgcgtgatgaaccctgcctttcagccaagactcaaggcatcctgtgaatactgcctctctgcagtttgagcttttgtggtgggaggcaggagccatggggagtgggggcaggcctcttacacgggtcccacagccactggcagcactgacttgatgctctttgagttcagagcccagggccagacagacccactgtcccgactacgagttggttcatttagaggggggcggacacagcacccaggcagcagatgcactgtgatcagccttgcagcggggctgtgggttctctgggctggatgtccgggaagaggcaggtggaggtaaacgccaggacacccctgcagtgactgggtgactgcaggctggaaatgctttctgtgggctgtggctgtccaggaaggttttgaatggggctagtggacagagtttgcatccagaggggcagtgctttggaggagtgaggggtatggcagtgtagggatgcccaggccgccctcactctgccattggaaagctgggcggcttcggtttcttcagtttcttcgcctgtttccctgcctgcaaagtggggttagaaacagctctctttgagggttgctgggggactctgagatgcagcccatggcgctgagcacgggtcctgcctcctacgggtgtggtgggtgtcgcggctggtgtggcatctgggcgggaaaagggggcatttgcaaaggacaggtaggtttggatgcttaaatatgcagatctggggatgggaggtctcaggcaagggcctgtgtgatgccactgtatgaatgaggccggacagcatggtcaccactaattatggaaagcacggcagacactagtgccagtagcgcccgcctgggggtccctctgagcccgacaggtactcaggctcccagtgcagccatgggaccccccttttcctgcctggctgacattctggaggctggcgtcatgttggctgcaggttcctcttactgggaggttgtcctggtcttccctgccaccatctacccccacccccaccctggagtgtcacagatgggtggaccatatgcccatctgcagggccaagcgctgacaatgaggtgagcacttgctggatgaccggaccatgaggacagcgggggcgctggcagcctgcgttcggctctgcaggctggcctttccctgaaaagcggttgtggcagagtgtgcatcccagggagtggtgcctgctgccctgaacattctcatccagcaggcctctgcaagggcccagtcaagtgtggtgcagagctgggctggcagctggaacagtctcatcttgtctagtggtgagaccaagggctgatgggccaaggctgcgtgctgcttgcccagcccgtggacccatccactgagcacccccatacccctacactgggcccggggtgtcaggaggtggaggggggactgggtgcctggaaaaacaagcccaccgagagcctgagcccccaggggtcagtatcaggcagtcaccacggtgcccggtacacagtggccacctggtctcgtcggctgtcttggtggtggagagcgtgcatggtggccgtacgtgatgggcatcacccagggtaatacagatatgcagactgtgcatttgtctgtaggagccagggacttctcagcctggcaacctgtgacctctgcctacccgttgggagagaggtgctgttccctgatagcctggtgccgggagagcagaactagggtctcctcctcctttctccacctcccatttcttacatgcccaggcatcaggggaggtcacactcagggatgagtcttggccactgggttcagggcctcactgttgccatctcttccctttgccagccagccaaatgcccgtccatcatcgtgccggggatggggctggcctgctcctctgaagtctccttggtgtatagcctaggctggagccccggacgattccgccaccccctcccccgactttttctttttattttgattcatcccagaaacccagccaaaaaccaagttcctgtgctctcccttgacaaagccactgaggaaaaatggtcaaacactgcctttctttccaaagccctcttggtttttcccaaatttggaggctctgagttgcttatgagaccaaagggtccggaactctctggaacacagtcccagaagtgggaggatttgtcatctctccagccaaacagacccaccagttggcccctagacacccccaggcgcctggggcatttctgggctcaggctgtttaatttggtctgcagagccccgaggctccgtttagactgggccagcagacagttctagagacttcaagtttgttgtcgtttttaaaagtcctgccaatgcccagaaacttagagggacaagaagatgacctcgatgtcagccgggaccataaacagtgaggcccgcccccccccccacccatgcctgcctccactgctcccgtagctgggtctccaggggattgcccgtggccatgggggaggccgggaatgcggggctcagactctactgggcttctcgtatttttttgtttttccttgtccatcttctttctcggaaatttctgaatatccccctacagcctttggcattctgtcactcctggcatctctgggccaactgggaaagccatcatttgtccaatatccagaaaatcaaggggcctggccttaaatacattgcagtgccctcctccccacatggcatcgaatttcctgtgtcctcaaagccaggagcctgtgccttggatgtgggcgatggagccttgcagacacctggagcggctttcctgggagagtctccctcgccttcccatccacccgcttcccctcccctgccccaagctctggtcacagcctcggaggggtcatctgagtgtaggttgcctccaggtgtacagttggaggggggcagttaccccacatccccctgtctgctaggggcacccccagggactcaggtcttgagggacagcggaagggtggggtggggagtaggccgttgtctcgtgccacctgggtgttatgtagactctgaatgggcagttcctgggagctggtttttccttctcaccccttctacagtgctgcccctctgaggggctggagctctctggagccctttgcagcctgtggcaggtctttctgattctgtgcctggtttcgcagcctccaacccatagccagtggcatgaagaacattcctggctgtctctacctgtggcctttgcaggcagcagttccctggggcagggcctgggggtcctggcacctccttgtgggaccccttgggtatgagggagggagccacctgggccacagatagacccccttcctgtatccaggaggttcaggatggacctgtctcatctttctttctggtgggaagagagcattcctggccatggggaatgtggcctggacagagccacctagcctctcccctcccccaggcagggccctgaaagatggagatggctctgctcctgccaggtcaacagccagcagtctggtggatttccatgcagtccaggcaggatctccttctgtccccaccccccaccccatgtgcaggaagctggttccaagcagggacccttggccccgctttccacgtgggtgggcagtttccctgcgaggggcaggccaggcccctgccctatgtcccccagagaccgatgttatctacagtaagagcatacaagtctttttggctccaaaccaggcctggaggggtggtcttctcctctgtcctctgcctcttgccccccattaaaggtcagggaatggagtgctctgtatgtttgctggggttgggttttttcctttggtttaaaatgaagggctggaatccctggtgcagactgcacggtgagaggtgctccttgggatccactcgaggagcattactgctgaatgccctgccaggccaggagcatcgctgggggtgggagaggcagttggcttatttgtttatccaacagccatccatgggtaccccaagggccagctctgttctaggcactgggggtctaggcatgggctcaggagaaggggtagaacgggagggcttcctggaggaaggcttcctaaccagagaccggggtaggagtttgccaggcaggtgatgctggccagcttctcttgccattttccttttctttttttctttttctttctttctttttttttgagacagagtttcgctcttgttgcccaggctgcagtgcagtggcgtgatctcggctcactgcatcctccgcctcctgggttcaagcgattctcctgcctcagcctcctgagtagctgagactccaggcacgcaccaccacgcccagctaattttttgtatttttagtagagacaaggtttcatcctgttggccaggctggtctcaaactccttacctcaggtgatccgcccaccttggcttcccaaagtgctgggattacaggtgtgagccactgcgctcggccttctcttgccatttctgcagactcatagtgtgtgtggaagactgtatgtctgtgcctggcacagctgccctcggcactcaggtgggaggtgggggagagggctgttggtgccagcacaggtcatggcatgagacaggctcccgcagccaagcggggtgcaccgcagcattggaggggccctgctgcgcacgagatccaggctctgcatctgtcctcctccccaggaggcctggagggctgggagggaccagggtggtgaaataacccaggtgggagagaggcactgttggagaggcagagggagctgcaggtttgtagcagcgagctttaaaccctgggcctccaccagaaaacctcagaaagggctgctttgcttttttttctaaactacaaaagaaacccttggccgcctgggccccttggggtcgggtgggggaggagatccttcattcgcacctttgcaggcccagtactgtgcagagggaggagggtggaggcaaaggcgagggaggagggtggaagcaaaggcggggtccctccctagccccgctgccctgcctggttgctgctctcagacccctactcctggcccggaaacatggaatcttgggacagctggggtagggggcacagaacggagaccctggtgagggaggaactctttctccagccctggctgtggccacagcaaggccaggctgggaggacctcactcaaatatttacatctctcctaatatttaaatgatgaagcaggctcctgcacacagctgccctggagccagctgttgcctgccctaccctccctctctccctccctctttctttccctccctctttctctccctccctccttctctccctccctccctcttgcattctttgtctctgacccaagtccaggcccttccagctgttctctccttacccacaggcacctcctgtgactgagcttctccttgttatttttcataaccatttcctttaattgagcacctcctaggtgccaggccctgggctggtactttgtatacaaggtgtcttttaatccccacgagagcccaacaaggtagattgggctgctgaggctccagcgctggaaggccggcccgggtcctcccagtccgcacctgcatccatccatcactcccccactgtggagacctgttccctggcccctggctgagcacgatggaaatctctgtctactagtccttggagagtggggatggctgagggtcccgaccctggggtctgacgggggctgcctctgccccacttcagcctggctgctcttccactcaatgactgagtttgcaaaaccagaataacagtgctacctggctggtactttgggtggctgggaggcgtgggagagggtgcacggaggggctgagcgaggtgtcagcatcgtggggatctccgagggtagccttcccaggcccagggcggagtgtaggcagagggcgcgatggcccagcgtgccggctcacatctggccttgcccttgcccacacggcaatgtgggggagtcatcagcctctcagtgcctcagtttcccatctgtgcaatggggacaagagtaaatcactgtcttcaggtatggtaagcactcatacacattgactattgcagaatgaacacagtgagcccttcttaggcttctactacatgccaggcagggtgccaggccctagtggagaggggacaatgatgggcaagctggctcctgccctcaagggctgtcgagcagggaggaaggcggcggctgccctgactgtgacccggagtggggtgattcgcaaagaggctggcgggaggctggctgggggctggctgggggctgctccctctcctgcctgtgttccgtggcagggtattaaactggcttttttcatggatttccgaggccctgactgtgggacctcgggcaggttttgggaccttgtgactttgttcccgcttgtcattcaggcctttgtcctcagcagtgcccagcacacggcgacttctgcatgtccttcagtgtgtgactgaccctggagctgagacttggcagctgaggctggacattgtccttggataactcccggggaggtgggggcagggtggggctgtgagctggcaactccgagtccctagcagcctccgaatggaggctttcctcttgtaggattctcggggaggaaggaggggatgggggagatgaggcttgtgagtcttcaggagggcagaggttcacacctgcagcgccccagaaacactccggggtgcccaggcttacccagccctcctgagccagaaccaccaagagttggggaccagcagtccattttttagcaagatccagaaatgattctcctgaacagtccgagccaagaatgacatatctggaatcagaacatcagaactacagaggaatcgagagaacgggcccaaaatgtgtagggacctcagccacatggcgccacatggaggaaagcacccaacatcatcactgtatgaacctgtttaaacacacacacacacacacacacacacacacacacacacacacacactccccagtaaagagtggaaagacatttgtcagaatattgatggaagttacctgggttgtgggtttatagattttttccctttgtttttgtgcattttgcaaattttcggctttgtgcctaaattccttttacagtcaggaacaaagcaatagatgttattttttaaagttcatgggctcgtgcccgtaatcccaacactctgggaggctgaggcaggaggattccttaagcccaggagtttgagaccagcctgggcaacatagggagacccccacctttttttttttttttttttgacagagtttcactgtgtcccaggctgaagtggcggtggcacgttcttggttcactgcaacctctgcctcccaggttcaggtgattctcatgcctcagcctcctgagtagctggattacagacactcatatttgtaggatttgagaatcctacaagaggaaagcctccattcggaggctgctggggacttggagttgccagctcacatattttttagtagagacagggtttcaccatgttgaccaggctggtctcaaactcctgtcctcaagtgatccatccatctcggcctcccaaggttccaggattacaggcgtgagccactgcgcccggccatgggagaccccctcttaaaacaagaataaaaataaaaataaataaaagtttactgtcaaaaagaaaaacacatcacccaacctaatctccccctaggattgagagatgaggaagcagaggccggaaagtgtcacattccctggtcgctggcagtcaggggacctgaggcctgggctggttttctcgtgctccaggcctggggtgtcaggtggagcccctgctttgcccaaaggtctaggtgcctctgccagcactgcttgcttctgcatttttggccacaaggaatgtgggccaaaggcagggtccttgacctctgcccaggagggtgaagtgggctggtcctccttgtccctgctccaaggcccctgcggctgtgcctttggaaactgctggcccgagctagtgtgcggagctgggacagacctcaccgtggccctcgtggggtcattccatgtccgggctggaagggatctttcggtccagcccttcctgttcctcatcaggaaactgagaccagagaggtcatctgcctggcccggggtggggtgtagatggcgcttgtgactcctgcatgccacgtgcagacagtccctcagctgtgggcttcccacgcaagcagccatgctggggataacttggctgaaacctgcgatttaatgaagagaagaatgactcctcctgcagccctgtgccccacaggctccctcctgcccccacccctcctgcagaggggcctcatgctggtgggtgggtccctgttgctgcaatgggcccaggcagtttctgggcagtggaggcttggctgtcttcctgcccaatgtcccctgtagcccacgctgtccgggaagggcggggaagcactcagccactggggacttcacaagatgggtatctgggagatgctgattggcaggccaggctcccgtggcccacaggcaggtcagaggtcacagtgctgagctgggctgagttggcagctcagggcagtgggggtgggggtaccttgctcagccatgggcctctctggcacaagggtttggagtttactgtaaacaactccttcagtttttccttctctcataggccaccagcagaattgaggggccctctgttgatgaggtgtggcctgggaggggctagttgtctgtccacctgatccttgcggacaggtgaccacaggcttcctgccccagggggctgggggaaagatcggggaggcctctctggcttccccacttggaaggaaaatacgggcataggggagacactttacagggacacatttcagccagtaccctctggctgtgctgggggcacagtgcctgccctgcccacaagaggggtcagttctctccaggatttaacttcagccttcagtgcagggcagatgagcactcagaggcccagaggactcatatcacgagagagaagctgtgaccacacaggcactgaaggttaagcagaagagtgggacacacgggtgacctgaaagtcccagggtcagtgtggttagccccagatagctggggagctttgggtaccaggcttagcaggggaggagggcccccgtgacagtttgctggggctgctgcaacaaagccccacgaactttgggggctgaagatggttctagaggccagaagtccaaaatcaaggtgtcgaccaggctgatcctttggggcctctgcgggaggctccggcccaggcctctctcccagcttctggtggctcccgggtgctcctgggcatgtagatgcgtcacgccactccctgctccgtcttcacatggccttttctctgtgtctctgtgtctcgtaaggatgcttgtcattgcatttagagcccaccctaaatccaggatactctcctcttgagatcctttattgcatctgcaaagaccctattccaactcctgtcacattcacaggtccgagggctagggctctggcatgtcttttgggggtcactattcagtccactgcggcagctgatcttaggggaagcagaatgttctaagcttggggtgagcggagggaacgctgctgggtggggagtgggagaccaggctcggagacaccgcggatctcctctgtctgatgagggcgtgatgaggttctcatctcaggtcctctgaatggcggctgcttctgaggagaccctttcccctggatctgcccctccagaaacctccacttaggtccaggtcccaaggtggatggtaagaggcggctgtccctgccacacttgatgggtgagtgtgtgaacggggctgggagcaggacacttgtcacttctgtggacagattccagaggctcatgaatctgctgctggggaaggtgcctgatctagcctgaccctccacccccacctcccccttcccgccccccttcaccagccctgttcccagagcttcacttccccaaaggcaggcgccgtttcctggacttctcagcagctaccccctaccccagacccctctcttgtaggcccctctggtctcagcgcctactcctccctgggcttctgcccctctaccgtgaggcttctgggcagaagtgtggggccccctcgctgtgtctggctctcgcggtataccaggggtcctcccaggggcccgccctgcccgctaggtttccagggagcttttcaagttcttagatgggcttgatggagtttcccaatgcgttgtctcagagcaggaggggccccggctgagtccgagagtcccctcagtcacaccctgggctgtttggggcagccaggcagcccgtcttctggaggtgctgcctctctctggttaccccttctggaatcttctgcgtccagttgcggcccctcctacacagcacacccaccacccccttttacctgtgactcttctttgtcaacctcttcatgtctttgagaatggagaccaggtcctcctcaccctggagttcagcagaacctaaaccaggcagatccgtgtaggttcacgtgggggctctgtggccactgtggctctgccgtcacctccagcccagcttggcgcgctttggatcatgtcattcagtgccggtcctccaaacctctcccctggctctgcaggtctgggaagcagctggctcctgggtgcagctgtgaccggagcctgaactctgctccctggggtcaccgtcccctgtaattaggctgcagctcatattggctcgggcagaggccatcggctgcccgccttggggccacaacacagagagccccgtgattaatggaggctccacctgggccaagtggcccctggtgttaggcgcttttttttttttttttttttttttgcattttttaagtgcttgtaacatttcccctaatggacaatgagacgaggagggagggaggggtggcttctctgcccaggcagatcaggaatggtcaccgcctgtgtgtgcagtgacaggtctgggaacagacaagggagagcttgtccgggaggctggaccctcacaccgatgctgcctgtgcctggcagctctgtcccgggcctcagaacagacactgaccaacacgctcctcagggtctccaggtccgggtcctggtccccggcagagcttcccatccatgggaagaagcaccgagcagccttgctggctcctcgcagggagctgggatgcatttctaagagcagcatgcgtgaagcccggggtctgggcaaaggagtgtttggggaagagtctgctgttgttggagggtcggaagtagaggggaaggaggggcacgcggtaggctgaggaggtggctggcgaccctgtggtggggacgagggggctatgagcagaccaggagccagcatcacgtttctctgtctccagaatcgaggacggagagctgccagagaggccctggcggggtgtctggggccacctaaagggcgtgggtggattaaagctgaggaaagcctcattttgggggactccgtacttaacctttgaggccctcagagctgcagcctgtggtttttcgaagtcaatcacctcccagggcctcgctcctgccttcagcgacagccatttatcagggagtctttgacccaaggagacctgaaaggtcatctggtccctctcctacccccaggcaggccacacctagaccctcccacacagatccgtcccacccttctgctgccttccaccagggacggagggtgggcggccctcccacccaggccctggcggccccaccccagccaggaaattcttcctctttatctgcctcacatctcttcccctgcggcttccgcccatttcccctcaatctgctcctagtggagcagccagcagctggtttagaacccgggggtggggggagcgctagaccagtgcagcacatctgagagtgtgccagaggtgctcccattcccatagctgatttagtaaagaaaagaggaagtccagcaacttagcgccactttaaagtccgcctggaatgaccctgtggctgccggaaccaggggcacgcggtagatgacgggagcaggcacagagaggccttcgtcccggatcagtcgctgttgccctcttggaggctgggctgcctttcaagaagaggacccaaggccctgtgagcggtggcctcctctggagcctttactgtggtcctggttctgctctgcgtaaagagagatggcttgaagcagaagctgctacgtggctgtcccaggcaggcgcccgtagtcccagctactcgggaggcggaggcaggagaatggcatgaacccgggaggcggagcttgcagtgagcagagatggcaccactgcaccgcagcctgggcgacagagcaagactccgtcttaaaaaaaaaaaaaaaaaaaaggagtagagaaatctttcccagaaggcctgcagtcacctccccttcatgtttcagaggtaaaaaaaaaaaaaactgcacatttcgctttttttttttttttttgagacggagtctcgctctgtcgcccaggctggagtgcagtggcgcgatctcggctcgctgcaagctccgcctcccgggttcacgccattctcctgcctcagcctcccgagtagctgggactacaggcgcccgccaccacgcccggctaattttttgtgtttttagtagagacggggtttcactgtgttagccaggatggtctcgatctcctgacctcgtgatctgcccgcctctgcctcccaaagtgctgggattacaggcgtgagccgccgcgcccggccacacgtttctgttcttgaacaggtggctccctgaccctgggtgtggttactccaagaccttgctctggtggggcacaattctggccccaggtagggcgaccgtataacttactgtcccttgggggacacgttagtgaaagggacccttgaatgactacggtgggacaacagatgtgagctgggtttgtcccaggaaggctggatgtatgggcctcttgagccagaggagacaacagcagaaagctctgcggctgatgggaccgagcaggagaagggccggcggaggctggggcaacaacgcacttgcccactgtgaagggcctgtgtgagctgatggctgatgagagggcagtggggcgaggctgcctcctgccaggctagaccagctccaggacacccatatctccttttcagaaccggtgactcagtggctagaaggggcttcagaattgacgggacactgagggagtcgaatggaatggctggagtggccacagcaggctctaggcctcctcccgtttcttttctgtgttctgttcctggggtctatatcctggggttgctgtaacagagtgccacaacctgggggcttacaaacatagcttccggcggctcctggagattcctggcgttccttggcctgcagacgcatcaccatcatctctgatctctggcccctgtctccacgtggctttctccccctgtctgtgtgtctttctccttttctgtcttttataaagatgctcaccattggatttagggcccactaaattcagaatgatctcaccttgagacccttaccttaattacatctgcaaagatccgttttccaaatgtgatcatgttcgcaggttccaggagttaggacttaagacatatcgttttgggggacactgttgaacccactacatttaataaacccagagttggtgccaatgtcccctgcggacaccatagcagattctggaggttccttgtaaaggaatccgtaggacttcttttcccttctggagggatgagactgtagctgggctggggaaagctgctggttcaagctggggctggttcagctggtgctggcttgccaggttgttagagagctttatccagggagaaattaacatcacaaagttgggggataagagaaggtttggaatcccaagggctggctgttgaggtcagctgcccacccctttgtgttccatcttacagggacccaggcctgccagtgctccgtttctggaaggaatgctgtgggctgctgtgccccataggcagggtggagggtccccttgcagccagcgagctgctcttcctgtagcgtgcagagggaaggaggaggcttgtttatttctcttggcctcagccgaaaatccaaccacaggctctggcactaggcagacctgctcattctcacatcatcattgcagagtgagccaggcctcttgggtggggctgtgatgagcaggaaggacctccggagtgcctgggacttcttgggcccagggttgccagaggcagagagaaagaagcctcctcctaacacttgagcaaagatagtcatcagaatccatcagagtggcctcctgtggctcttccctgggtgctgacccccctggtgcatttgaagttttcagggatactattgacgctccctgcacctccatccaggggttagtggaaatggttcttttcctccttgtccagaggtactgtggatgatgaccccaggtcccagacctcagtcattgggccacgtgtgcagataagcctgggcagtcagtaacctttggccaccaagctggcctcctgcggactgggccggcactggaggcgggtcttagctgctagcactgtggcccagccaggcctggccttgggaaggcagagggggaggggactgggaaagggattgagctgggggtggggtggtaccctggttcttccctcccagacctttggcaggtttgaactatctggctgcggctctctaaggagggagcgcctcctccgccttgatgtggactttgccttctgttcacgttgtccctgtccctaaacaaatgtggctctctgtggggagcctgggggccgccctccactgacactgctgtttcctggcttccctttgcaggctccgctcagcttcactgcgcctatttttaagcctttccttttggacggttttgcttcctgagaacacacccctccccatcaccccaactgtgtcctcctccctatccggagcctgctccacctgccccaggagccacctccctcctccaccaagcagcccaggccaattctggagggctaatttgtgtccctccagaagcaggtcctgagacagggatttcagtgggaggggacaccaggggatgcctgagtgtgggaatgggccaggcagggaatccagccaataaagggtgcctcaccagctcattgtgaccacaggtggctgcccagcccccataccgggcagcatggggagactgcagaccgtgcccccagccttgtcccacctggggttgggtaagggagctggggtttttatacttcagttcttggccaaggactgcactgctcactccttccagccttccgagggcttgggcactaggaaaggctctgggtggagacacggaaataggccatgtgaagtcagtgggcgtgattggtagcagtaaggccaggacagccttggtcaccagcaaggtgaccacacatttcagcatgcacagcccccacagacacacacccaggagatggtaattacaccagcaacagtcacccctgccgcgtgccatgcctgcacccagggaatcttattttttatttatttatttatttttatttgagatggagttgcgctcttgttgcccaggatagagtgcaatggcacaatctcggctcaccacaacctccgcctcctgggttcaagctattctgcctcagcctcccgagtagctgggattacaggcatgcaccaccacgcctgactatttttgtatttttagtagagatggggtttctccattttggtcaggctggtctcgaactcctgacctcaggtgatccacccacctcagcctcccaaagtgttaggattacaggcatgagccaccgcgcctggcctcaggggcaccttattaccccatcacctcctacagcaggtgacactgaggacactgaggctcagagtagactgtggttatgtcactctcctgtttggttctcctgctctcagccctgaaataaagagcacggtccctgtgcaggcccatacgtcctgtctccagccctggagcagtccttaagctccttgaaggcacaccaggcctttgggcctcgtcccccaagtcctggataaataggaggtgaaggagcctttgcaactggaccccactctgccagcgccaaggccctgcctgactacccaccccaccctacacagatcagggacctgtgccaaggtccagtgtcacaggagagtgaagacaaggaggtgcccatggcgtacatgctgctggactcactctgtagatcctaagggttatggggagttatctgccaggtgaggttttcccgtggctttttcctgcaggctcagggtagcatacagggaggtgcttccctactccttggcaccatctgtccggcttccctgagccctgaccctggctcctagatagccagtgtttcttcagggacagaacctgctttgctgctgctcagaggagacccagtttgaccagggctagcgttcctggaacctgagcctggaattccaccctgccctgggcagaggccacgttgctccctcctacgagagctgagctgcgcatgagattattctgaccttgggctctaccatttctttgcatgacatttgtcccaggctggagcagggctctgtggctcgcttggtgttccctccccagactgaggcctgatatgtacaccaggaagtgcttgatctggtttcaggagctgggagcggtttgccaggcagcctgtggtcagagcaggggccttaacaatggtcccttgtgcggcacattcctctctaaataggcccaggtccaggctgctcctgtttcgaccccgccatgggcctggaggggaaagtttgcatctggagggtggcccactgtggcctctttttgtgtagcagctgagaccgtaggtgcttgagaataggagaagccctgtgcccatcctgggctgtgagatgtttttccagaggtggggatggggatgggccagcatgcagttacccacaccctccagcttgttggcatcaaggtctgtgtatgtgtgtgtttttttttttttaattttgtttttccaacatggagtcttgccatttgcccaggctggtctcggactcctggctcaagcgatcctctagcctcaggttcccaaagtgctgggattataggtgtgagccaccatgcccagccagtaccaaggtgtgttttttaagagcaatattggccgggtgcagtggctcacgcctgtaatcgcagcactttgggaggccgaggcaggcggatcatgaggtcagcagattgagaccatcctggctaacacggtgaaatcgtgtctctactaaaaatacaaaaaaattagccagacgtggtggccgggcacctgtagtcccagctactcgggaggctgaggcaggagaatggcgtgaacctgggaggtggagcttgcggtgagccgagattgcgccactgcactccagtctgggcgacagagcgagactgtctcaaaaaaaaaaaaaaaaaagaacaatatcgatggttttattccctgaacatgctaagtgatccccatgtagtataagcatctcagaaggcaggaaaatgtaatgaacaacacccaccgccattcattccatccagagatcgttattttctgcccgggtgtgagtgtgtgtgtgcgtgcaaactgcacatgtgtgtatgaaatggaattaggatctttgtatacatcttgtgtcctgctatttttacttaatattctcggcatttctcatcttcaaaaatgtgattttaatgatggtgcaggcctttgacatatgggtttagaaaatctgcggaaacccggactgtttccaggttttgtcagtttaatgctgatgcaaatgtcctcgtacgtaaatctttctgtacttctgattatttccttgggataaattcccagaagtgggccaaagcacatgaacggtcttcaggcttttggagcaagttgagatcggtggggattggagaagggacccagggaggcttttgggagcttgcgagattggagtctggctttaggggacttgaattcacagatgaaggagatggctggcaaaggtgggaacctcctgctctatgggtgggggggtgacactgctttaccttccagtgacagcatggggatcctcccaacatgacctggctccgcatctttctgacactgtgcacggtccacagttgtgatgctcagctgggagcctcttctgtgtccttcagttgcattaactccttgcagacagaggaggaagctgtccggtgctcctccctgctgcgtgggtcctttgaatctgcccagttgggcctgtggatctgtgcagtcacgtacggggttctaaaatctgcaaaatgacaagctcacgaacactctcgcttctgtgggtgaatgtggataccccttggctgcgtctccctccacagggaagatggagacgtgtaaagtgacaaggacctgctacccctgggcaggttatgccggttccactgtgaggatggtggcagggggcttcccaggaggcctgcacattgggaagagaggggcgaccgtgtgtgactgcaggacccagggcgcagtcttaggactctgatgggggaggagatgctggggagccctgttctgccagcctggtgacagacatctcctaatgtttcccggctgggtacaactcacaatgtcctccgtggggaggcaattgcccatgaggcatccctggcagggatgatcttgtttcattgccacatatcccagcaatgaaacaagaatctagagtgatgtgattcctccgatgacttctccaaccatctggggtttttgtgcgactccaagaagggggaaggaggcagctctcgctcctctgggctcctgatgtggcagctctggaatggccacgtgtccgttggcccacagtgggccatttgtcgaatgtggttgtggtgggattggggctgggctggagagtgggtgaccacaccagctagcctcaccctgggccactgtgcagccaggggtttcatcttcccaggggtctcgttgtgagtgtcctggggctgctggaacaaattactggaaaccaagtggcccaacaaagattgattcgctcatggttctggaggccacaagtttgacatcaaggtattggcaggaccacactccctccgacagctcgaggggaggacccttccttgcctcctccagcttgcgttggcccaggcgctccttggctctggcagcatctgcagtctctgctctcatcacgtagccctccccaccgtgtctctttgtgtcccaagtccccttctgcctttctcctataaggacaccgagcactggatttagagcccatcccaaatccaggatagtctcatcccgggatccctaatcacatctgcaaagaccctttttccaaataaggtcacattcgtgggttcttggggttaggtattagacatgtctttttgggggtcactagtcaaccctctacagaacctcagacgaaagtgaatcttcacaggctgaaatgggggtgaaggtctagtgcgtccctcctccttgggagctccctcagggcttgtgcctatcctgtgatcctgtgatccagccttttttttgagatgaagtcttgctttgtcgcccaggctggagtactgtggcacgatctgggctcactgcaacctctgcctcccgaatttaagtgattcttctgcctcagccttccaagtagctgggattacaggcgcccacccccatgcctagctaattttttgtgtttttagtagagacagggttttaccatgttggccaggctggtttcgaactcctgacctcaggtgatccgcctgccttgggcctgccttggcctcccaaagtgctgggattacaggcatgagccaccacgcctggcatttagtaggttttggttgttttttttttttgagacagagtctcactctgtcatccaggctggagtgtagtggtgtgatcatggctcactgcagccttgatctcctggcctcaagtgatcctctcacctcagcctctcgagtagctgggattacaggcatatgccaccacccctggccaatttttgtattgtttagtggagtcggggctttgccatgttgcccaggtttgtcttgaactcctgggctcaagcgatctgtccaccttggcttcccaaagtgttggggttacaggcgtgagccaccacgcctggcttagtaggttttctagaagcgcctgaggcctggtgaaggcatggtgtcatggagtagagaacattcaactctgttcccggggagccggaacacacccctcgtagccaatctcaacagtcatgacgtggccaggatgacatggggagggggtggtgtggactgtgtgggaggccagctccccgggaagggggctggagtgggcttggctttgaggaggattcccaagaggaggaggaggcggtggcatgctcgtttggggggatggcgtgagccagggtgggcacctcttcatttaggtgtcaccttcttgacattccagccgggacatggtttccttggggaagatggacacccccagagtggggcatctcctggggaagatggacacctccggaatggggcgcctcctgttctcactgttcttctagcacacagttgtattctcttgcagttctggaggctgtgagatctcctggctgttatctagaacaaactcgcctttgagcagcgccgtcctgatggtggggtggcccctgcgggtggaacagcccctgctgtctcagagcttactgagagctagtgggcatgggagtggtgctggaccgaaacacccagagggatcatagagccaggcagtaagcacagaggccagctagtggggagggagggacccatccatgaaaagacaccaagcattgaaagagaggagaggatggttggggaccggcacacatgtgcattttgcgcagatggccaaggtggtgaggcgccagccacgcagacaactggaggaaggaggagtgccctaggggaggggccagctccggttctagaatgatccgcttgtgcacgtgggcctggctggaataaatcattgcatccgcaccgtagactcaatcgtaagctcacaccagggcagcctctgctttggtgcagtgtcttcgatcatgagttggccatggtgggggtgactccaaggggactcccaaggagggggttcaccggatctcccagggaaggtcatttgttttcttgggttggacctgggacaaggccttctcctgtctagtttctgttctccaacttgaccgcacggaaggatgctgaggacacctggaagccggcccctgctctacagcacccataggacagaggcacaccatgtggggacagtttggacagtgctcaggaggcagggagcagatcagaggaccgcgggaggccctgggaaccgcacgaggacccaggcattgagctctgcactttctggcatcagcccgatgtacagtctggctctgtgtctaccccgtacttcactttccccatctgtacgggggcggtaataatattctttacagcccaggtttaagcgggtgtagatgtgatgagcttggtaagcccatctcattacattcagttctgggcattgaaccctggactttctggctggtagaagtggacattcaacctttccttggggccctggggcttctgcagaatcagaacacagccagcagtttgcatgcagggtgcagagggacagagggacaccatgtcgggagcccacacctggcacacccctgactctggggctcagtgtcctgctgccctgcggccacgtgatcagctagaggtcatggctggacccataggcgaatacagcctgtggatttgattttgtttggccctgcggtgttttattttatttttagttttagtttgtggagacagagtctcgctctgtcagtcaggctgagtgcagtgacacgatctcagctctgcaacctctgcctcccgggttcaagcgattctcctgcctcagcctcctgagtagctgggactataggcgagtgtcaccatgcccagctaattttttatttttagtaaagatggggtttcaccacatcagccaggctgctcagtgttttaaaaagggcttgttttgctttgtgccagcatttaaagatcaggagatatcatataaagatccagatttctactctcttgagaagtgaacagctctggccacgccgggcccatatcctctagggcagtgacggagctgagacagggcctgtgacaactgagagttctctggagtccacacggctccttgcccagcttctggtggaggttgagcttagtgacccaggatttcgtctgtgtccaccaagaaggagaggtgcctgtggcttagagagggcgcccacaggagtgccttgcccaggaagctggcagctgaggcggccagggttagggggttgggcttcctcttcccctccccagtgcctgagtgcatttggaggaagagagacgggtgaggggaaggcactgaaattggtcctggagcgctattattgggggctggggaccagctgtcatcccttttcctgtgggcaggggaggcagtggtgggatcccatgagacccggactctgtggcctggtgaggcagggagcggctggggagacactgtgggtctccacaggggtgcgctgtgggtctggcctggggaaggagctggtgaatgtgcctgccatgtgggtccctccctgctctggccctgataaccaggagcggctggctctcatttggagtgcggttgtggggactgtggaggtggcagcttcccaggtaccatccccactgcctccgagggagcagaccctggtggagaggcaggatggctgcagggcgggagctggtggttggcatcactgcacgggcttgtagtagtggatgggaagatgcaggagaggctgatgactgagaaagttggttcctgtggactaagctgggggagccggacaaccaagtggttagaaccttgggctctggtatcagcctgatgtacagtctggctctgtgtctaccccgtgccccactttccccatctgtactgggggtactggtattctttacatcccagggttaagcggctgcagatgtgatgagctcggtaggcccggcgcctcgccggcactgaaagctccagtgtccgcccttagtgtcattgatggggttttgttcctgctgcggttctgattggttacagttgcggtcacttattattggaggcatgtcccccgctgtggctgatggtagaggtgtgtttgctggtggtgtcccagtgtgtgccttggctggaggtgaggagggataaaaacagccgcgacaagaaggaaatcaaggccgggcacggtggcgcacgcctgtaatcccagcactttgggaggccgaggcgggtggatcgcttgaggtcaggagtccgagaccagactgaccaacatggtgaaaccccatctctactaaaaatacaaaaattagccaggcatggtggcccgtgcctataatcccagctactggggaggctgaggtaggagaatcgcttgaacccgggaggtgccgctgcactccagccagggcaacagagcaagactccatctcaaaaaaaaaaagaaggaaataaaagtcttctctggaactagaacgttcctatgtagacgtagctggagggggaggctgtgtggtttgcgccgtggccatggcaagacacgacgggcagcatcttcccactccagcctgcatctctgccccagaactcatgatggttctcctaggatggggctgtcccttccgcttgctgagacatgaaggacgggaagagacccccggccctcaccgccgcatcgcctgccttcctctgctgctccttagcaggaaacatgccggagtgttccctagccatccattcaccaattgcatcccctctctttatttttcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggagggtgagtcgcagagcgctaggtcttggatgctgtggtaatggggggcctggttgctggctttgccacagaatcttggaggaagaagctggatatggggtggagggtgctaccctggagacccagaaagaccggaatgcatgggggtgggggtctgcaagctcaggagaggtggctctctctgtctgatgggaacatgccaagatgccccaagcgggacttgaatgagagtttggaaagattttctgggtttcaaggagcctcctttatgggtcaccgtgggccttgctgggacctctgtctgctgtgtgtccctggagggcctgggaggcttagagaatgaggagccacgcaggaaccagggcaggctcatgcaggggtgtaggacagggtggagttgagacccctagaagggctgtcacattctggtggctcctgcttgaggaattgcaggctgcctggatatgcccagcagaggccgagggcttggggaagggaggagggacgtatgcctcctgaggcttgcattggagcccatggtctggtcctcctcccccaggagggatggttgtggcagagggaggggaacatgaggagcaccttagcctgcaggacaaaattctcagggcactgggaaggggtgcctggaccagggggctgtgtgatagctgcacacggttttatttgggggtgcccttctggcgagaggagagaggccatggggctccagcagcgtcctgggagggctcaagcccacagccgtgctgacatggagcttacaggcaggggattggtgccagtcctgtgggacacagggcctgtttggaaatgccaggctgtgggacatggttgggtcccttctcagaagcgtgccccctggccccagcagggatcgtggctccatggggctatagtaaggtgccagctgggttagaagcccctcaagagccaggtctgattctgggcacaggatcagaactcagtaatgctcagtaagccttctttaggttggacaaacagcacagtctgggtttttgatttagctgctgcttcttatttctaaccgtggtgaaatacacaacatacaatgtgcaattttagccactttgcagtgtacgtttcagcggcattcagtacattcacggtgttgcgcagctgccaccgctgtccatctccggtacccttttcatcctcccaaactgagctccgtccccgttagaccaagctccccatgcccctcccccagctgctggcagccaccattctattttctgtctttattatgaatttatttgaccactctaggaaccttgtgtgtgtggaaaaatacaataactgcccattttgtgtctggctcatttcactcagcatgacgtcctaaaggttcatccgtcgtgctgtagcatggggcagaatttccttcctttcagaggctgaataatattctgttgtgcgatgcacttgtgttgtgtagctgttcctccatcggtggacccttgggttgcttccacatctctctaagtccctctttccatcttctttgacttttctttgacttttttgagacagggtcttgctctgtcctccaggctggcgtgcagtggtgtgatcactgcttactgcaacctctgccccctgggctcaagtgattccccagcctcagcctcccaagtacctaggaccacaggttgcgcgccaccatgcctggctaatttttaaattttttttgtagagacaggttctcactaggttgcccaggctggtctcaaactcctgggttcaaatgagcctcctgcctcggcctcccaaagtgttgggattataggcatgagccacccaacccctttttggtttttctttttgaatgagagttctccagtggtcagtgggcttgggggctgggaggatgtggggcctggagagggtgtgggtttggggggagaccagtgctcctcatgctttcatgggcatgtggagtgcacatttgtcttggcgggtctggggcctgggactctgcatttcctacagagggggcatcggaacacactgagtagccagaggctagtgggccttggaaggtcctttccggccctcagtgtgcgagtcccgtgttccctctcccatctctctaagcttgactctgaagagccaccctgccccagccacccagactcagtgacagtggttgctggtggcatggtgtcaggccaaaggcatgggcagtttgcagagtggcaggaggctgtttcctcccctgccttctgttggtgcaggacctttgtttgacgtgccggatacacccccatcctgggttgatgtgttcacactcagctgagtcaaacaggatgtggctggggaggcggttgtcaccgagccatctaaatctcggtgatggctggtgctggatgcacagggacgtggtcctggctctgggggacaggtagggggatgtccatggggatgtacaagaacattctcctccaggggcagacacagtttagcccctaaattgtgccagagactgtgccgggagccaggcccagggacacaacctgcgggctctgctttctggagctcaccgagccgtgagcaggatggctgggacacaaggagtgtccagggagcttccccagcagtggaagtacaatttcatcaggccaggaaggggagagaaaggcaggccacgtggaggcagcagcgttcagagctgccaggaacctggcgctctggggggacggtggctttctccatggaataggatgtacacgttggagccggggcatgggagaaaaccatcagcatcccagacccggccacccacggacagggacctgtgcaggtgggagtccagctcacgtggagaggtccgtgggctgggctgacagtcctgagggcctaagcaagtccaggtggaggaaatgcagggacagacgagggcagggccttcccaatggaggagtgctcttgaaatccgatgggagtggcttctcggggggcccaggcctgagccccactagttcttcctccgaggcaccacctgcttgcttctccgtcctccctctctgtgtcacgaccgttctggacacggatccagttctctccaactcagcttcctgcccatctttccttcaggcccatccccttctgcccctccatgtggggctgggctgggagttccctgagccccgacatgcacagctctgaccaatctctgcggcccctctgtcccccgagcaccagggatccagctggcaccatggggaaaggaatcatggagggagttccgtgccctctgagcagacgcccagccccttggcttctgcctgcgggagggcatctgtgctgtggtttgtctccaccccagagctgtgggtgcagggcagggtctcctggggccccagctgaattgctcccagactgacttccccaaagcacagcactgctgagatctcttcccgtgctgagccttctctgctcactcaccataggcccctccacggttgattcactctcctgctcagctcacacctctctccttcccagcttctcctgctttggtcttcccttggtctctcacacctttcctcacaacccctttgccctgacctcctgaaccctgacctctgcttctctttacatcactgccttggtgaactcctatgcatccctcaaaacctggtccaaatacctcgtgtttggcttgggatataaatgatttgtgtataaactttctttcctctgctagacttttttttttaaatgtgaaagtagtttttcagatcataaaaagtaatcgagtaccctttctttaaaatgcaggaagtacagaaatgagaaagaacctaaaattcacctgtaagccagcgatatccatgcttgaggttttgctgtatagtcttcaaaattcctttcatgcccccactagattctgagggtagggctgttgtctttgtttttttttgtgttttttttttgttttttgttttttgagatggagtctctctctatcacccaggctggagtgcagtggcatgatctcagcttactgcaacctctgcctcccaggttcaagcgattcttctgcctcagcctcccgagtagctgggactataggcgtgggctaccacgcctggctaacttttgtatttttagtagagacggggtttcaccatataggccaggctggtctcgaactcctgacctcgtgacccacccacctcagcttccctgacctcccaaagtgctgggatcatgccaccgtgcccagcctgtcttggtttttataaagaatcccataaggggccaggtgcagtggctcatgcctgtaaatccagcactttggaggccgaagcaggcagattgcttgagcccaggagtttgggactagcctgggcaacatagagaaaccctatctttacaaaaaatacaaaaaattagccaggcatgatagcatgcgcttgtagtcccagctactggggaggttgaggtgggaggaccacctaagcatgggaggttgaggctgcggtgagctgagattgtgccactgcactccagcctaggagacagagtgagaccctgtctcaaaaaaaaaaaaaaaaaaaaaaaaaatcccataagataccaagtaagtgacttggacataataggtgtgccatgaaattatgctgaaggagtgagccactggtggtgagttgggatggcttttttgtggttcttgtaggcagatgtagtgacccccatgggtcgtccctagagaccaagcagaaactttcctggtcaactttacccccaggacacctggtctctcctctggaggttgtgctggagggctcagtgggtgggtgttggcttcagtgtgggggttctggaaggagtcagcatttcaggagggagtgtgggcacctagatggttgaaggggagggagaggaagagaggcgctgcagagggcagaggcatccctgcctgctcctccgccccagggcctggtgaggtctgagctttatgctggtggggtggattctcggtttccgaggctctggccctgcccctggacttggcaccctccttgctgtcctcccacagaagggcgctcatcctttggggtcatccctggtcctctcaggctctgggtggggacggccttgcctcctctcctggatccctgctcttttcctgccccccaacatgggtgcctctgggtggagtggggtggggctgggctgcagcacccagtactgagcctgcaagggctggctgctggctcagagccccccccaccagagttacccccctccggctcctcagccacaccagccaagtttctccagagctgccttataaggcgggtgctcagcgctcgttcatgggtctggttctctgccttcttgggatgctcactgggggcaagagggaggccaggcccagtgcccagctcagttctgggcatgtcccagctctgccccatgagtcaactggttctgaactatcattccacccctcccagcctcaatttcttgatctgtcaaagaggcatctgcagaggtggctgggggctgagctctcatgtatccacccaccccaagaaccaagaagggagtccacagtggttctggggccacttgtgaacatggatgtgaaattggggcggggtagacatggcagcatgtctcagtagttttcctgtgacccagagggtctggaaatctttgtcatgtgggtggagcgttgagggagcagggggtcaggcccccccgagctgatgatggtgggcgtggctcttcgcatacttggtccgcaccgggccgtgtgttccaggggcagaacagggaggaatctcagcacagacagcagggctgccagtacagcgttgagtatagggttaatcaaagcacagggctccctggaaccacccaacacagagcagtgaagaggtggctttggggaaagtggggtcagagctgagcctgagtggggggtggggagggcgggcatcagcctgcaagggagggacacctactgggccccagaagttcctggtggggatcagggactgtgaagttggggagagggtgaccactgtgatttagggaggaagggccccatagacagcccagcttctggccccgtgtttacaggacaccccacataggctctgagcctatccctggactgtggactccctgaggcagggtgtgcaggttcgtccagtaccaggtgtaaggcagggggccttggtaagcgtcgagggactcactggtgtctgatgaagcagtgagtttggatcgtgtcatgcctcgggtcctgagcctgcaggatttttctgtggggctgtgtgcttctgcttctggaggtgtccagaaggcactgacgttcctgccgggatgccttactcggaaggtcccgctgctcccacctcctcccattttcctgagctgcttgcagagggcacccaggtccccttttactttgggattgggtctctttctctttccccttctaagaacaagtaccctccttctccgaactgtccctggagcctctcagacctaggtctagagtgggaagtcccgcatgtgctgggggaacaggaatcaatgcgggaggattggccaggcccggtgtgtctccttcgtggtgggacggggtggggccagagaacagagcctggctccagagcccaggaagagaacccctcccctcgccggcctgccaagcaccgtgcagtggtgagaggaaaggagggctggtccgggaatgcagcgggtgccgagcagctgtggaataccttaaatagagcgcagctgcggggaagggtggggccaggaggcaggcgctgggggcggtttctctgctccgccccctgcagctctgtggccctgaccacccagcctggccccaggatggagccccggcccccagacacatggcactgggtgaggccgcctctcagcacttgtcccaggaagtcagagcagctgccagaagagagaggagctgtgtctgtacccgccgcctcccaggcccgggacagctgccgggattgagggtctgcacaatggcgagcctgtccggaggggcgcgccgcggccagacagccatgctctgtgcggtgtggacagagggcacattcagccctggaggagcgcactcagactccccgcctcggggcccaaagtgtgggcagcccctaaccagaccctggattccagcagacagcctgggaggatgccatgtggtccaccctgacacactgtctcacctgtgacctcatttctgagagctgcagggaggcgcttcctcagttggactccacttcctctccggggttttctgtgggtgttataagtgactctgtctccttcagtccaaggggggctcctggggtatgggctgtaactgacaggctagagtagcccatggccagggctgagcttccttcccgttctctctgaacactgggcccaggaaggggttaaagtggagatgctctgattaaagttgagggaggcatggagctcccctgaccctgtccccccatcccactgctgctactgggtgtactctgtggagccccaggactcttaaagaacccagagtggagattcccggtctcatccagtgcaggtgagggggaaagtgatttgtccacagttacatggctaccatcagcacacctgggtcaagctcgattccactccacggcccctgtctgaaacctggaactggaaatggccctggaaatcactgattccatctgccgccttccaaaatggcccgcagaggttaagatatagactcctgtaatgccttgcccactcgtgtgtggggaaatggcagaggagcaccggctttgccctcacactgcctgggctgccgcccctgccctgcctagtggctttcctctctggtccgttttctcattgtggaagtgggcacaattcttcctgtgcagcgtggttagagtggacagtgatgattcgtgaagcagggtggagcgcctgggggattcgtgttaaacaagcacataaacaaaagccaacacaacccttacttaatcagcaagcaggccttgtctgaagcccctgggcagcacctcatgccatccctaggttccaggccggtggtgtcgccccgtgtctctctcacccgcaagctggtgtttagaagccctgctctgtgttctggctcccattctccctgtgacctttccctttcttcatcctaaaaagcaatgcacgacggggcgtggtggcgggcacctgtagtcccagctgcttgggaggctgaggcaggagaatcacttgaacccaggaggcggaggttgcagtgagctgagattgtgccagtgcagtccagcctgggcaacagaacaagactcccatctgggaaaaaaaaaaaaaagcgatgcccagtcattcttagatagaaaatgaagatcacatgaaatttggaaagaagtttttctctcccattccccaactctctcccaaggggtggccatgttgacagctgggtgtggcattctcctgaattttattcctgcagagtcattcagggcttgtgtaaaaaaagtcaatgtgtaaatatagacttttcaagaacacaaaggaaatcagacttctgctaccagcttttattttttccatttaacaacactgttgccacttgtagatgtagcacgttcctttttctttttctttttttttttttttgacagagcgtggcccaggctggagtgcagtggtgcgatctcagctcactgtggctcactgtaacctccacctttcgccttccgctttcaagcgattctcctgcctcagcctcccaagtagctgaaatcacaggtgcttgccaccacacctggctaatttttgtatttttagtagagacggggtttcaccatgttggccaggctgctcttgaactcctgaccttgagatccgcccacctcggcctcccaaagtagcacgttccttttaatggttgtgtcatcagctgtcccatggccctgccaggcttgtccagcttcccactgtgattgagaggctgcaacagatgttctcgcacttgtacatgtgcacacatgactgaaggatgagctcttagtgaatttctgtgtcaaggatgtgtgcatttaagttttgatctgctgggcacagtggctcacacctgtaatcccagcactttgggaggccaaggcgggctgatcacttgaggtcaggagttcaagaccagcctggccaacatggtgaaaccccatctctactaaaaatacaaaaattagctgggcatggtggcttgtgcctgtagtcccagttactcaggaggctaaggcaggagacttgcttgaacccagcaggcagaggttgcagtgagccaagatcgtgccattgcactccagcctgggtgacagagcgagactccctatcaaaaaaaaaaaaaaaaaaaaaaaattgatccttgttcctgaattggcctctaaagtggttactagaattttttaggacccctcccctcgtcgacctgctcagctgtctgctgggccctgtgcagtgatggtccagcagggaggtcctatgccccttacccctggctgagggccaaatgctctccaattggtgttttattttgtgcatctcggtcaagcgagagggattatctcttcgtatgttataggccagggccctgtgttctcttttcatttggaaggtgtatccttttcttgttgaaattttttaaaaagagttctttgtaagccaggcgtgatggctaacacctataatcccagcactttgggaggctgaagtgggcggattgcttgagcttaggagttcgagaccagcctaggcaacatggcaaaaccgcatctctgcaaaaattagctgggtgaggtggtgcgcctgtagtcccggctactcgggaggctgatgtgggaggatcatttgagtctgggagtttgaggctgctgtgagctgtggtcataccactgcactccagcctgggtgacagagtgagatcctgtctaaaaaaaaaaaagagttatttgtacatctttatcacagcaggtacgagtatcttgtccccagctgcctacttttgattttgtttctgggatgttcttctacacagaacattttaatcctgatattgtcaagtctctgctttcccttttagcttttggaattcacatcctgtttagaggtctcctgcgttctgaaattataggaaagaatttcacccacgttttcttctagtacttctgtggtttcatttttacatgttgaaatcatgaatccattggaatgtattttggtttcagcagcgaggtaggggtagatggtattgcttggatacacagcagcgagcttggtctggagcgggtggggcgtgtgtgtgtgtgtgtgtgtgtgtgtgtgtgtgtgctatttttatcagttttggtgtctgcattgtgctggcttagcaaaaacaatttggatgcatttcttttaccctctgccttctggaacattttaagcagcaacataataatctctctgttaaaacttttcaagaattcactcgtgaaaccatctgagcctgatacttttgggggagtctagcactttaaaaacttaaactttttccatgggtctgtgagtttgggagtttttctttcttcttaaaattcattactatttttttcctagaaaagtgtcttttagcttatttaaaatccgtcagcttattccgagggggttgctttagctcgcttagtgaggacagtgtgcagcgcggtgattgacatgattgatcagcagagcacgatcgatcagtcggtgtgcaaacatgactgactgtggccagcgtcctgggatgctccatgttgaggcacatgtgtgcagtgcagggtgatgtgtattctgagaggggatgaagccacaggacccctgcacccttaggagagagcccccctccccaaggctgcagtcttgagtaggtagtgacgggactgggtctagggggctgagtggtcccagcaggccaagggcttcaggaattatgagaagtttggagttgcccagagagcagctttcaaaaccagtctggactgcagcctccagaaagacatgcgattgacaccacgaaccaggacacacctatatatggggtgggggtggggatgggatgtattaatgaaaccaaatttccgtgatggaattcttacctttaccatgcgtgtgctacactcagtattttctttttttttttttttttcccctctctctttttttctttttgtttgtttgttttggagagagggaaggctttttttcatttttttttaaacagctttattgagatccaagtaagctactatacaatccaccaatttatttatttatttatttttttgagacggagtttcactcttgtcgcctaggctggagtgcagtggcgccatctcggctgactgcaacctccgcctcctgggttcaaccaattctcctgcctcagcctcccgagtagctgagattacagacatgtaccactacgcccggctaattttgtatttttagtagagacggggtttctccatgttgaggctggtctcgaactcctgacctcaggtgatccacccgcctcagcctcccaaagtgctgggattacaggcatgagtcaccgcgtggcccaatccacccatttaaagtgcataattccatggttttcagtctattcagagagtagtgcaaccatcgtcaccacaaccaattttagaaaattgaaaatttgagaaatttagaaaatttttttcttaagaagaaaccccgtagcctttagctatcaatcctgccctcctcctccatatttccttcctatctgtgtggattctttttttttttttttttttttttgagatagggtctcactctgtcacccaggctggggtgcaatggctcaatctctgctcactgcaacctccacctcccaggctcaagccatcctcccaccatggcctcccgagtagctgagactacaggcctgtgccaccatgcccggctaatttttgtattttttgtagagatggggtttcaccatgttgcccaggctggtcttgaactcctgggctcaaatgatcctcctgccttggcctcccaaagttctggaattacaggcgtgagctactgcgcctggccgattctagacatttcttgtacagagaattgcacgtttggcctttgtgtctggcttctccacttggtgtcatgtttccaaggtccatccacattgtggcaggtgccagtgcgtccctgagtaatattccaccatggcatggaccattccattgtggacagacatgttgccttcatcagctgagggacattgggttgctgccaccgctggtgagtgtattcttttcaaattaaaaaaaaaatgctggtcaccacccactagatcgttttcttggcccacagggtgggacaagccggcctgggtgagggccaggaggtggccaggtggaggcggctggagcggccctgggttgcctctgggcgcagcaggcagaggtgcaatggcagagtctgagcaggttccctgggcggatctccatgccggtaatgtttgtttattcaagaagtctcggccaggcgtggtgcctcacacctgtaatcccagcactttgggaagttgaggcaggcagatcacctgaggtcaggagttcgagaccagcctggccaacatggcaaaaccccgtctctactaaaaatataaaaattagctgggtgtggtggcgtgtacctgtagtcccagctactcggtaggctgaggcaggagaatctgcttgattccaggaggcagagcttgaacctaggaggtggaggttgcagtgagccaaaattgcgccactgcactccagcctgggtgacagagtgagactatgtctcaaaaaaaaaaaaaaaaagaaaaaaaaagaaatctccagtgctgccctgtgcccggcaccgaagccgagggaaggcagcattagtatgagctcccagcccaccgggctcctgtctggagctgacgtgcgaccaaggcacacgagggaagcatggcgaggtggacggtgcggaggcataaggagcaaaataaggcagatgcagtggctcagtggctcctggtggctgcgaggagcgtgggcaggacagccccaggagggcacctggagagcagggccggctggggcaaggtgtgtcaggcacttgtcaggagcaaaatgtaaggggacaccaaagagctcaggaatcaacacagatagtatttaatgcagtatttttcaatatcgaaatgatgcatagtaatctctatgatgaacaaatgttggaattttaaattaagacaggcccagccctgcacgtgcacagccctgtcagagtttgttcagcgtggaatttgatttgtttaaaatgttgcttcaaaatattgtttgattcctggattttttggcactgccttaacttttgcacctggacgaaggcctcaccctaatcccagctggagagggtcaagggctggtgaatttggctttggacctgcagagcttgtggtacctgagaggtggggccaggaacaggaaggagctggtgagaacggcacccggtatgggatggggccagatcagagcagcactgtggctctttccaacccgtggttttgctgctggatgcttggcgttggtgctgagcccccggccctctgaacggagtgtgatgaataacggggccggggagctcttgggcccctccctgaagcagcagtgaagccagggacatgccggcagcaggcagggagagggacgtctggtctgtgcctggagccagctgccccatggaggagctgggtgaggatgcggtgggaggaagaccttcccagtcctgcatcctccgaagcataactgagtgcttgtgtggcttgggggtcactctggtccgaggacagtcttgctttgcttagccaggctttgaagagccaccgggatacggacagcagccctgctgggtggcaggttgtccaccctcgcccactcaacgctggaactggatgcagagcacctggatggccagtcccagagtgtctctgacactcccagtcacctcatcccttagaccaggataagatgcgggatcccaacctcgagcctcccatgggctccattccatgtgctcccataagccactgggcccacctcctggctccagggctgtctggccatttggcatcttggtttcctcatctgtacaatgaaaataatagtcccagccttctcgaggagttacaagatgcctttcgtgtgaaaaactgggatttggtaccagactatctggatttgaattttggccctacccctcctaacctgtggctttgggccaatctggcctccctgtcctcagtttccccatttatagagccatctcattgagttgctgggaggatgaacataaggaagtgtactcatgtgcccagagcattgtgattttacttattattaccaaacgaggcacacaataagtgcctaatagatgctcagtgtcatttcacggattctgtgtgccttgtgtgtctccagcagccaagctctggaggtggggaagctgttgacgagttgcacgaggtaattagaaagaggaggccacaggtgcaagggtttgggtgacacctgtggacagagagaggccgatggaccctggcagaggggaagggggcccttgcacatagaaaatgtttcctgcatccaagatccttgtgactctggaacagaggcagcagaggtctgcaaattccaaatcataaacccagaaagcatagaacattcgtagagaggaccagaaacatcatatatcttagtgtgtatagaattttccacatagccaaacaaaagcacgtttctaactgaagctgttggagagttcctgaggactttataccagacaagggccggtaagtggaagttcaatacgcaggagccattccttttgttcacaaatgtttgccgtcttttctgtctatatccgcattcatgtgagggcactcataggtccaccgtccagccccatgctttgtttgctaccaaaaaatttcttaagaattcctcagctgcaaatcctcctaccggagggggggttccaggaacccagccttgctcggggttggggcacctcagcacctgctgcacaggcgttggtcattaaaggtcatgtgccgtatccgtgggccctcggggtctggtggcacctgggcacacagtccagtggcggcctcctacctgccagacactgggagtggggggctcctcattcctgttccctggcggtggggggagtgccccgagctgtcacacatcagaacccaccgactcacacgttgcggcaccttacagccccttgacagcctctcagcctgagagaccatcaaactgagttcctggagagggtggctgttgaggcctggacacaggtgtggacaggatagccctgcctcatctcggagtcccgctccggttcagcctcttgtgggtctgaagctcaggctgggccagtccctgcccctcagatggccggaaaggcagcccagccccacggcctccttgtcaggctctgagagccgcctggcctccagctctgctctttttttttcttaagatggagttttactctgttgcccaggctggagtgcagtggtgccatcttggctcactgcaatctccacctcctgggttcaagcaattctcctgcctcagcctcctgagtagctgggactacaggcgcgtgtcaccatggcaggctagtttttgtatttttagcagggaccggttttcaccatgttggccaggctggtcttgaactcctgacctcaagtgatctgcccacctcggcttcccaaagtgctgggattacaggtgtgagccgccacgcccagcctccagctctgccttgattttctcttaaggccgtgaggatgtccacgcctcctcctttcctcacggcccattgatgtctccagatgctctgcaaagccaccctcccctcgggagctccccagctggtgacgggggaccttttggggatcactgcccaggtagtcatgtaggtctgtgggccgtgcttccaggctggaccgagacccggtgcatggggtgcttctggtctgagctgaggcccctggaagccacagccaggaggcagcaagggacggctgtcatgtcccctctcccctgtctcccagggtccctgcgggacagatttccctgcctgagcctcctggttgcccataccctggcctcccaaagcccagcctgaagccttaggcaccctacaacctgcttcctctagcagcctgccctgtctcttctctgccgatgttcctgaaactttcctgcctctccttacctcttggccagagagagactggagaccctgtgggaacccccgaggggagggagaaggccgctgtttgaacggaggtggtctttccctctgcccctccccaggcgggtcacacttgcaggcccagcctcctgctgtggcagcgcttggggtgtcggctgcctcctgggcacgagttgggagctgagggaggcgctttcaggaccggagtggcaacccagctggaggaggagtaacaggcccgtggtcagcagcagccgccgcagggaccccggcgctgtacctgtgccccagctgacccctcccgcttccctagggtgggccggggatggtggtctgttgcccagcccaggaagaagaggggccgtaatcagcagcagccacctcaggggaccccagcgctgtacctgcgacccagctgacccctcccccttccccagggctggctgggaatggtggtctgttgcccagcctaggaggaagaggggctgtggcttccactctagaggtctctctcccggtccctcccccggtgctggtctaactgcaggcctgccttaggccgtgccggcacctgctgactgacgcttagcggatgctgataggagagggctgggatggggaagcagcaagtcccggtcactgtgggctcgggttacagatggttgaggcacctcctggccatccccaggaagcaaggccccacgcagcctccgactcacccactgcccgtgtgtatttcaggaggctgcatcccccaaggcccccaccaggtaacttcattgggctgggtgtcgctgcaaaaccacccattgggtgcggtggtcttctggtggggggcatggctggggaggatgcggtggaggagaagccagctccgtggttggggggagggcggactatccgtttcctgtctgtcccctgaactggagctcatggtccctcccccaggtgcctgggccatggaagaggtcacagccctgccttattcctgtggcagcctaggggagccctggccagtcccgtgtctcctgggagggcgacagcctggtcaggctgcagggcaggactggaatgcagacccctgcttggccatgctgttgcctggctgctctgtctggggaccttctgttcaggaagagagaagcgggccggacagcccggctcagtgattggaagctcagctccccatgttcagtccagcaggaagtttgcctcctcggaacacttgcgtgcttctgcatgtgtcttcttggctggtggttctgcgaggcccctactgggctgcgtcatgtcctctggccaccctggccttggtgcctggcccctgtgaaacagagatacctgggcagtcccccacttgtgcttgcaagcctgtgtggcttcagtgatggctgattctgctccacccagaggacctgggaatcctcagcccaactgtccagaggagtctttctcagtggggagagcctgagctgtcctcctggtggacagtcctttagatctcaggcggacttccctgccggccgttcctcctgctgcccctgctcctctgtcccccatctgtctcccaccctctcccctgcagcagccagctggcacggggacctccccttccctctgggattgtgaatgagacgactttcctggtccttctgggtctagatctttctggcaacagtcagtgaaacccttgtctcaggtgggaggagaaggctcagtatgtggtcacaacaacggtcctaaccacatcactctcaaacgctggctttcacttaccccttgccctgcccaacagttactttcatcatcccattttccagattaggaaatcaaggcgcagagagcttcagccacttgcctgaggcccccacagttaagtgtctggatttgaaccctggagcagcctggctgctgagctgtcctggagacggggtactgtgcagtggtcggggtaggggtggagctctgccgtcgctgactcccgggctacctggagtgataacacagcccagtgtctgggcccctgcctgagactttggctggatgccaggagcccgagaccttccagctctttcctgtgtaaggcgccatggggtgaaatgaaagaaaaccccagttagaaggtgtccccctcttccttcagtccctcagctgccctggattttgaaataagacaccgcccgtctgtggggtgagcaggaacagattggaaccgcatttctctccccccagtcacagctgccaggagctcatctttctctgtctcctccccctgccgcctctccccacaagactgggctggatgctgctgggaaagtcaacaggaagtcttttggctgcggtggaggtgggggtctgtgcttccctggggaccgagatgagggctccaggttggctccggcaagagcagggaggctcacgtctctgcctgctggttttgcttcctgtcctgggagaaggtatccacatgtcccagaatgcaccctctgcgtgtacagggatggcttttgggccattcacctgaggtttattgatctttctctttggaactggagtggctcctccacggtggattgggctgagctctctgcctcggccgacgtctttccccaggcacttcctctcaccgtgccagggtgcaggttgctagtggatgggtcttcaccctcggggattggcagctgccacgctcatttcacagtcgagacaccctggccgaaggttctgctaagctccatggagtgtagggattttttttgagacggtctctctctgtcgcccaggctggagttcaatggcccaatgtcccgctcactgtgatctcgacctcctaggctcagcagtcctcccatctcagcctaccaagtagctgggactacaggtgtgtgccaccatgcctggttaattttttaattttaatttttttttgtagaaatggagtcttactatatttcccaggctgaactccaactcctgggcttaaatgatcctcctgccttggcctgccaaagtgctgggattccaggcatgagccattgtgctcagctggggttttcctttaacccttcctggcccttcccaggtgcaggacccgggcctcagccttatgtgttcttgaacagctctgggctctgtcctgtacctcctgggcgcgtggtcaggcctctcgtgacatcagcaggagactcaggtgaagaagcaggcagaacggaatgcttgctcacccagcctcggggccaggcggggcggccaggacagtagcagtggctggtgtggcttcctgggaggtcagcccattggcgtggccagcgaatggggaggggagcttctccccttgtctcccctcatttctggtctctgggcctccagggccaggtctccagagttctaggtggaggatggaggtcagggaagctggggtaagagcgggctgggggtgggtggtcaggcggatcctggaaaaccatcctctgcaggtcccgctttccccagggagcactcagggctggtcccggggagccgggctaatggtcacctcggatggtgcaggggtccatccccatgaaaccgggcccatccccatgaaactgggcccacagaagcttttggttccggttctgttctgccccctggctcttgcttccaaagtaggactcaggatagctctgaattccctgccgaaatgcagcttcctgggccctaacccagccctccagaaccagagtctctggggtgggccctctgcttgtctagcagcctccaggggacacttgtgcctgccagagcaagtctaataagcactgctgtaaacccctcgtccccacagccttctggttcgtctcccttttcctgctgggatctgcatcaggattaaatgccaacatcagggatcaggttatacttgtgaaccctgagacaatacctgcatctttttttttcttgaggctgtcttgctcgctctgtcatccaggctgaagtacaatggtgtgatatccactcatggcaacctccacctccagggttcaagcaattctcctgtctcagcctcctgagtagctgggactacaggctcacaccaccacacctggctaatttttgtatttttagtagagatggagtttcaccatgttggccaggctggtctcgaactcctggcctcaagcgatccgcccgcctcagcctcccaaagtgctgggactacaggcgtgagccactgcgcccggcctgatacctatatcttgaccaagctgctgtggaaacattgagttccccttgatagttttgtccacagagtgaatgtttaggaaccggcgaggcatctctcacccccacccagatggcggcctggaggcagcgtttctgaccctgtgatgggatttgtctctcttgtccaagagactttagagatgtggcccctgaatgtgggggcccctgttggggtgggaacgggagctggccctggccattgtccagtgaccccatctcagtgcctcgatcctagcaccctcgatctcagcgcctccccttccccggctccgcgcggagatcacgtggcttgcgctgagcaatcctccactgcccccgtcgcgttcctgctgcagggaagcctttccagggagccagctgacacatttggcctccattatttgtttttgaacaggaatgaaaggagagagtgagtaagaaagtggcaggaggtgggggttgcagagtaggggaaggtcagagagaggggaggaaagatctggaaagtccaggcatgtgctctggaagcaggtgccagcgatgagctcatctggagggtggccgcccgccctgagccctgcctggggccagcagggaacactctgccagggcatgtcgctgggagcctgtccttggctcactttctgctgctttgagcgctgagcagatttgtttccattttagggacaacgcaaggaggctgtcattccacccctcaccttattaatatttcatgaatcataagtgaccacttactgcgtcctgacgtactccaggcgctgggctcgaagctttatgcgcttcatgggatgtatctgcactatcgccgtagaaaacggttcctgttactactgcagagaaggcaccgaggcacagagaggttgaggaactggcctcaggccacacagctagaagcggctgaccctggctgtgaacacagggctgcttgactccaaagcctgagctggtttgcagcgaggctcatggtttctgtgccactgtttgagcctctggtcgagccccttggctcagtggggggcccagtgacctaccagctgttccattatatgttgtggacacctccacggcccacctgggtgggagggaaggggcttcaggaggtgggaggggtacagggaacacagtccagcctgcttgggcccaataccttgaccttcaaggtaccccttgagggtagcatgaggctaagctcttgttctcctccaggactctgttcctgtgagggcctcggggtcccttgcttttttctgggggccttgctggtcaggatcacagagaagctctttgctgttgatctttctgcctctgtatcttttggcaagccattttatgactcagttgctttgtctgtaaaatgggttgaataacattgtcctgcctcggagggtttttgggaggatcaaatgagacctgttgcacagaagccctttgtaagccatgctgactggcggtcgccgggcccccaagtgaatgggcatccgggcactgagtgtgtggactcagtactcggaaggaggggctggggggtacctagaactcctgggaggcttggacccctgctctgctcagattctgagcttctccttggccagtttaattcccatcagtagggtgagggtaaccaggacttacgcatagttgggcgaagtcgagtgaccacatgtggaagtctagcgtccttcatgcaaagtgggcaggcggccaaagtgagctctgctccagtccccccacccccggggctgttcctggcgccctgccctcccccagagccccactgacctgcaccatgtgacccgggcctgggaagatgggcccagctgtgggaggtcgtgcgggctggggactgagagtgccggaggagggcctcccaggaaaacccagctgcacaggaagccgggccagcggcctccggaagcctctgggctttgcaagctggactccccagatctgtggctgtggggccctctcctgcctgcagctgagagcccttgacccgcacctgagggcttcagaggtccgggagggggatgtgaccgtgtccccagggtgaagcccacccgagtgtcactctggatacagccctcacctcttcctggccccctctctggtcatggggacgctgcctggggggggttcccttacatggaaggagctgcagctgagctggcgggcctcgcacacccccaaggccgcctgacttccagcctccaagtggggttgcattcaccactcaggacctggagcctcagccagagagggaccctccactgcctctttctctgtctcttgggaaaggtagggtctttgtgccccctcccacccagggacctggcatgttgggaggctaagaggaagctgccccccgctcatctaccccccaaccctcccagccagcagagttttacctgtgtgcttagaatctgtgcgtggagccagaagtcacaaggttggcccagctgtgtctgaccctggttgtgcggtcttggacagtcccagccctcctggagctgagcatcctgatctgtagaggagaggctgctgtgccggccccgcagggccctgtgcagaggggagtgtgtgcggctgtgagttcaggccatgccctcagactggaggataggatcggaacagtgggtcaggatggccagagggtcccagcctcaggaggaggcctccacacctcccagcacctccacaccaggaaatgcagccaggcccccaggcctcccatgtcaggaagcagcaccccgccccccacctctggttgcctgggcctgagaagttgagcactcctcccgaatccgagtgccctctgacccctgcttgggtagttgtccctcctgaactgaccgcctgtcctacacagtcccctgtggtttgcccgacagggtggccagcgagtcccctgcacagcacacctcccccaggagtgctgcctgtgatgatggtgtaaagggtgcccccccgagcccccggaggcatgcagtggcgcaacagcgtgagcccaggagccccggtgagctcctggatggagaatctgttcagatcactccccagcctaaaccttccctgggtgtctgctgtgcttggggcgctgactcatcgtggggcggcctgtgagaccctacgtcacctggccactcccctcagcccctgttcactgcaccggtcccctggcctggctgctcctggaacatgagggctcatcctcacggaagaatattcacttgttccctcctggaaagtccctccctagacctcctggccgcctcattcaggtcttgctgaagcgctgccatcttggagaggcctccctgtcacccgcagttaaaacagccctcccatgcctgtgggtggctttctatggggcatggatgagtattggagagtcttgccgtttatttgttcatatgccctctgggagggcaggggacactgacttgtgttgtgggtgccttgcatgtcacgggtgctcagtgaatgcctgttaagcattaggggagcacaaaggagggaagcctctgtccaactggagcagtcagggaagacttcctggaggaagtggtatctggtctgcttagaatgtggcgatttgtctgtatgcagacattagattagagggcaaaggccattatcataacttagcagacagctacaagcagctaaggaattgctatgacatggactgctcgtgattggagctaagaaggagtcagagacagaggtccctgtgctctggcgtgagtccttgggggaggctgagctcccagaatgtggggccgcctgtgcagaggccggaggtgggagacacacctgtgagtgccggtgagtgtggggtgagccactggggctggatcagaagatgggaatccctaaacccaccaaccagccttggtgccctgggagtgacaggagacggggcttctgggggactaacccagcacaagtggacgagatgggatgcaggggaaaggacaaagctctctgaggctttgggaagctgagttagggtagagccatgacagggtgagttccagaagcaacacaagaaaaaatagctagactgggttttcccttcactgtgggagatgccccacctcacttcccccgtcctccgggctctggcaatgggctgggcacagtgaatgggttccatctgcaggagtggtcacaccccttgggcacagctgcctcatacactgtattgagatgggatccgaggccgggaagaacagcttcttctgtaggttgacattgtcagccttcggggagggaaggacggcagggggcctggagcatctccttttgccatccacactctgtgcctgcctgcagggtcttgagccctgtctgttctgcctcagtcctggtcaggaacttgttggagcccataggggcagtcaggctggaacaggaggagaccaggccggcaggggagccgagagggggccctggacagcacccagggctgagtcatcctgggcctgcccgacttgctatttggagctgttcccgcttgctcatcatgtgcaaggtcctgatccactcgggtctgtttaaccagcgcccctccccaggcccagttagcctggttttcgttcgattcatttattgtcatcagtgccatccttgcaccacgtaactagcctttgcagcatgccagccaccaagctcagggccctctgtgcatctcctgtaaccctcacagcaacccgggaggcacagagaggctgagtcgctggcccatagtcacacagcaggtatggggcattgccaggatttagccggatctctgactccagggcctttccagggccttgggtgggacactggcaaggaagcaaggtatgaacactggccctgccttggacagagctcggggacggtggcctggcaggcccagctgacacagtgaccctggtgcaggttcaaccattggcaaagtgttcaagtacacacagaatctcaactggggagacaggcgaagcggtcaagggagggctgtgagtgacaggtggacactgtacctactggcagatcagctgaccttggtgccttctggagcctttcaacttccttatccagaaaaagaggaactaacagttccacccccaaactgggtgggagtaccacattcgaaattgaagcaaagctggtcgtgtcacaggctcggcagatgttagctgtgcaggcaacttagtgaccatttgaagtaggctgtgcggcggcatcctcatcttgcagatgtagtccagagaggttagggcactaaccctgggtcacacagcgacagctcaggctacagagagcagtgctggatgggagggtgttggcagcttcaggcacaggctgggagggctgtggggtcagcagagggagggcacacttcccagctggtggggttcccttgtgcctcagtactcatgtgggcccaaaggagctggaaggagggaggttagagccacccatgggttcagaagctgataagcaggttattgactctgaatttgcctcatcgtatgtaaattggggacaaatttggggatttaatgatataatgtaagaagcagacatgtcacagccctggttatacagtcagtgtataataagtggtaagccgtcagaggaggcagccggtgagaatgggagcatctcagcagccctccgccccctgctcctggttgcagatgtacctgttcttggctatttgtgccccagctccgtgtcctccggtgtgtgtgaggccaagctcctggggtggggacttgggggtgtgtctgcagctcctgaggccaagaccaaggctgaggccgaggctgaggctgaggccaccttggtgaggaggaaattgcaggtggagaagctcgttgaccgtgaccttgatctgaccgtaattttgatggtgccgatgccgtcagcacgcaggcctcctgccctcgccacgactggctcctgcagcccacctggctgagaggtgtgctggctctcgcaggttgcaaaatggggacatcaccgtccgcctgggctacagcgtgctcgccgattgcatttggggagggactgagggctgattgtgttgtggggatgttggcagagaatcagagagggcatccaaaaaggccaacagttcggtggggagaggaggcgcaaggctggttcctgttttctgggctttgatcgaaagggaacaggggacacatctggggacagtctccttcctggaggaagaagggcttagggtgctggtgtggagtttgcacagatggggataatgagctggagggtgctgggcaggagctggccagtaataggctgacgagggaggccctgctggctgggcctggttttcaagtgagcatcctgagctgcggggacccagggggtcttagagacctcagagctgagactcgggaccacagaggggtgggctgtgctcagggcaacacagcggatggggcagatgttgcgaaacctgtctctctgcctctctttctcctgctacagaactggatcctcccagctcatggctgtcaaatcctttagatgcttctgggttccatgggcgccttacactggcttccctgtaggacagcagaccctgggggttggctctgatggtattcaccatggggtaccccatgcaagcacagtgctttcacgcccagcctcccagcctgtggagtaggcctgtgtctggccagcctcactttgtggccagaggagggagacagtggttctggagacaggagctggcctggggctgccctcccagcccctgttctcccagctcatctccttgccttgcgggtgctggccaccctccccccgccagctccatccccagctttctctgcccgagccgtgacctgtcagtagggggcagtggaggccttgaaagtccttggagaggactttgaagcagtttttacaaatctgtccctggaaagtctctcctgtcacacccccagcggctccctccctcctaacatttttcctggggttgtcatgcagcggggggtggaggaacccactaggccgtggatagagcagagccatgttgacacaaaccctggctgaacccacatgctccctacagccagcggccgatcactggaaccagggaagtgacctcatagcaagggcccgcagagcagccatcacgcattcccgatcttggtttctggacccagctctggaaaagaagccagatcctagccacttggagctgcctagggaagaccccagcctggtgccggctgacagctcactggaacttttcatctgcttggccaggtgatgccaaggggcagaggttagaagtgctaagaagcaggccgagggtggtggctcacgcatgtaatcccaacactttgggaggccaaggcgggtgaatcccttaaggtcaggagttcaagaccaggctggtcaacatggcgaaaccccatctctactgaaaatacaaaaattagccaggtatggtggtgcacgcttgtaatcccagctactctggaggctgaggcaggagaatctcttgaacccgggaggcagaggttgcagtgagccgagactgtgctactgcactccagcctgggcaacagagcaatactccgtatcaaaaaaaaaaaaaagaagaagaacaagaagtgctaagaagcatctgtcttcctgattgaaaagcaatctttgctgggcgtggtggctcacgcctgtaatcccagctttgggaggctgcggtgggagagtcgcttgaggccaggcgttcgagaccagtctgggcaacagaggtgctaggggtagtggcgcttgcctgtagtcccagctcctcaggaggctcaggtaggaggattgcttgagttaggagtttgaggctgcagtgagctatgaccacaccactgtactccagctcctgggtgacaggatgagaccctgtctcaaaaaacaaaacacaaacaaaaaaccaacgtttatcttttgtgattttaaaaatcacacctacttgtgacaaaataattaaattagaaaatgtaaaggaaatgatcaataataattgcgtcctccagacaaacactgttaacatgttcacgtttccttctagtctttttctacatagacactcaatacttattaatttgttttgaactaaagatggttttctctgctttgtatgagaaccacctcagccaggcacggtggttcacgtctataatcccagaaagctgaggcaggcagattgcttgagcccacgagtttgagaccagcctgggcaacatggcgaaactccatctctacaaaaaaacacaaaaattagcctggtgtggtggcacatgcctgtgctcccagctcctcaggaggctgaggcaggagaatagcttgagcccgggaggtagaggttgcagtgagccaagatcgtgccactgcattccagcctaggcaacgggagtgaaatgctgtctcaaaaaaaaaaaaaaaaaaaaaaaagttgccacgttgtcacctctctcagggattttcatcctttctacttttcgcccaagacttgccctgtaaaaggatgaggccaaatagccatgggagggtggtactggatgttcaaaaaaatgtttcgtggctggcgggacttagaaacaggttggggaggtttcagcagagggtggaccccagctgggggtggggggcagcaggggggcccctcacatgctctctctgcgtgtttcatggggctgcctgtgaggccgtgtgaaccagagcccggctgggaagccacatgctacctggactctgacctttcctggcagcatgaccttagccaatacgctcaactatgttcccctctgtaaaatgggctaatagaaatgtccactcgagacatgatgagaaacaaaggtgttcatagagcaaagtgcttagaacggtcctggcatgacaggagcccacatgtcagtgctgccgttggcatcgtcatcatcacggcggcattggctgctttgtttctcccttgtccctgtcaccttcttccctcagcaggctctcattcacttgttcatttattcatggccgaggccccgtctgtgtcaggcctggtgctgagaacgggggtagagagatgggggctgtgccctgctccctgacccaagggttccctttgcaatgtgaagttcttggagactggaccctcaggctgttccaccagcccctcctcaggccagcttaacccttccgtgctcgttttctgagctgttagaggaagagagcgggaggaaggatggagtggggtttttgtggggactgagcggggggtgtgtgaggccctggaaatggtgcctgcggcactcacgcagcattagcttttgctgcagttgctgtttggagaatattcttggatttcaggacactgatgacagaaggtggaacgctttttctggaagccatcaagaggggaccaccgcggcggctgagcagagttgctgacttgtgagctgtggcctgaccacagtcactgttctcatgagcgaggccccctgtggtccccctcccaggaatttctggccccttggcaggggacagttcagggctgggggtgggtagtggtgtctgcaggccctcttggagtcagagaatcccctgtcgccgtggcggggctgttccctcctgcccctcccctcccgctgtgctctcagctgctccgacaggatgcttttggcctgagagacagaaaccccaactctgaatggcttcagccctcaagagaatttggagcttttttgtgcaaaatgagatgttctgagcatcgaggatgctgtgggggatcctccatcccaccatctccagccgtggtgtccctctcggtcacaggatgctgcagccacgttgcagggaaggagagcctcccttcctgtgagcctagggagcccctccatgcagccccttcactggccattgcctgagacccgacctggtggctcctgccccaaggagcagaaagggggttcgctaggtcagggtggggctgggtgcgaggaccccccccggccaacagggtctgcttaggtgtccgtcctgttggggcagcagggaagggacccacatgtggcactgggacacggagaggcttttgtgcctgtgacggccaaaagggatggcgccccagccacgttcccacccaccccgaggcccagcatggccatgccggaaatagcagcatcgtccccctcactgtcctggcttgctttcaataggccagaggggtggggctggagcgggcgtctgacctgtggctggatctagctgcccgtggacaggctgtgagtgaatctgcagaggaagggagatgggaatgccgggaccttctcctgcacctcccgaacccccgttccctgtgagttagatggggagtgcacccctgccctcccctcctgggtatcccctgcgccccccgccccaggcacttgatgttgcctgttcattttccctctctgcccctcccgctggcccttcccatatggtcctaattaggaccttccgcccgttggtggatgggcagagaggggagcttgctgtggggcctcccccgatcgggggacttcccagcacagagctttctggcctctgcagggacgctgtgtgtgcctgtgtgagtctggcgtgttagaagcgctaagctgcagctgttctgtgcgtttttcacatttctcacttctcaaaggccctgggtttggtgtctgtgggctggggatctgtgttggggtctccaggaggcccttggtgggagaggcagggccccttcccctttaatctgggcaaccttgctttggcctgctgtctgcggaaagtgccctaggatacggtggcaggactggctggggttctggctccaggcccagccccagcccctgtcagacttaccctccttgtgcctccgttcaccctgtccacccgcagggcctgcaggagcatcctgagagttggtagggtggcctgcccggcgtccgcacagggtctgctggtgggtggctgaggctgcggtgaggtctccatggctccctcgtcctgcacatccttcccttgttgtgttgtctcgctagcatatgagcccgtactgcctctgagtctgcagcctgttttccttaccaggtggctaagcagggtggcagccagggtggcagagtcccattggcctgcaggggaccctctgtgggctgcaggtagtcccctgtggttgaaggtgccctggcaggacctgcaccatgacccccgtcaaagctcacgtccaaggcatttgtgggcacccccgccccagacgtgagggttggcatcttctcttgcacgtgaagcaaaggcctgtttgaaggagcgtgtggaagcctgggtgtgatgaaggcaaggaccggtggctcacccctcttgcacctggaccttgggtggcaggcctggggccttcagtccttaattcaggagggtagccagtcgctggaactaagagtgaacttcagctgttgttgccatagctggagggaagaggggaaaggaggcgctgcaggggagcagagacctcacccttcctctgccgacatcaggctgccggtgctggacggggccctggcaaccgtggcaggagtggtgatgtccgatgatggtaacaagggcttcctgaggaccccgagctgtcttaagggctctttacctggagtaagtatcccctttaatcctcccaacaacactgtgaaattgattctgttgttattcccatttcaccgatgaggaacccacagcccagagatgttaagtaacctgcccaagcctccctctgagcatggcagagggagggtccgaatgcggaaagtctggcttcagtgcccccatccctaaccactgtcatttacctcttcggccagccctctgattgcaaaacctgaggcccagaggagtgcagtgacttggccagcttcgcacggcaggttagtggcagagctgagcagtgtctcccatgccctgattctgtggcttcttgaggtggctcacccctaaacacgccccccatggtggctctgtttcctcctctcctctgaacctgccagcctgtgctcaggcagggggagaagtagagcaaccatgccgggcgggtcgtcgtgccccagtgccgcctgccctacacctgattggcagcagagtggcccctccttggtgtggtctggaggtgccagtggtcactcatcagcacagcccagtctcacacatgtcactcccaaaggatgttgacacagaatgaagcagctaggggaggcggacgctttggcacgagggtggcgtttctggtaatccgtagtgctgttgtctgtggctgcctttggctggcatctcacctcctcctggctgtcctgcagccacctgagggaggtcagcatgtcgccttcatcccaggacagtgtgaatgcagcagcgcaagcttgccagcgccgcactgcgggatctggaggcctttgctcctgagccctgcctctgtgtaatccctaaagcacggacttcttaggggcttccattcctccacctggaaaaaccttacaccgtttagggcttgaggcagggctagagcatggagacgttgctggaggaccaagggagaactgagcgcgtgttctcttggcctcagcctcgtgtgtgtgtttatgcatgggtactttgccatccacactggcttccacggctgggtgggagttgagttgagctcggcggctgcctttccaccctgcgggcctggttggggagtgtgaggatgcctgctggaagccaacgtgcacgaaagagttaatggtggatcccatttcctcagccccctctccagctttcccagggaaagggcaggaacagagaggccttatcttcagaggaaggggtgggcggggacacagcgctgttcggcacagtcccctctgagccaccctgcatgtttcattccaccgacttctgcagcccagctgttcagagcggatccagaaggtggagagagggtttccaataagcagaggatggagtgaatgtgagattcattactgggatttggcaaagcaaagagcctcactttctccccgcagatgggacgggggcggggctggagccagcggggtgggggtatccagcaagagctccttcccatcctcccacttcctttgccatgggccccctcctccacgcagaccctcagcctggaatgatcagtgtccagcttttctcgcccctctcctgccccgctggagggagtgacctggcccctggccccggccacctacacctcctgttttgctgcactagcctcgtggtaggggctgcggcggaggtgggcaaaagccgcttccgggcagccagcccccatcctgggagtgactgaaagtccttgggggttcctgcagggtgagctgcccattctggccctggtaaggacacccaggagagggccagggtgcctgtatttggggcacagcataaagaacagccgtaagtgtttctcaggcaggagggtgccgaagcattgggaagctgggatttagaagcattgtttggggtggtgagtggaagatgcaggacacagattcacgcgattgtgcagatcacctggcctcactccctcggtttacagtggaggaaactagaggccgagagaggtgaagtgagttccctggggtcacacagcctagccaggcccagggcgccgacctcctgctctgccttcccgtgcccattcggttggcatcagcatccctgccttgacacccccgtgtggcagctgctgtgattctgtgactcctcctcaccccaccccagtggggccctgcgagggaaagaagaatgccctatgcagaagtggttggaaagcaagaagcctggagagaagtgaggcctctgtggtttggcctgagtccaggactcatggcctggttcccagggatggagcaccgacccctcccttctacacccccaccccacgcccccaggagctccctatggggaagccggaatggacctgggctcagagattgtaaattcatcttgctggatgtgtggctgcctttatgtaaccaactctctcacggagaagccaggggatggctctcagtactctcgggggtctctcagtgaggtgggaggacctcgagaggtcaggaggctgctcaagaccttctgcccctcagggaccaggtgagggcttgtcgactgctctgacctcctgatgcttctggtggggagacctcagaggggcctgccgtcaccatcgccagtggccctggcctgcccagtcatccttctggggtggccaaactccatgctgcaaaagcccaagtgaaccccagtagtggcctgggagaatcatctgtcacgagccaaggatggagtttctggggaggactttctgctgccccccaacccctttcgggtacattctcctgtagccccactccctgtaagaaagtcaggtgcctcccgaagcttctccctggccccaggccagaggtgacagtgggggccccttgcttgcgctggtgactgtggctggttgttggtgcctggccctgccctgcactgtgcacccattgaaggcggcatcatccgggcctctccggtggccatgcatgggtgagcagcccacgacacatctgcttccagcatcgtgtgggccggggctttcagaggggctgagggcttggatggccctgcaggggggtgctcctggccttgtgaccgaaaggagctgaaggtttggagaagccgttgggccgaggtcagttcttatagatttggcgaggagggaacagatgctcacggagctgctccaggcactgcacacactgcctcactctgcgctgacagccaagaggctggttccccgccgacccccattttacagataatgtgctcccccagttccttagtggtggagccaggattcgaacccacgcaggcagcctcctgggcctgtagtcctacccttcatctccctccaggacctatgtcttggggttggcaggataatgactcccagagttgagcacatcctaatccccagcacctgggactacgttaggtgacatggcagggccagctaaggtcactaatcagctggtcttaaaatagggagatgatcctggatgatccacacgggcccgctgtcatcacaagagtttttaaaagcgcaatagaccatctgaggggtgcagtgggagaggcttggaaggaggaaggaggccacaagccaagaaatgcaggtgaacagaaaatgcaggaaaacgcagtctcccctgcagcctcgggagggtgcgcagccctgtggacaccttccctgtagcctagtgaggtggagtgtgggactaatctgtgttgtttgacatcacaagtgtgtggtcatttgctacagcagtgatgggaattgaatgccattaggcagcagtgcttctatcccggaagaattaggataaattcccctgtggatctcaagctctgggagattctgggctcctctggactgctccagttctgcaatcataggaaaggtctcccatgtctgtttgggagaagaaaaccccgtagcaaatccatttccccttttgacaaatgaaggcgagggtgtgggctggacacatgtttcctttttgtggattttttttgttttaacacttagaattctgtagctgaaggagactttggggggttgtctgcctgatttgcaagtgaagaaatggaggcccagggaagttaagtgactggcccagggtcatgcagagtcatgctggaatatcaagctagatagcccagttcctgctccaaagtgctttcctccctggttggggaggagggttggagggagtggaccccgagcaacagcagcattggcaggggttggaagagtagctactgtatccaggtgctggagcctctggccacttcctgcaggaaccaggtgacccaccatggcacaggcctctccctgtctatctgcagccctgggggccccagggaccagaggacactctggcctgagggctggggcctgagagaagagatggaagtacccctagtctggcctgcccccgtggcgtcctgcaggcatatccggcagcccaggggtcctagagaacttggctggtgggcgtccccaccttgccgcagctgcaccctgtggccagcagcttgcaggacttgggctgttgcctgtggccctgaaacagtcattttctgagctgagtggggatcaggtgagcagatccccacaccttaactgctgtgatctttctgtcctggaggctggtgggcagcctggttggtgcttcatggcactttatgaccggccctgtcaccaggctcgtgagttgctcccctcctttcgggcatcctgaacggcttccctgagagccccgccctgggccttcgcctctgcaggcccccgctgcctggggcgcctccttcccctggaagctgggcctctttggggactcattaagaagggccttgccgagtgctgccaaattgccccatctggtccccatttgttccacttaccaccctattttaacttttatgtctcctccttggctctaagatctgagcaggcagggcctgtgaggcaccccaggtcccctgatgctgccagcacccaggggactgttagtacatatgcagggagggaaggaatgaaggaagagatgacttggggagtcctccagttcccatttgtaactggcacattgcgacaaaacactcatggcattttacctttttcatataccttttttttaaatttatttttatttgagatggagtctcgctccgtcacctaggctggagtgcagtagcacaatcttggctcactgcaacctccacctctcgggttcaagcgagtctcctgcctcagcctcctaagtagctgggattataggcgcccaccaccacgcccggcgaatttttgtatttttagtagagatggggtttcaccaagttggccaggctggtctcgaactcccgacttcaggtgatccgcctgccttcgcctcccaaagtgttgggattacaggcgtgagccactgcacctggctttcgtatatctataaaagagaatttgcccagaaaatctttcagatgcacctttagggttttaaggcacagatacatgaagcttgtcagtgagcagctgctgcttattcctttttctcttccaattcagagcggcctgcgtcccaagcggacagctgctcccttcctcttggctccctgctgcccacgctcccacagaagcagggagaagaggcaggaaggtgacgcgtgatcatccgctgggcgcccgcacagtgccgtctgcacaggtgccatctcctttacttgtcactctcctcgctgagccctttcccctttttgcagatgagagagcattgcctcccagaggttaagaaatgggcccagagtcactcagctgatcagcgtgcagccagatttgaaccacatcctgctgatctccatgcctgcaggcctggcctgatgagatggacagctgggtggtggagaccttgagaccctggatggctcccaaatagggcctgtagctcctggacagggagagtctggcacaaagggtttgtggagtgagctgggggagaaggtggcttagggtccctgtctctgaacaaacagatggaggggctattccagcgttttctcagcctctggtgtgctgggctcctggttctgggaggagagaatggagctggcctccattctgggctgggctggtttgggcccaattcagacaagcttcttagtttgccatgagtgacacttttgcctgccctggtgtctctgccaaaaatatgaagggtttcagaacccccaccccggcctgcttccctcccagacttggagtgggtctggggctgacaacagtctcatgccagatagcctgagcagccaccagtgccatcaggtctgacactgcggcccctgccccggagggaaaaacaaggccctctctgggggattttctgccagcttgtgaaaacaggcctggagtcagccagcgcccccatgcttagacacttcgtgtggttttcaaagtgcttttatgttgctagctcatatgatcttccccaaaaccccataagggagggcaggaagtttgagcaacagcctgtcaagcacccatacagcaggtggtttcattgccctccatttacagacaagtaaactgagcttcagggtggctaccgcttgtctcccaagccacccagccatttagccacggaagaggtcatgactttttacaccccagtgaagctgaagatttttctttccgtttttaaaaatgtttactccccagggcagtgaacacctggtgcctctgtctagcgcaagaggtgaacgtttgccacttccgtttctttcctcctaccagacctgaccctccttttgtgacgggaacatcctgcaggcagtctgtcctgctttcatagactttgagaaacggggtccaaattgccggctgtgggtgggacaggcgacactgcagtgaagaggtggagtatttttgtagcggggaagaaatacatttcctctaccctcttaggttcagtgtttgggggtctgtgaattaaactcactcaagataaattaatgagagaaaagacagatttaatcacatacgtatgggatttcactgaaaaacgtgactcaaaagagcaggtagaaggtggggcccgtgactggtccgaaggtagtgagttatctcagttgattgttcacagtcagttacagattagactccttgttccactgtctcccctcttcccacttgttttgttttttttgagtcagagtcttgcactgttgcctgggctggagtgcaatggcacgatctcggctcactctaacctccgcctcccgggttcaagcgattcccctgcctcagcctcccgagtagctaggattacaggcacccaccaccacgcctggctaattttttgtatttttagtagagacagggtttcactatgttggccaggctggtctcaaactcctgacctcgtgatctgcctacctcggcctcccaaagtggtgggattacaggcatgagccactgcacccagccaactagtcttaaaaaaaaaaaaaaaaaaaaaagaacttagggcccgtatactatcttaataggaaaaaaggaaggggtgaaagcacatattatgggccgggtgcgatggctcacgcctgtaatcccggcacttcgggaggccgaggcaggtggatcacctgaggtcgggaattcaagaccagcctggccaacatggtgaaaccccgtctctactaaaaatacaaaaattagccgggtatggtggtgcacacctgtaatcccagctacttgggaagctgaggcaggagaattgcttgaacccacgaggcggaggttgcagtgagctgagatcataccattgcattccagtctgggcaacagagtgagactgtgtcttaaaaaaacaaataaaaaaaaaaaagcacatattatggcaaaacaaatgagtttttggaaagataaataggcccttaggagctgagatgggagatgtgaagtcttgtgacaatgtcttcttaggtgtggtgtggaaactactcacatcttccagggaagagtcagttgctcccagggagcagatttgggcctgtataccatcttaataggggaaatggaaggggcaaaagcacatattatgggctgggtgcaatgtgcccagtgcaggaggcagacgtggtttatggttgctgttgaaaccagtgcagggcccgattgctttgtattgagtgttgaggatcctggttttgtatcagccatgagtttgcagctctgggacacacttgatgttggctcaaggggaaatgaggttggaggggcagggtggttggattggatgtgggcctggggccattgctgatctacaaagtggtcatcacacgggaataatagagctggctacagaccacaaccagcaatattatttaaaagtaaggtcacacttttaataataagtcacattttaagttattatcaatttataaaacacactgttggtataatgatagcttttcaagaaggatataaaaaggcatgttgggctgggtgcagtgactcacgcctataatcccagcactttgagaggctgaggtcggcggatcacttcaagccaggagtttgagaccagcctggccaacatggtgaaaccctgtctctgctaaaaatacaaaaaaaaattagcttggcgtggcggcgcatgcttgtaatcccagctacgggggaggctgtggcagaagaatcacttaaaacctgggaggtggaggttgcagtgagctgagatcgcgccactacactccagcctgggcaacagagccagactccgtctcaaaaaaaaagaaaaaaaagaaaaaaagtaaaaaggcatgttgaaggtacctgcttgtggaaagttgcaacttgacgggaggtagggcgagcacttcttagaaaggtggaaatgggccctcctgctacagagacccacaaacatagactgaggcctgcagcctaggagactcaaaagaggcaaaggtgaataagagtcaaggtctccaagtcagggtctgactctgggggtgggggtcacatatgatggaggatgtcaggagggcttcctggaggtggtgacatttaccaggggggattttaggtggggtttgcgagacagtaggacctggctgaagagcgtaggctccttagacaggagtgggaattcaggcttgaaaatgagttggccagattgcaggggtcctcgaatgcaagggaagaatttcaactttaacagaggagcctgggaagctgtttgggaaaaggagtgataaagcgggaggggtcctccagcagagccctgcatgggcaggagggagcgagatgggaggtgggtgttggtaagggatgatcccagtggtccaggggagcagtcatagggtggaaactaaccttgtggggtctgggcaggaagggactgatttgagacaccgggaagaaacagccagtaggactttggtgagagggctgggggtcggggaggggggtgtggagagtgggagcttgagtctctgaaaacagacagtgttccaagggggagacctgaggcaagatgtggagaggcagctgagctgggaagctggaacggaggtgtggtcactccaggagactaagtcagggggcgaggggacccttgggagctatctagaccccagcactagggaatacggaggggagaaggaggggagaagaaccagctggtgcgtgtcaggcactgccctcgaggtcagatggggtggggctggatactggccatgaggattttttcaagagctgggttaatagtgagacgggcggacaccagatggctcgggctaagaagtaagtgggcggtgggaagctagaagccgtggtgtagacctactttgagaggttgggctgttcagacagggagaaagttcacagtttgaggaggtagataggtcaaaggaagagggtttgcttgtttttgagattggggcatcctgaacgttctcccaggccaagtgagaagaaaccagaagaggaacatgtcacccaaatgtgctgaaacagcccagcagctgcgctgcctcacagaaaatgtgcagaggcccctctgtcccaccatgcctgcctggggacggccttcactcgggctactcagggtttccccagcctgccaacccaagggtggcaggagctgtgggtgctcccagccccttctcaaggttggtctgtgggtagaaatgtgggctgcctcggggcgtcacagctacaaatgcataccagccctcagaaccacattcctgctccccagccctttcctccgcacccccatgcagaagcgcggccgccagctcacaaaggatagggagggatattgctcttggcatttgatgggaagcatctgctgcatcccattggggtgttgcccaggatggattggaaaagagttggcaggaaggctgagctctgtgctcacaacctggcttggtggtggccgaggagcttggcaggagcagagtgcaggacctgggaactgggggttggtgcatgtgtgcacgcacgtgtgtgtgtgtgtgcgtgcgtgctgggtgggtagggaggaagctgtgaaaccacatcccctcctctctgctgctgtgttgctgtgtgtttcagcagcacgtgggtgtcaccacacttcctagcaggtgtcaacctccaagactgttctgggctcttctcccagttggctgagttggaggtgggagtcccaactgtcccctgtggcttccagagtgggaccttgctgtgggataggctggccaatggtgctccctcccctgtgacccttctgttgggtgggtcacgaggaaggactgtgggtgttgcccacagacaggtggacatgtggcaaggacaccttgggaccttctttctgacgccccttgaagggggcactttctcagctttgagatgagtctctgtggatgtgggaagttcactatctcaagagcagcagccttggaaaatccaacacagaaccccgagtaggggcgggaaggggtcctgtcccgctcactggctgcctggcagagttctgcacaaggaagcgcctgtgttgctgtgggcggaggaatggactgagggctacattcgcttcctgttgccgctgtaactgcttatcacaaactcagtggcttaaagcaacagaggctccttcctttacagtgctaagggtcagaagccgatcagtctcaccggactaaagtcaaggtgttggcagaatccattcctgcctcttccagctttgggtgggaggctctgctggagttccttggcttgcggctgcatccctccagcctctgcctccatcctcctacagcctcctccttctctgcagtcagatctccctctgccttcctcttttttttttttgagacggagtcacccaggctggagtgcagtggcacaatcttggctcactgcagcctccgcctcctgggttcaagcgattctcctgcctcagcttcccgagtagctgggattacaggcatgtgctactacacctggctaatttttgtatttttagtagagacagggttttgccatgttggccaggctggtcttgaactcctgacctcaggtgatctgcctgcctcagcctcccaaagtgctgggattgcagccatgagccatcacacctggcctgcctccctcttaaaggacgcttgtgatttggggcccacctgggtaatctcttcatctcaacatcttcagttacatctacagagtccctgttgccacatgaggtaacacagtttgggaagggagagttattcagcctaccctaggggcctgtggtgtatctcagggcccttctgattttaagatataaagcaagaaaacaaactggctcaaggggaaaaaaggacacgttgaattctgttgctttaaatgtatatttttttattgtgctaaaatgcacagaacataaaatttgccattagtaacactgagtacattcacagtgtcgtgcaaccatcagcactgtctagcgccagaactttttcatcaccccaaagggaaaccccgtatccatgaaggactcactccccattcgccctctccagcccttggcagccaccagaatgctttctgtctccataaattcatttttaataagtgcaattctgtgtgactttaaaataaataaacatgagcacgatgagttgcttattggaaggatatccatgcggggaggccggcgtgtggagtgcgtaggcctccggacgggcaggagttgaaggggcgtggatgtgccgccctctcctccccttgctctttccttggggtcactgcctgagtatccctctttgcaaatggccccaaataatgtctcagcccccacgtctgcatcgcctcctagcttcaggaccctccaccaaaaaacattccaagcttcagactcactcctgggaaaattccaatggcctcactctcccttttgagccagccagatcccatggcctgtggcgggctgcctttgagtcctgagcacctgtgagctagggaagcaggacaggcacacccagggaaggggaagagtcgtcgtcagtcacagtaattgatatctttggaatcgtctaagagatacttagcgtgtgcctaaaacattcatttctttttttgtttgttttttgagacgaagtctcgctctgtcgcccaggctggagtgcagtggcgtgatctcagctcaccgcaacctcctcctcccgggttcaagcgattctcctgcctcaacctcctgagtggctgggactacaggcacacactaccacgcctggcgaatttttgtatttttagtagtgactgggtttcaccatgttggtcaggctggtcttgaactcctgacctcaggcaatgtgctcgccttggcctcccaaagtgctgggatgacaggtgtgagccaacacacctggccacattcatttcttaggagaagctctgcattttctgaaagtgaaatgtccccaggcgggtgacactgatggtgggatctgtggcctcaccagtgtcttatgagagatgccgctgtgtgtttcaccaagctgtatcctattgtcctctaaatgtggcttgtagacatggtgccgagaatgatctgggaggttcaaatcataatatggtccaaatcaacagctctctgatgacctggtattatcctaggatcaaattgagactatccgaggatgggcgtggtggctcacgcgtgtaatctcagcacttcaggaggctgaggcgggcggatcaattgaggtctgtagtttgagaccagcctggccaacatggtgaaaccccatctctactaaaaatacaaaaagtagccgccggacatggtggtgtacgcctgtagtcccagctacttgggaggctgaggcgggagaattgcttgaactcaggagacggaggttgcagtgagccaagatcacgccattgcgctccagcctgggtgacagagcaagactctgttccccggcaaccaaaaaaaaaaaaaaaaattgagactctccgagctgcactgtccagcatgatagccactggctgcacggggccatttgaacacctgaaatgtggtgattccaagtggagaggtgccgtgtgtgtgaagtgcactctgggtttcagagtcctagcaagggggaaagaaaagaatatcaaatatctgtcatttttacattgattacatgttgaattgataatattttgggctctgttaagtgaatgatattaaaattaatatcacctgttcttacattttttaatgatttcctttttcttttcttttctttttttttttaaatatggggtctcacactgttgcccaggctggagtgcagtggcacgatctcggctcactgcaacctttgcctcccaggtttgagcgattctcctgcctcagcctcccaagtagctgggattacaggtggctgctaccatgcctggctaatttttgtatttttagtagagacagggttttgccatgttggccaggctggttttgaactcctgacctcaggtgatctgcccacctcagcctcccaaagtgctggtatgacaggcgtgagccactgtgcctggcttgttcttacattttttattgtaggtgctggaaaatgtaaggttgcgtctgtggcccatgtgccgtttctgctggagggttggaccgagggccagccgagaaggctctggggctgctctacctgaatgctgagtgtgtgctgagcggtagagaactttgagaagtgctgaaggacagaggctttgtgtgggggatgcagccccaggccggagatgccttctctgtgctctggagaccctcatttggtgacagcaagaggaaccactgcaagaggggcggccacctcagcaaagcacccaggatgctggcctcccagctcaggaatccagaggcagaggaggggaggaggctgggcttggaggagagcagggtcttgggccctgggaaaagcctggggggccagaaagctgggggacagattgaggccagaggcaaagagaagaaggttcggagaggagggccaaggaagaagggttctgcccacggggagggagaggcccacggggcaggggcgtggtgggagctgcatcctcgaggctttctgttgaccctgacacctggccagaaaggagttccttctggcatcctttgtcagcggtttctggagctgccctttaggggccagtgatgagggtgccctgggctgggctgcagacagtggaaaagacaggctcttctcactcccagtgctggggaaattagcttcttggaggaagggggagctgtattttctgagtggccgcacttcctggcctagacgtgtgtgtcttgctgtaattttggcgactggtgttggtggtgcccattttatggatggggaaggtcaaattccacagatattgagtgacaggcccagggccttggatttcagtgtttgactcagaacccaggtctctgatctgccaccagcctccctcccattcagatgggaacagggactccgggcatgcagtcttctcccagacactcccccggctctggcctggcgcccggagaccagtagcagcagctccccacggccgttcactgtgagggtggggagggccgtgggaccaggaggccttagggggaaagttggccatgaggagtgggaagcgacgggtcagatgccagtgactgctggctggggagccgctggacgtggctggcctgtttggccagtgtggcgggtgccccggggcttcagtcacccccagccacgtgtgggggtgcgggatgggaaaggtaagagtgtgtggagcccagtcagcactcaacatgaggtcccgtgggggctgcctgagggcgtagcttccagaattcagcccctggccctcagaaggtgtcaccaaaggcttctttccatttgagtgaatccctcccagcccccagcaagccctcggaacgagcccactcccaggcgctctctcctagtgtgggagtggccacgcccctgctgggagtgactcacttgggttcagaggtcgtggcactgagatgggtctggcagatcccagcgtccaggcccagcccctatagtgtcagctccctcctctggggacccccttgcttgtgcccctctgggtcccagcacatcccaggcctgcagggagggggagaggaagagactgactcactggccaggtcccccaggggctggagaggctggagaggcaggagctggatcagatctgaatccagaggctctcggaggaagagctcagggtgagctgcgcccccatcccctgcccctcctctcctgctccttctcccttccatggtcccagccagcaagcacctggggtagaggggacaaacccaggtggctgtgttccagccctggctgcaggtctgaatggctttctggggtggctggccatgctccctgagagcccagctgtggcgatgtctgagcaggtaggtgggggagcacctaggaagcaggggtgtcaggcagagcacaaggagagagggtgtccaggtcagtttcaggacctggctgagaggagggggctcctcacgggcaccgcctctggcaagcacagggacaagggcaaggacggcatggccagaggtccctgggagcctcttcccctctcttcttcctagcagctccccctcactcttcccagggaccctgtcactttcctttagcgtgtggcagctccttggcgtccctcccgtgccttcaggttgcttctgcgccgggcctgccgctgggcgcccctatctctgcctgccccctcctcctgctcccctcgccctgcccccttggagcaattccccaccgagcctcccttcccaggcagtcgaggtccctccctacctctgccccgcgctctgggaggctccttgttccgcgaccacaaagcccctttgatcctctgctcggctctgagccatgtgacccggtgggcgggccgcggctctcggcgcgtccagcgcagcccgacgttccgctgctggggtgagtcctgctcctttgttcttcccagccttgcaccactggctcgggggctctcaggtggcgcggccgcgaggcggaccctgatggccatggtggcggtgccgggagccacgctgtccctgggccccggcccgaggccggcaggaccgagcggggtccccaggagaggggtggcggggagctcgatctccacgcggggaccagattttcggcctcaaaatagaagaatagggctttgtgtggtcacagctatctctttgtaaatatttggccaactaagctgagtggctaagttctcctgctgcccggagcttcttggaacatgtttccttttcgcaaggggtttccctggcttccaggagggccaggaagaaattcgaattggccaccgctttctctaaaatcactccgctcaagttatcacccctctgggctcccgaagaccggctggctggaggctggagatagtctcaatgctcgaaatgccgtaaccgaagctccccgcggcgccggcactgggatccagggagctgctgctacagcgcagctctggattcctggatgtgttggatatgtgcagggcgttcctgggaggagcggggagggagggtgctgctggcggggctggtctgcgtgtgctttgcttctctacaatggcatgctgcgtgtcggccatgcagaggcatgtcagtgagcaggggctgagggatctccctaacggacctgctttcagagggtcttttcatgctgggagaaccccagagactaaatcatgcagccaacggggtggtccccggcctcaaagcagggaggggcgaggagctttgtaggcaatgccatctgctcctgaaacgccgtcccagtgactctggggactgactcagcctccagcctgctgcacttcatccctggcccctctctctttgctttttcatgtgaaatctgctgtgttttggtcagaggtttggggaacagctctctgctcatctaagataagtttgtaattcctttcctggagaaaaatatgccacccggaagcaggttgagcagtggttttctggcaggtctgttcggggctgtggagacagcacctgctggatcaggatggagttggaatttggtttggatcccacatgagaaaacccgttggaagaggaggaagcagaaaaaggccccattccctaataatgctgtgggttttcctcctccattcattgccaccttgccttgaaacttaatggggccacgtgtgtttccatgaatgtcattctctttggccaactcccccggcagccccaggagctccttttcaggaaaaggaagaaggtgtttgcttagcatctagtatacgagtccttgttggaaaggtgggattcttgtttctccttgggtctcttttaggctgagatgtggtcaaggaaggcctgtggtgtggctcgccttttttaatgctcgtctctggagacctgagttgctgctgactcccagcttgccccttctgtcccctggccatttctgtgtcggggtggctgagacactattgcattggccactttgtgttcccactagcccccgcccctgtaggctgtcattgtgatggtgatggggccaattcagctgcggtggggaggacccactgtgtgcgcctggggggtggcgtggggcactctgggatgagaagatgcgacttctgccctgagagccctgctttaatggaaggcgggggcatagttgcaggcagaagccatcaagcactgtggtcagaccagcattccatgtcaaaaatggccttgttggccgggcgcagtggctcatgcctgtaatcccaacacttcaggaggccaaggcaggcagatcacctgaggtcaagagttcgagaccagcctggccaacatggtgaaaccctgtctctactaaaaatactggctaatccgggcatggtggcgcgtgcctgtaatggcagctactcgggaggctgagacaggagaatcacttgaacctgggaggtggaggttgcagtgagctgagattgtgctactgcactccagtctgggcaacaagagtgaaactctgtctcaaaaaaaaaaaaaaaaagccttatctgggcctgggatctgtcctccgaacactgggtccactgtgctccacaaggactttcaccccggaagccctagacccacttgggcaaccagagtctctgggttgaccactccccagccctggccagcctcctgggccaccgtattctcccaacttcctgttgtgccacggctggtccaagctgctcttatcagacaatgcgaggcacttccacaggaggggacaaccccgtccttaggagccccttctccctgcccccaggcctggtgcagtgtgtggcttccctgccggtgtcaaaggtctcaaggcccctttaagaagcctgtcaccaccaccagcagcttccgttatctggttcttctgtacatgtaagcctttcccatacaccccggatgtttagggcttccgccctctctccctggccgggagtgtgggaagagggctttatttcaatgcttgagagtagggtcaatggccagggtaagctgtgggggctcctccccgccggcccctctctgcagccctcaccttaacacagagcatcgataccacctgggctttgggaagacctggaggctgaccaccctggaggctcccagcgtcccacagccactctttggggaagaggcttcctgagggacttgtggcccttggctgggactctagtcccagagttctgccttccggcgccgagctttgatttgtttattgagtgccagcccggttcccggacaggtagggacctgttcccggagctcagcagagccttgggaagctttcccaggagggctcccgagggtggcggccatgcccagtccgctgtacgtgtgagtttgtttgatgaggaattggctgggaaggcgcgggtctaattacaggcccatgagggtccctctcgcccccacccaggaagcagcggagatcctggcacactcagcacctgggcctgtgcctgcccagctgctggtggaatcatgggagccttgctccggggcctgtagagcagcagtgggaaccttccccacctcagcccctcccagagttggctgttcaaactcgccgccgctcagcctcttcctcctctctttcatcaaccctgggaatcgcacactgcccaccccaccgggccccggagcgggtgcaggaagagagagcttaacacccagaggtctgggccttctgcaggcgcctgagctgctgtggcctgagctgggttccctgctggaaccatcacagtagacctaatgatctgcctgcaggagttgcttcatcccagccgactccggggctgcgggaaggggctgggccttggttttgctgggggtggggggtcagtgcaaagggcctgaaaagtggcagaggtgatggcccatctgtcctccccctggccggccggcctaaacgcgattggctctctttcttttttttttttccctcccttttccctataaataacactaaatgcgatttgtcaatgcattcatttgggttcagtagttggaccatgggcagaagcactccagatttgtcactttccctaagctaagggtggggaacaccctctgtgagatcttggctcctgagcgcccaagactgctcttggaaccccaactctgggtcggtctcaggggactgacgttgatggagttgctgacattgacctccggcctctgcatggccttcaggaagggggcccttcgctctctgtcccgtcgagcctggctggcagcactcccttctcaggcctgtgcccccggcagggcctgctgcccccgccctgctctgtgggtgccaggctccaagcaccaggtgactcggtcactgaatggtcactgaacagtcatccttgctggtgtccccagtggaatgtgcatggacgtcctccctcccccagatccttgtcttttatctctcagcctttgttccaggggccaccacaggaccaggaggtacgcagacgtgggtggcacatccactgggcagattcagccctgaacctgcacgccccctccaagggggcccccagcgggcggggttgatggtgccgtctctctctctgtcactagaacggacatgaggattgtgtcttgtcgatccacgtcctgagttcccagacgtcataggtgcttgctcaacgagtgtttgaatgaatggtcagcattgtgtgaccgcagattttcaacttttatccaaatagtttgtggtttctgtgaggctatcccgagacagtctcacaagaatctccattctccctgcacgctccgcacaaggtctccttggggggtttttcagaaaaagggccaaagagcagcatttcctcggggatttgaacacgatctcccccggggcaggggactgccctggaagattcccggcaccgcttcccatgcgccacgtgactaggagggtcttggggcaggatggtgtcttttgtgccttgtgtgctggggccggaggaaacactgcccgtggccggtgtcatctgccagccctgaagactaatgatgggctggacagtggccccattgagtgggagggagaatcgctgctgtctgtagctggggggccgggtgggtgggagccgaggccagggagaacagcgcagacctggcacggagaggcctggaggaggagcagggggtctcagccacccagggtgcagggacgccacacgaggagcaggtgtggtgtgcgtcctcctgcgggttctccacctcttggcttcgttacctgcactaggctttgtggtgagagggcacagagtggaggaaggtgccgtggctagggcaggccacacgctgtgctaatggattgctgttacctgtcgcctctgtggttttgctgtcaggatcctccagcaccaggtccccaccaccaggtatgggccccacaggcactactggctccccgaagccagggacagaccccatagacaatactgagtccctgcagccagggatgggcccccacggccagtaccagatctcagggaccagcaccgggtacccacagccagggacaggcctccatggccagtaccaggtctcagggaccagcaccgggtacccacagccagggacgggcccccatggccagtaccagatctcagggaccagcaccgggtacccacagccagggacgggtccccatggccagtaccaggtctcagggaccagcgctgggtccccacagccaaggacaagtccccacggccaataccagatcccagtgaccagcactagatgtccacagccagagatgggcccctatggccagtaccaggtctcagggaccagcgctgggaccctggatgactgaaggagggcacggttgactaaagctgcaggagccagcctggccatcctgaggcactaagccatcactgcggtctcaggggactcagactcctctacttgtcttcttgaattctggaatcagacacacctgggtccagcctttgcccccggggctgtgtgcctgggatggttgcctcacctccctgaagctcagtgagatggggacggctgcacagggcccggcacagatggcacccgatggcacagggtcacctgcttgcatccatacagcctcggccctcgctctggctgcgtaccgagagtcccatgcccagacctctgctgagtctccaagctcctggtcatgcctcaggcctcccgtgagaagcatcactgcatggaccatgcctcgggacctcaccttgggctgggaagcttgctccatctccccaagtctcccctagaggcgccccatgtcccatcactctcactgcttgaggggtcagataggggaacccagtgtgggaggcccagaggtgccggagcagacgttaagcgagttccgtgtttatgcgctgggccttggcagacaccctgaatgagcctcttccccaggaaggagattggggtcccagtccaagttgtggcctcaaaccctgtgaccaagagtggagaaaaggcaagacccctcctcccagtcttccagaacagccgatagtggtggaaacatggggttcacactgaatttccttgtaacttgttgaagagaatttagcccacattttcaggggtggaggtctggccgatttggcagtgtgcccgtccccctggccacagtttactctggaccgggcaccctggtgccctccctcagtgacgcagtgaagtcactatgacgtgtttagttggtgagaaagtgcctcctgtaatgttttactcttcttagagggtgaataagccttgtttattataaataattatttacagaatacatgaggtttaacctaactctgggccacggcagcgtcccctgggtaaacccacgcgccaccctagctagagcctgtgcccccacaggcttcctggactcaccctgaaggggggctggattttctgcctgtcccgatgagagggctgcaggacagtccccagcgagcccttctgagggctgtaacctcttcccctggtattttcctgctcgccaggaatgtttcaagcttccagcagaagcctacccaccatagtcgctttccaccctgctcaccatccctcctgccctcactcattcagcagaccccgtgcacagcccagtgcaggactcagggtgggaaggtgtcccgggtgggctggagcaaggttcccagccagggcggggtcccaaggtgggtccacagccaggactgtgatttgggaggcccctccctgccttgttccagccccggcaccgccgctgtccttgtgctcagtggagactcactggctccaggctctaaaacctcagcgaggtctgcagacagggaggagccccactcgagggtagagtgactgccgggtccatttgcctgttacgaaccacgtggcctcagacctgccattcctcctctcctagagctatggtcttttgtctgaaaaatggataatgatggttaccatgtcagggaccattttgaggacaaacggggatgaaactgaagaggctcagcacggaacctggacacagaagtgctaattgtgtgttaccagctgcggtggctgccaaggcccaaccacatggcagccacgggctgagtggcgggcgggaagtggggagcaggagcatgcaagatgggcattcctgaagtttctgatccagtgagataagtacacacccagctctaagatggagtgtcccaggaaggtggagactgcaaaggccttgtggcgcaggagtgtgagctgcacctctgggctctctagaatttcaccagagctcagggaggaggtcagctcagatataggggcaacgggagagatgggagtgagaaaatggcttggcgtctggaagtggagcctggaaaggtgggcgtggggacagaggagggccttgggggccatgggcccatgcgtccaggaggtggaggcagtgaacggggccacggtcggccccacacgtggcaccaccagccctgctgagcctgcacctgctcctcaggccccctgagtgccactaccacctggcaccccttggtctgattcctgcttcctgcccgcctgggaagagtgagaccacttgcctaaagtcccttagctgtccttaaccattctggctgcctcctggccctgtccagggttagccgttgacctgaactgcctggtgccacctccccagactcctggggccttgccctggcaccaacagccacctccatcttcatcattcactcgcacattcacccagcagtgctttttgggcatccactcagcaatatcaaggcgctgagatgcggctgtggttaagacccgggcccggtctgtgaggacctcgcagttgccatttccccagagcacagccccagccaggcacactgtggggtccagaaagagaaactaatacattgtgttcgtccattttgagttgctataaggaatagccgaggctggggggttatttgactcacggttctgcaggctgtacaagtggtgccagcatctgcttggcttctggggaggccccaggaagcttttcctcatggtagaaggtgaagggggagctggcacgtcacatggcgagagagagaactcccagactctttttttttttgaaatggagtctcgctgtgtcagccaggctggagtgcagtggcacaatcctcggctcactgcaacctcagcctcctgagtagctgggattacaggcgcatgccaccgcgcccggctaatttttttgtatttttactagagatggggtttcaccatgttggtcgggctggtcccaaactcctaaccttgtgatccacccaccttggcctcccaaagtgctgggattacaggtgtgagccacctcacccagccctcccagactctatagcaatcagatctcccggactttgtgaccgtggggagggcaccaaaccatccatgagggatccacccccatgacccaagccccaccccccccaggccttacctccaacatcagggatcacatttcagcatgagatttggaggggacaacgtccaaaccatatcacacgtgacctctctgtgcgtgcgtcagtttctacatctggttaagcagtagaagctccttctctgttccttgttgagagagcggtgggggagaaatgactcagggatgggaggctggtcccccgaggggccctggtgtttgtggagtgggagtgcgggaaggcccctacgttgtgtgtgccgtgctgggctggctcctcacagctcaccgtggtgctccccgaggactgctggggaggaaagagctaattaacttggggacccagctgctgaagttatcattaaacttgagcagtccaggggcccctctccttctgggtcctatgtcacccagcacagtggggcttaattgaattttttctcatcccccaaggctcctggctggcgtggctggggtttgggatacggggagcgagagggcttgggcctcttccagatttggagtgggttcaccagaaatggcccaggaaaccgcgggggccacccccagcagctgggggctcctgtggtcatttcctcttggtcctgttgagcagccctggcccctggagccctcagcaagggatgtgggggcctgccaggccagggtcctcactgctgccgctatgcacagctgcatcttgcatccggggagtggggtgccgagtggggtgtttgggaggcaggttttcccttgtcccttctgcccagagaccttggggatgagttgagtgagacccttccggcttctgactggctgtgtttctgttgccatcccccactccttttaagtggaggtttatgacttccttctttatttaaaagggtcatttagtgacttagcagatcccagtctgtgttacccagggcccttttaaaaatctgtggggaggctgggcttggtggctcacacctctaatcccagcactttgggaggctgaggcgggtggatcacctgaagtcaggagttcgagaccagcctggccaacatggagaaaccctacctctagtaaaaatacaaaaaattggctgggtgtggtggcacgtgcctgtaatcccagttactcgggaggctgaggcaggagaatcactcaaatccaggaggcggaggttgcagtgagccgagatcacaccactgcactccagcctggacgacagagtgagactctgtctcaaaaaaataaaaataaataaataaaaataaaaatccatggggggacctctgtgtccattggctggtgtgaggagagggtgaggagctgcagagaaggtaccaggctgaggaccgcccccacccttgggctacagaattgaaggaggggacacatgaaagatgttcctagactcgggctggaggctggggacatccgagggcaaggacgacgctgtccctgctcttgtttgcagaggagtgcacagggctcaccagcttcttgttgctgtttaagtgatagctttatggagatagaattcacatactgtgacgttgacctttttaaaatctacagttcaatggttttgctgtattcacaaagtgattgtattagggtcatccagagaaacagaaccaatagaaggtgtgtacgtgtgtttagataaagagatttattattatgaggagttggctcacctcattacagaggttggcaagtgccaagattggcagagtaaatcagcaggctggagacacgggagagcccatgttgcggctctggtgtccacctgaaggcccaagacccaggagagccaatggcgtcgttccagtcccgagacccaggaaaagcgcatgtgtcagtttgagtctgaagcaggaaaaatctgatgttccaggttgaaggcggttaagcgggaagaattctctctcactcaggccttgtgtcctcctattcagaccttcaggcctttgtcacaaaattacaaagacctgatcagaacaaaatctgagaaaaaaccctttccttctatcggttttggattcattggctgggaccctggaaattagactgacagagattaacaggaaacaagcataacaattcaagtaagttttacttgacaccgagccttcataaggaaatgaagacccagagaaaccgttagcctgagcggtttttgttttgttttgagacaaagtctcactctgtcgcacgtccaggctggagagcagtggcccgatcacggctcactgcagccttgacttcctgggctcaagctggggcccagctgccggccccgggagctgctctgaacccactcttaagtcccagctcagactcccaagtagctgggactacaggcatgtgccaccccgcctggctaattttttattttttgtagagacagggtcccactatgttgcccgggctggtctcaaactcctgggctcgagcaatcctcctgccttggcctcccaaagtgctggggttacaggtgtgagccactgtgcccggcctaggcctgaacagtttttatttgttttgcttgttttttaaatttgtttgttgcttgttttgagcagtttttttgtttatttcttttgcttgtcttttgcccaggctggagtgcagtggcatgatctctgctcactgcaacctctgtctcctgggttcaagccattctcatgcctcagcctcccaagtagctgcgactacaggcgtgtgccaccacacccggctgatttttgtatttttagtagggatggggttttaccatgttggccaggctgttcttcaactcctgacctcaagtgatctggccaccttggccttccaaagtgctgggattgtaggtgtgagctgctgtgcctagcctaggcctgagcgtttttatgctgggtttgatgaagagtggaaagtcgtgggaaactgtgacagagcaacaaaagatgagctgaacagtgagcccgtgggggtctcggcaagacctgtgtactggggcccctctcagatcctctgtctctggagatgaggctgttcctttccgctgggtgtagggagggcacctcttacgtgaggggcttatgatctacttcagagaaggggcaggtcagtgagttcttcttggacctgccatttcttaaattccttcagctgaaaatatttactatgccaaggcactgtatcttggagtgtgcgttccaagccctgttgccttcaactgatcgggtgaggcccacccccatcagagcacacagtctgctttacccaggctcctgattgcacccttttcctgtttgccccgagaatactcaccagcagtgcttgtggctgcagcgttcaccccaagataaatttgccgggaagtatcttgcttttattattattttcacatcactctagtatatcgactttggaaacaaaagacatcattctgtttatagcattccatttttagtagtggtatttcctttaaaaaaaaatggtaattctcagctgggtgtggtggctcatgcctgtaatcctagcacttgggaaagctgaggcaggctgatcacctgaggccaggagttggagaccagcctggccaacatggtgaaatcccatctctactaaaaatacaaaaattagccaggcgtggtggtaggcacctgtaatcccagctacttgggaggccgaggccggagaattgcttgaacccgggaggcagaggttgcagtgagccgagatcgcgccattgcattccagcctggacgacagagcaagattccatctcaaaaaataaataaataaataaaatttaaaaaaaaatagtaattctcgatcgctgaaaatgtcaaatcctagagaacacagcattcctacaagtgatgttaacattgttcttgatcagttgttggctgaagattcatttgatgaatctgatttttccagaatagacgactcagatgactctgttgttttgcttagaaataactgcaggaacaatttaaaaaattttttttctttttaatttttttgttttttgagacggactctctctgttgcccaggctggagtgcagtggcacgatctcggcttactgcaacctctgcctcctgggttcaagtgattctccagtcttagcctcctgagtttagctgggattacaaggtgcctgccaccacacgtggctaattttttgtatttttagtagagacggtgtttcaccaggttgaccaggctagtctcgaacccctgacctcaaataattggcccatgtcggcttcccaaagcgctgggattacaggcgtgagccaccacgcctggccagtttttatatttaattttcacacagagcatccagtcagatttgcttcagcctcaaagagcgtgtttatgtaaaattaagtgagtgctggcagtgagctgaactttctaaaaggtaaaagggttaaatattaaactcatccaaaaacaccttcacagacacactcagaataatgtttgaccggttacctaggtgccccatagcccagtccagttgacacagaaatttttttttttttttttgagacggagtctcgctctgtcgcccaggctggagtgcagtggcgcgatcttggctcactgcaagcttcgcctcccaggttcacgccattctcctgcctcagcctcccgagtagctgggactacaggtgcccaccaccacacccggctaatttttttttttgtatttttagtagagatggggtttcaccgtggtctcaatctcctgacctcgtgatccacccgcctcagcctcccaaagtgctgggattacaggcatgagccactgcgcccggctgacacaggaaattaaccatcacagttacacagccatcgccattaatcccagcacatttcatcatccccaaaagagaccctgcccccattagccaatccccattcccaactccgggctctcagcccctagccaccgctcatctgccttcgtctctatgaattcacctgttctagatagtttgtataagtggaatcgtacagtatgtggccttggtgtctggctcctttcacttggtagaatattttcaaggctcatccacattgtagcaggtgctggtgcttcattctttttcatggccgaataatattccatcgtggatagaccacactgtgtatctcttcatctgctgatggacatttgggttgtttctgctttttggcataattctgttgtgaagaattctgcagtgagtgctggtctacaggtttttgtgtgaacatgttttcatttctcttgggtaattgcaagatcatgtggtttagccaaccagcctttaagccatgtgtctgctgagggacccaggcctggtgggggtgcattgctgtgcttggccagccaggtgctgcgagtccgtgtcgcagccatttctctgtgctgtgctctgaggttgtctcgccggcaccgggcactgtgagccccaggaggccaaagccccctttgttttatcttgagtccaggcctcgctccatgaactaggatgaatggacattgaatcaacgcagggatgggtggggctggggtggggacgcagagtgaccccgggggcctgcagctgggtcctggctgctgacttccagtttcctttgcctgttggagcccagaacaagtcagaaaggggaaatgcaaagttcgagtgtcttttctgtggtagactggcaggcctgggtgggtgagccacttgcagctagttgcagcgtgagagaggaagtgggaggggagggagagggtgagtttggtgtaactcacccctggaaggaggctgggctgaggctgggggaagtgacttttatttttctgagaggattcttccctggggccaacttcaaaccaagggagacaagaccttcctgggggaggctggaagtgctggggcccccaggtgggcaggtctcccagggccaacgtcttggggaagctataagttaccatgtttctggactgtcacacacacacacacacacacacacacacacacacacacacacacacacacacgagtaaactgtaacacaaatgtgtgcccatgaaagtgcccactttaaaccaccacacagcctgtaaagcgaaggccctggcccgcatctgggcacccactgcccagccagccggtaggcagtttgcactgtagtctgttaccatccctcagagatgcagccgaggagcccagctggcttggagggcccagtgggcgcagcctcaggaaagtggtcaggcccgggccaggccccttccccctcccagccttgggagaaattaccatatgaatgtagctccttcccggagttcgggctggaagggcctgggaggggacaggctcccaccccaggagcttccaggttccggctgctgcctgtgttagctgcgtgagcgtgagcgagccaggggtcactactgggtggaaggaagaagcgggcatttcttccaggaggtcaccgttggagtcccacagtaggtcaaccccaggccctgggtcctcgggaggaggagaaagaagagaagcaggaggtgtggagggtaggccaggaccagaaggcacacagggtcggggcagtgtgggagaccctgggggctccctcatttaaccagctaacatcacagcgttcataagaacacgctattactgcagttttattactttgctctgatttcagaaggcacaactgatgactttagggaacggagaatctgaggaaggcctcgcaggagagggtcagatgcgatcgagtaaatgtgagccgtctgtaaactgtagagtgcacgcacagcaccggtcagccctggggtcagtgttcccctggtgctcagctcggcctctgcaccttttagtgctcggctgggctctgtgggggtcagggctgggtctggtacattagaggacttctaccaagcccctggcagtgtctcagttactaaatccagtttgccagttactaaatccgctctgccggttcccgaatcactcttccgctggggccggccatgtcacgtcaggcttttcatgcaggacggcagatggatagacgctgggaccaagtcatccttgggccgcgagacgtctgaccttctgctggtgtctcagaagatgctagctctccgtggcatgtcttccacgcggtgcttggggaccagtggcctctaaggggcccccctgcctcagcgtggggagtggcctggccaaggtctcagtgtctggttggagccaggcataggctcaggtgtactggctggaggcctcctgcccatgggctctgcctgtcctgtgtccctggtccttactgtgtcttctgtgttcctgggagagaccccaggggccctgagcccagcactggggttggggagtgggcggggaagagggtggggattagggtccctggctgcagaacagccaggccccaagtccccactccactcccctcccaccgggcgcctcatcccacactgaccatttcctgaagaaaatttcctgaaccggcctcccaccccggctgtcccaggaagcccatccatccttccgccttaatgctttgtggctccagaaggatggtggaagccggaaatcatgagtctcattcacaggcggccacacaccgaagccgcggagacgccgtgggaaaggactctggccagcgcggccggcacagagggagcggtgttaccggggtagacgggaaccgtggctgcccccatgctggtctgggagagacgaggggccggacgaaaggacagcagactggccattcattcatttattcattcactcattcacagcgtcttactgggtgcttcggacgtgtaaggttttgtgggtagtgaatgcgacagaccccagacagcaatcggagggccacgtgtgtaagaactgagggacctaggctgggcgtggtgtctcaagcctgtaatctcagcactttgggaggcagaggcgggcggattacgaggtcaggagatcgagaccatcctggctaacacggtgaaaccccgtttctactaaaaatataaaaaattagccgggcgtggtggcgggcgcctgtaatcccagctactcaggaggctgaggcaggagaatggcgtgaacccgggaggcagagcttgcagtgagcccagatagtgccactgcactccagcctgggcgacagagtgagactccatctcaaaaaaaacaaaacaaaacaaaacaaaacaaaaactgaggaacccagtgtagatgagctatcccgggaaaacaagtgggagttctaggaacagcatggggaagggatggtcccggcagggaggacctctgtgggtagccttgttggaagagctgaaaggcagccagagaggctgtgcgtggatggaagctgaagagtaggttaggggcgtgtgttttgttaacaaagacttcaagcatttactgaccaggcacaacactatgtgcttcataaataaatatctcatttgatccccagcattcttatgagacagatgttattatcccatttcacatgtaagaacattgaggcacagagtggttaagttacttgctcagggtcacacagcacgtcggtggtaggcaggattctggagccacaggaatctggtatatcccaggtgcaatggaaaccagtcacggcttcatagagggaaatcatcagattagtaaattttacacacgccccctggtgctttgaggaggagggattcggacaggggcagctaatggtggtggctgtgagatgtgttgggttaacattgatgagagtttgggatggatgagtggattcggagtaatggaaatggagggcccaggcccggcccctggagatctagctgcaatagctgttggctggagaggctgttcacttagatgggggatggggtgggaggcaggtgagatgagagctccagagttcagcctggggcacggtcattgggttcaagatgccttcagatgttggggcttgacagtgacagtggctgcagatacccaggacccagcagagggcctggcacagcggggcccagggacacgtctgtgagtcaggctggcactcaagtgtgaatctggacaaagaaggtggcattgttggcattgaatgctcaggggctgggtgaagtcagctagggagaggggctctcaaggcaccaggactgactccgtgggtgagggcggaggaggagacggcagaggctgagagaatagccagagacaggaggaaggtcagcagagccatgcacagaagcctggagaagatttgaggaaaggaagggctgggtggtcgtcattccctgcagctaggaggcaagggtgacccctgtgtgtttcattcttcagaggattggtggctccatctggtcagaaccccaagtccagagatgcatctgagcttcatgccatggtgcaggcagcaggagccatggagcaggcctgcggggtcacggcctgcctgctgcttcctggtgtctctaccctgagctcaggggttgcttggatgccctgtgctgcatccccccaggcggtgttccagagaggatgaaagtggctatctcaaggtgtgaccaggtagcggtccatgcacactgctttttcctggggagagtctgggatggaagggtatgtgtgtgtttctgagactccttgaataggctccatgtacctatccacccatcttaccacccacccacccatccactcactcacccatccacgcacccacccatccacccatccactcatccacctgtcaacccatctatccactcattcacccatccactcatccacctatctacagtcattcactcatccacccatccactcatttacccatctatccatccactcatccacctgcccatccactcacccacccatccactcatccacccatccacccatctatctatgcactcatccacccatccactcatccacctatccactcattcactcattcactcatccacccatccactcattcacccatctatccatccactcatccacccatccactcattcactcatctgtccatccactcatctacccatccactcattcacccatttatccatccactcaaccatccactcatccacccatccactcatcatccgtccactcacccatctatccacccatgtatccatccactcatccacccatccactcatctgtccatccacttatccacccatctactcacccacccatccactcacccatccatctacccatcctctcatctatccatccactcatctacccatccacttatccatccatccactcatccgtccatccactcatccacgcatccactcacccatccatctacccatccactcatccacccatccacttgtctactcatccactcacccacccatccactcatccacccattcactcatctactcatccactcatccatctatccactcatccaccaattcactcatccacctatctactcatccacccatccatccagtcattcatccatttgctcattcatccgccaacccatccattcacctgcctgttcatccacctacccatccattcatccatctgtccatccatccacccacccactcacccattcacacacccatacacccatccatttatccaaccatccatccccatccttacttcagaaagcatttgaagttgctggggtgtgcacttggaaaatgcgtcataagctttcataggcctctctttggcttcctcacttctttgattggtctttctttcggacatgcaggattctgagcagctcttctgggaggtgggtgcagtccaggtaggctgcctgcaaagctaggaccgagggagccacatccaaggcactgtgggttcccaaggcgatggcactgtgggcccactgcttccagacctcctcaactcccaggctcctgagcaggaggactcctggggcagggcctggagacgggaagagaaaacaattccagtctctcaactcttgtcagtccaggtgggtgctgcatggattgggggcacctggaacagttggccccttcacccctttcccccacctttccagcccctctggctataatcagacagttgtgtgcgatgtctttctccctcctgaaggggtcatttagtcaggctcctactcatggcccaggaatgtgcccctccctgcctgtcccctacccccaagcaggccgtgcctccagccccctgctgtctctgaagggcctgggcatggggcagcctctgcagcatccccagggcccgagctgatctgcacagcagaagggaattgggggaaagctttttttctacccagcacctggcagggggccaccctgttgcaccccagagacccttgtctaagttttgttatttcagatgatttcataagttgggggaggcggagccccagcccccacagcccctgttgttgcctcactgctgagctctgctgtgtatctgctgacaggtctgctgatagcagaaggggctggagagagggaagctctgggccctgccctccccaacccctgcttaggggacatccctgataagaggaaattccagcctgtgacagatggccagtgtccacccacccacgggggaacttttctttctctttgtaagtttgcagatttgccaggaactaaaggaatctctggttgacaggccactgtggacatggctggagggctggcacgggctggatcttggggttgctttgaggtaggggccgctcctgctggaaggttccttggggtggggaaggcatcagggccattccctgaccctccctctgcagtggatccacttcagagcctgagacaaggcaagggggcagcagaaaacagaatataaaatagccccccccaccacacaccgcaccagaagtcagaggattcatccttggcctgccctccctgcagcctaagttctgagagtggctctttaggaagtgaatggtgatggtttgcaggtcagagcttgctctggcccaagattgatgtctcaataggccgcggagcctgggtgaaaaaactcaggctagggaggtggtgggttgcaaatgaaagaacagaggagggcctcttccagaaagcggcgggtggtgtgaggagcccttggaccttgtccaaatttgactttaccgactggggccaattgaaaccgtgctggcagaaaggcaaaactgcttgagattccttcctccacaatagaggagaggtttgcttgaaagggtttggcgagggaaaagctggaggaaccttggccggcagtaaaagtggggacccccgccccctgcctcgggggcgcctcggcccctgaatgaatgaaagaggaggctggatggagacagactcacaccacctgtcccttccaggtcctgcaaaggagcacacagggttcttgttggctcttccaccttgttagtcaccaagaaggagaaaacaccaacaggggaactgtaaagctgcagttttgtttaagccccatagtggaaaccggaaagagctccagctcggagaaaaatgcagctctttgcctttgcaaatccgtgtctttctctgggaggccagagccattgtgctcgatttctaagcagggtttcagagtgtctcaggaggggaaggcagagtctcagatttccggcatcccaggtcctaaccaggctttgaggagacgcttcctgtcccatacaaagtgtgaagtgtaatttgatttggagttagttaacaaattagatgagctgtgtgcattttaaaaattcagtccttgatcccccacccacacacatttgcacaatttggtcatttatattcagtgtttccatctttagaagagaacaggaagtccccagtgacatttatggagtgtttgtagtagcttgggtaggtcagtaggaacacaatgcagtgaaaagcagagttgagatgggaaaatatcctgttttcagagccccccagggatgacattccttatcgtctctgtccacccgctctggagtccactccgcaaacagcaacttgttctcacttgagagcttcctcctgccggagctcagggatggagagcagctggcctcagtcttctcctcttacctctttgtttctcagactcatcttccaccttgaataattgtttttaacctgctctccctcttctctagctgtagaacccagaactttgtgtgtgtggtcaaaagtttagagagtgctgcaggtaatgctgagataaccctattaaattctgtaagttctcatcacaccaagtttgtttgttttttttaattctcattttattttatttcattttatagggatggggtctcgctacgttgcccaggctggtcttgaactcctgggctcaaacgatcctcccgcctcggcctcccagagtgccaagttatttttttaactgggatccacgggcctagggattctttgatgaaccgttcaaaatacgtgtgtgtctgtctgtctgtcttcaatgtatacttttctagggagagtctttacttttcaccagaggtttgtggcacacacatgtcctgtactactgtatcagattgtgaattccttacatgttaaagactgcttcaaatctgtccggaagtctcggctaataaacatttaaataaatgaacttcaaattcccatgtgccaccactgttttcattctgactactctcaagcctgtagtgtcatctttttgttactgtgaagtagacactcaataaatacttgtcaaatgaatcaatgttatggtcctggtccactaggaccccaggatcatcgtctaccattattgtctatagtttctttaccatcttgttccagagcagttctttctctgaggtctgctcacctctgcacgtgtgtctagtttccagccctgtcgccttaccattctctttcctttacctgcatttcctgaactgttaatagttaacaatagcttctccctccacccactcactcatacctgaagtgagaagtcatcattgaggtctctgtggattttgtcagcccaacctggggcggcctcctggaggtggagttttcagatgagggatggacattttggtgtctgctgggtagatctacctgggagctttggcaggggccccagggcagctctgcctctttattttggctgtgggacccctggtgcactagggtttctcaagtaagcatctgtgtcctgggagagccataggcaggcctgagagggcccctggaatctgggacccccagcccggcccagtagctggtaccatcatctttcttgcaagggaagttatggaaactaagatgctaatgtgctttgataggcctggggtggctctaagccctgggaagagccctggcaactttccctggctggcgggtagaatcttctcctggcagttcagggctctgcctccagctccctgggggagagcaactgagggaggagctggaggccaaggcctcagtgctgagctgcctgcaccgcagctgcaccttctgggtcctggctgcaggaaccccatacttctccagcctttccatggttcccgaagacctggcctggggagggggtcagcagcctggggctcacctacctggcttcaaatcctggctctaccgcttactcgctttgcgaccctcataattgacaaaagccctctcggtctcggtttccttatctgtgaaatgggacaataacagtggctaccttataggattgtgtgatgatccatcagttataatagctcctgagcagcgtttagagtaacacctggggctcggtgcagtggcttatgtctataatcccagcactttgggaggccaaggtgggaggatcgcttgaggccaggagtttgaaaccagcctgaccaacattagtgagacccactctctaaaaaaaaaaattagagtaacgcctggcacagagagcccccagtaaacctcggctgctgtgatgagctttgtttcttcatttgttcattcattcaccagactttttgccggggcttgccgtgagccctacgctgctctgaagaaagccgggctggggtgagcgtgatggatgaggtgtctggcttcacaaaccctgtgtgggggggttgtggtgagaggaaaccgcacacatcattattcagttaccatcgtggggagactgtctggacgcagagagcaggctctgtgtgggagcggggagggcaagccctggttgcgaggcagggcttccccaggattcagcagggatctgaaggactttgcaggcacccagggagataggagaggaggagggagcagccctggccggacactgtcctcctagcattgcctgcatcagggactcactcagctttaagaagcccctttgtgggggacagggagcatctgttagtttataggacctgaagtgcccccatgggctcaagtttctgggaaggcctgcaggtggccgtagggctgccgcaggggtgctggccccagggtctggattcaggggagcctgcagagggagggcagctggaggctgctccagtgtgcattgttacgaggcaaagtaaggagactgctgggcccacgctgggccggggtggatggaggcaaggaagtcttcgccggggcaagggcaccagctgtagatgccggcagctttctcctggacacgggcctggaaggctgacagggtgtggtgagtgccaccggctcccctgccgtggcctggtcagtggcttcacaggcctccgtgggcaggaggaggatgaccttgcattctgcttggccaccattggcagtgacagacaaggtgtgtggggatgtggccatttcggtccgtgctctgagagccaggtgtgggttgggtttggggaagacaggggaatggcattgacttgaccctgagcactttgtcctggggtgcaggcccggctgtcactcccctggagctgggaatggcattgggcggtggctcagggtcccttgccccagcggcaccatctctgcatttggccagcaaggctgatgggacttgtgtggacatttctgggacgtagaccaggcagcatgacacacagggaggggtaggcagagaagggcggcccctgggtcttggtttccaagtcaggctttgcaagcctgctgtgtcaagccctctctcggcaccaggccaggtgggccagggtcagccctggggctgtgatgagtgtgagtgcccctaaagtgtgtcatgtccaatagctgcctcctctctgggcactgcctcccagccagatatcctacagcccccgtcccagccacagacagcaatctgattccctcatcctcggcaggtcctggggttggggtaagaatttgtcactaagtgcagatgttcccagagggtgctggctcagggctgcgtggattacagccctttcatccctgccttagacccacctgcaactctggagaaaagatggcccagtggacgcctgcggggaggagggagctggtccccaggatgagcagatttgggggcagtccccatcacgggaccggtgacctactgccaccagcgccagtgaatggcagaggggccctggcataaggcctgggttcagaatgggaacctgcagagaaactgtcaaggtctcccgccacctgacacctccgcctggctgccaccctagaaacacccttgctgcaagaagatgggggagtttgtctggggcatggtctggcgacaccaacttgagaacctcaggcctaagtgttggcctctgggcctcagctgtcctctgagctgtaaagctggctcctgggcacttgtggaaaacactggactctttattttattttactttacattctgggatacatgtgcagaacgtgcaggtttgttacataggaatacaagtgccatagtggtttgctgcacccattggactcttcaatccagctccactagaaatgactgccttctttcccttcttccgtccctccctcctcccctcccttttttccttccttccctgtttccttccccctccctccttcccttctttcccttcctctcccgtcctcatggggatataatttccatattacaccatccgccgattcagaaagcacagttgagtggcattttttcacaaccttctataagcatcacctctaattccagaacgttttcctcaccccaaaaggaaacgccatcctcggtacacagtcactccccctcccccagcccctggaaatcaccaatctgcgctttgtccctacagatgtacttattctgaacatatgactagaaccctaaaagatgtgactttttgtgcttggtttcttgcagttggaatgttttcagagttcatctgtgttggcgcacgctcgtgcctttttatggctgagaaatagtccgctgtgttgactcagcacgttgggtttctccacgcatctgttggcggatgtgttagttatttctggagccgggtgtgttgtgctactcacgggctgcactaggagctggggatatcactgagtaagccacagcctcgggcacccaggagctcgcagagcaggagctgggagggaggtcaggaggtgcatggcctgtttgccaggctggagagacttgcaaaaagtcactttgagccagaaaccagagcctgaggcctctgactcccagctgcggagccgggagggaagctctgcattttgctttgactgtggggtgacgtgtcagttactgtccaaatcagaacctttctgagagtcgacgtgggtactgctgataattagtctggatacccgaaagaatggaaagcagggacccagacagatccttgcacaaccgtgttcgtagcagggcgaggcctggaggtgcgatggggatctcaacggggcagctgccgtcttgctggagcccacggtctttggggggggtcacaggtgttaaccgcatatcatacaagcaggagtgtgaaatttcagggttgccaaattcagtgagggtcttgtgctggcctggccacttacagtggcatttcaggaaaaaaaatcactctatggacctcagtttccccattagtaaagagtaggttggactggaattctgtaccatccagtatagttgccatttatgaaatgtggctatttaaatttaaataaaaatagaaattccgttcctcagttggactagctcagtgtcaagtgctcagaagtcacttgtgaacacactgtggcaattcctcaaaaaacgaaaactagaaccaccgtagcatcccataattccacttctgggtgtggattcaaaagaatgcacagcatcttaaagagctagagatatttgtacacccacattcatagcggctctgttcacagtagccagcgggtagaaacaacccgaatgcccgcggtcaaatgaatggagaaatcaaaggcgggacaggccgggcgtggtggctcacgcctgtaatctcagcactttgggaggccgaggcgggtggatcatctgaggtcacaagttcaagaccagcctgaccagcatggagaaaccccgtctctactaaaacaaaattagccgggcatggtggcgggtgcctgtaatcccagctacttgagaggctgaggcaggagaattgcttgaacctggggaggcagaggtttcggtgagccgagatcgcgccattgcactccagcctgggcaacaagagcaaaactctgtctaaaaaaaaaaaaaaaaagggtggaacatacaaggaatttgactcagccgtaaagaggaagttaggatacctgcaacagcaagggtgaacctttcgggtattacgctaagtgaaataatttggtcacaaaaggacaatcctgtaggattccacttataccaggtccgtagagtagtcagattcagaaaaacagcagaatggaggttgccagaggcttgggggatggggctggggagttgtttaatgaggacagtttgttttacaagatgaaaaagttctggagatttgttacacaacaatgcgaatgtacttaacaccactggactgcacacttcaaaatagtgaccgtggcaaacgttatgacaattaaaaggaaaagtcacgtggccagtggctaccacgctgagcagcgcaggcctcggacggtgtcgtggtcacagacaatggagtgggtgatctttaccattgtttccagctgtctgagcaccatggtgtcctggggccaggatgaaagtgtctctgggtatgggggtctctgcttttcccacttgggagtcctgaaggcagaccccaaagctcacctggccaggtaggagagcgaggcgggctcttgcattgctctctgcgtgcgtgcctgcctgcgggccagccggggcctgcaaggccgcctctcgagggaggggttgcaggaatggctctcacctgtgcagaaggcaagccactgccctacgtcaatggcaaagatggggctcggctgcgttgtattattatttctcaagcggggcccctggtgggcaggatgtttggtttgatttgagtttctgcagtgagtgctggtgcctgtggagggacccagctgcagctgagccggcccctccctcgctctgggctccaggggcgttgggggcgagaaaggagagttcagggggcagcgcctccccccaggtcctgctggggagggttgagggatgctggggggaggtgggggcgggtaggggctggtcccagtcccaggcaaaatggctctcagacccacaggcagatggaagcgattttcggtcacgtgggtggggactgaactgctgccccgcaaggcaaggccccatgtctggcttcaggaagcggccccaaagccacatggtccatggccagatgcagggctgtgtctttgtttatttaaaggtcctggaagcccaggggagagtatttctgaagggggagcaggagcaggagcaaagccctgaaggcttccaggctgcgtggcctgggtgggggccacgtgggggcacagagagaggagccctggcctccaggtccgcctgtgggtattgctctcagcagtggagatgtgtggacccccccttggcatttcccaacaaggaattatattgttcctttgttcccccaattccataagataggaattcctgtgccctgtggaggctgagaagacggggaggtgcctgtgaggataaaccagcccccagtttctggcttccagagtcttttcctctctcacctctgatgcctcaggcctggggagcctccctccgacaccctctgaccgctccagtgaaataggccgagagggatggcttgaatcggctggggatgcaggctgcagccagggggctcagtgggcatttcctgagttcggttcttgccccgcaagtggaagggcagttgaactgaagtctcccactgcccctcctggcctggaagcctgcctcccaccttctgggcagagtgaggagtgggcgtgggccgggagggctgcctcctgtctgggagggctgctcacttgcctgtcacgggggatgagccccctgcagcctcccgtgctgtggccctggctcccacgccggctccactcccctgtggctgcccctgctgggtgcccaccggtcccagggaaaagccactcccctcccggaggactggcgggaggggccctgcctgggagcgtgccgtgtggtccctgtcttagcgcaggatgcctgaggccagatcctccctgggaggcaggatggggcaaaagtctccccgcaggcagagcagggcctggatgggcccaagcagggacgggggcacagaacagcagccgcccagcctgcgtgggagctgagggccaccaagggcagctccagcctgtggggactagcagaggcaccacctctgtgaccagcgagttgtctgcacctgcatgcgcatgcaccagtgagtgtggcgagtctgaggtgtgctgggacctggcccgtgtaccagccagccctgatgggaaccagccccatcctgggtacccctggaaccccactgtgtgggagcacctgggtcctcagcaggcgtcttccgggcgtccgcccccagccccaggcctctgacccgtgtgtggtgtcttaacagcagccaggagcagggccatcgaagggacctacagacagaagaggctttagtgatttcgggaagttcagctccacgtgccccacatacccaagagtaaaacttggtcttggcctgtgggtgtgcagcccgtgggcgctggccaggcacacaagacggccgcctgggtcagtccagggggaggcagatgtggtgcaggggcccccctcctccatgagcccaggaacagctctgcatccaggcacccgccctgcacccagcacttttccttctcccaggactgctggctcgttctatgggattgaacacacaactccatggggaccgacgctggttctatccccctttcttacaagaccatccatggggatgtgggaggcggggacacacgctggttctatccccgtttcttacaagaccatccctcctgtgtcttggctcgtggatcggcttctaaggcctttgagtggcagcaggcggtacagcttatctgagtagaggtgaaggagagggccaggtccacctgggtggcccgaggcagtgtggagggccaggagaggagagcaccctccacccttgtctgagcagccctccagggtacggagacaggagttcagggtcagccctgccttggagcgcagggggcccccagcttggcacagctcctagaagaggagatgaaaaagcctggccttgggagtctggggatggagctttgctggggaggcagcgtggctgcaggatggcagctttttagaggacaccacggccagggacatccacccgggggaattctcaggggtcgcctgggcaagtcgcttagcctttctgagcctcagtgcctcagtttccccatccaaggatgggtgtgacaaccacctggcaggcgcctgtgtgtgagcccctgttccgctctaactcctctgctgttccttccccagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcggtgagtcctcaccttgcatgccactcaaccaatgccggaaaccagcctcagcccccagggcggcccacaagcctttgggcttggtcttcccttctgtaaaatggggcagcaaccctgacctcaaggacggattgccagtgacattgcgtgtgcatgcatgcgcctgggaggagcccacagcctccagcggctcctcagaggggcctgtcctgcacatccagggcccctgagatgactttggggagcccaggccggcctggagcaggtcctgatgagtggtcgctgcctctgagcaatgacgtcagcttgtgcagagggttctgtggcagctgtcccctcactgttgctccagcctggccctccaggctccccaccgcaccccaccgcaccccggccagaggcttcccagcagctcagcttcagctctgccctggaattggggcctcgtggcttccacaccccctggtggccccggagagctggaggtcaccacgggaggtcgtcgatcagcacgacctgggcagggtgagggggccaggctggagtctacagtgggccgcctgttgtttccaaagccccccaggtcccattcaaacctcacagggaccctgtgaagggggcgtcccgttttccaggcagaagcgaggctcagggaaggctgccaaggttccttagctcacagggcagagaaccgcagccaccgttttgactcccagaactgtgttctgcccactccacggggtccagggaggggtctggggaagtgcccccgccaggtcacaccctaaacaaaggtgagcttgcggggtttctgcaaggtgtctgggcacctctcaggccgggcctgtttctctgacctttgccagccgtgcacgtccttcctgcccagctctgtggacgcaaacccacacctgccagcccgacacctttctttcctcttctgcactgatctgggccctggctcccctggggtcttggtgtcctctctgcttcctgtagcctcatgggacccggctgctcatggccctgctgtgctcacagctgcctggaagctggcagcctgcttcaagggagggcggaggtgtggggtcccctcctacggcccccaccctgttctgcctgttgtgggggacgtgcttgtaccctgaggattcagggctgcctcccgggaagatggctggagagaaagagaggggagaggcccaaaggcagtggccaggctgggactcatctctgtgggctacggaggggctgccctgctccctagccagggacagggtgagaaggacctgggaacctctgcgtcccagccatggcacaggccttcttccggagctttggccccaaggagagggagaggcagcccagcagccctcgccttccgtggctgccactgtgacagccttgccctctgggaatggtgcgcaggaggccacttcacctgtctgggcctcttcgccctttcaaccctgagaagaacagtggtcctgattccccacaaaatcactccctcccagggatgccgagtgaggaacaagacgtggggcagctctgctctcctccctcctccctcccatggcagctgtgcccacctgcagaggtgcaggcaaggtggaggggcacctgtttggaggtccacagaccccggggagaatcccagctttgtcctaactcagcggggtgaggcttgtgtgtcttcccctgggctcctcctctgtgagccttagcttcctcgtccataaaatgggatcatcccataaagtgagatcaagcgagctaggccccgggcagggtccccaacaggttgtggttgttcgagaatttgcagcagtggtgatggtggttgtggtgatgaggatgatgggggtggtaatgacggtgatgatgatggggtgatggtgctagtggagatgatggggatgatggtgatggtggtggtgatagtggtgggatggtagtggtgatgtgggtgatggtgattgtgatggtggtggtggtggtgatggaggtgatggtgatagtgatcatgagggtgatggggatggtggtggtggtgatggtgacagtggtgggatggtagtgatgatgtgggtgatggtgatggtggtgatggtggtggtggtgattgtggtggtggtggtgatgatggtggtgatgatggtgattgtggtgatggtgatggtggtaattgtgatggtggtggtggtgatggtggtgatgatggtgattgtggtgatggtggttatgatggtggtaattgtgatggtggtggtgatggtggtgatggggatgatgatggtgattgtgatgggggtggtggtggtgattgtgatggtggtgatgtgggtggtggtggtgattgtgatggtggtgatgtgggtggtggtggtgattgtgatggtggtggtggtggttgtgatggtggtgatgtgggtggtggtggtgattgtgatggtggtgatgtgggtggtggtggtgattgtgatggtggtggcgatggtggttgtgatggtggtgatgtgggtggtggtgattgtgatggttgtgattgtgatggtggtggtggtgatggtgatgatggtggtgattgtgatggtggtgatgggagtgatgctggtgattgtggtggtgaagggggtgatggtggtgattgtgatggtggtgaagggggtgatggtggtgattgtgatggtggtgaagggggtgatggtggtgattgtggtggtggtaatggtgatggtggtaaaggggtgatggtggtgattgtggtgatgtgggtggtggtggtgatgtgggtggtggtggtgattgtgatgggggtgatgatggtaatgtgggtgatggtgattgtggtggtggtggtgatggtgatgattgtgatggtggtgaagggggtgatggtggtgattgtgatggtggtgattgtgatggtgatgtgggtgatggtggtgttgatgggggtgatgatgttagtagtggtggtgatagtgatggggatgatggtggtgttgatggtgatagtggtgggatggtagtggtgatgtggttgatgatggtgctggtgctgatgattgtgatgacagtggtggtggtgatgagggtgacggaagtggtgatgatggcgggagtgatgggatgatggtaatagcagtgatggtattgtgatgatggtgctgatggggatggtggtgatgataagggtgatgatgatggtgatgataataataaaagtaacaataataaagggatacaccttgcagtatcccagttggcatctcctagatctaaggtgtcgtggctggaacattgacataactcctgacctgaggttggccaggacacagacctggtggacagagagagatggacgaggagtgtccgtccttgggctactaaacagttcaggccagggattcccagcaccagcctctgtcctcccaggagcccacacttttcctagaaaggtgttatcaaagtcagaacatcagtgtaatttagggtgttttttgtgttgtgtttttttgagacagggtctcattgttgcccaggctggagtgcagtggcatggtcttgactcactgcagcctccacatcctgggttcaagtgattctcgtgcctcaggcatgtgccaccatacctggctaatttttgtgttttttggtagagacagggtttcaccatgttggccaagctggtctcgaactcctgacctcaagtaatccaccctcctcagcctcccaaagtgctgggattacaggcgtgagccatctcgcctggccgatttttgtttttttaaaagacagggtctctgtcactctggagtggcaatgatcctagctcactgcagcctcgcactcctgggcttgagcaattctcctacttcagcctcctgcgtagctgggactataggtgctcgccactacacctagccaatgtttacattttgatgtagagacagggtctctctgtgttgcccaggctggtcttgaactcctgggctcaagcaatcctcctgcctcagcctcccaaagtgctgggactacaggcatgagccaccacacctggcctagggtattttttttggtgtgttgctagcgtagcccaaggcagctctgtgcagggtaaagcaatggggctccgagtctggaggggtgtgtgtgtgtgtgtgtgtgtgtgtgtgtgtgtgcgcgcacgcgcgcgcgtgttatatgtgatttgtttgtgtgtgttgtgagagttgtgtgtgaggtatgtgtaagaggtatgtttgaggtgagttgtgtgtgtgttgtgagttgtgcatgtgaagtgtgtgtgttgtgaggtgtgtgtatgaggtgtatgtgagttgtgtgtgttgtgttgcatatgaatgctacttcctcatcctcgtttgtctcagtcacctgtggactggctgtctgcacacacggtcactgtccctcgagtggcaccaccctgcaggccagcgccccctagcacatggccccacagaccccatgggacatgcgtgagcctgcctgatgctcacaccagctccacgggggaaggactgtttatcccattttgcagatcaggaaactgagacacggtgaggtcaggtgacttgcccaggccctggccggtcagggaggagcagtttgaacacctgggctttggttgcaaccaccctggtgaactgcaggaatcccggccacctggtgcaccctgggcagccctgggctcctccgccagcccggcctctgtcctgtccaaaatctgagccaccaggagacctcctgtccagaaagcacaaggggcacaagagatgccgactctcccaggcccggctcacctctcaggagaggactgtggcctgggttgtgctggcatcagagcccggctgtgtgggtttacacagtcactggacacccggctcgagggtgaagtcctcgggggctgcttggcagggatattgccgggaggtagcccaggcactgctgaatctcagactggagagcctcgtgcctgggtgggaggggccccatgtgcagaccctgctggtctctccggagagacccctgaccggcctcccatcctctccccagggcagagcggcttgggtaaatccaccttaatcaacaccctcttcaaatccaaaatcagccggaagtcggtgcagcccacctcagaggagcgcatccccaagaccatcgagatcaagtccatcacgcacggtcagtggccgggagtgggctgggggtgcaggacgcccctgccttcctggagcacaggggttgggggtcaagaccatcacacacagtcagtggccaggggcgggctgggggtgcaggactcctctgccttcctggagcacagagtggggggtcaagaccatcacacacagtcagtggccgggagtgggctggggatgcaggacgcccctgccttcctggagcacaggggttgggggtcaagaccatcacacacggtcagtggctggggatgggctggggatgtgggatacccatgccttcctggagcactggtgcggtgtgagggtgcccgagtcaggcaatcccaggtccccaagacggggactcgctgtgcccaccatccccagcatgttgagcatgttggggctctggctgtgatgggtcagtgtcccggacccctgtgggccccgtcacactgagctccccacagacaactgagttttccaccaaaagtctgacaggcaaggggctcccaggggaaccgtcaccggcctgtgccggagttggctgaggaaggccattaatttcccggtgtctccttggttgtcatcgctgcctacctggggttgccccggggtcagtcaggtgtggggtgtctgtgagggtcttccgtctcccctctgactctgcgtccgtggctctgtgcagatattgaggagaaaggcgtccggatgaagctgacagtgattgacacaccagggttcggggaccacatcaacaacgagaactggtgaggcccctccagggggaggagcactagcgggggcttcagggctccctggaccccacccagagtcagccctagaggtttcccggcccgcgggggtgcagggcccacctcctgggacctgacatgctgccaaagccgcacgtctcaggggcctgaaaattctggaccaaagcagaattacctggggaatcttgctgtccccaactcatcacctgaggccagcccggggaggctggtttgggaggccgagggtaaggctgtggcatctccgctcagcaagccagacctcccagggcatgcatttcattggaaggtggggtgttgggctctgagtcctgggaatgcacgacctgcttggggagggcatctcatgtgcctgctgactcgtccccatcccccacgcagctggcagcccatcatgaagttcatcaatgaccagtacgagaaatacctgcaggaggaggtcaacatcaaccgcaagaagcgcatcccggacacccgcgtccactgctgcctctacttcatccccgccaccggccactcgtacgtccctgcagtgtcggcgtcctcatgccgggtgccctgggttccctctgtcccctgggactgcaagacggtgctgtctgccctgctgctgggtgcagaggggctgagtcaggggccatggccgccagctatgaagttgggggtgtgccatgtctgcacctccaaagcctcacactgacccctatgcaagtgtcctgcccagcccccatccttcagctgcgtcttggggagctgagggtcaggcaggccctgggctgttctggagcctggtggtctgtgtcctgccttctcaggccaggctctggcaggtggagtgggagcccccagccaagcacccgtagcggtgactgaccttctcatccgggccctgcctcatgggaccccttagagggtttggtgcgttcttagacgggaagcacagagatcagtgctggccccttccagggctggacggggctgctgttggtgttggtgagagccctttcctcccgccggctctgtccgcacctgacgtcgcccctagagatcagcaagggcgggaggctgcatgtaccctggcaggtggactcttcatggcctcacggaccctctgtcctcagctccctgtgcaccccctgccagacacctgtggctcaccctgagccagggctgggaggaggaggaccagaggccagcaggagtggctggtggaggcagccgtgggtggcttgtctgcatgggtgggtggagaaggtccttcgcacctgctgtcccagatgtacttccctgggcggaggaagcccaggggtttggggaaaccatactctgtgggcaccaggtgcaggaaggagcctggctggtgggcagcgggcctcacccagagtctgtgggaaaacccaagccggagttttcgagcccaccctctggcatcatcctctgtgggccagcaggagtcaggggcagggggccagcccgctgtccatgggcctctcctgaactgaacatctgccctcccaggcagaacggctcacctgcggtcctgtggcagctgttccagctgctccaagctttgcctcagctgaggctgatggcaggaggcagaagcctctcctgatgccagctgggcaagccgagggcgggcgggcggtctgtggcacttctgccactccccagcactgaccctttggctgggactccagctaggcatgttgcctggtcccgcccaaggcgtccagtcccatggggcaggggcgggccttggccatctctgcttaaacttctgcccggagcgggcttctccccagccatgtgtgtgaccgatttattctcactgtgggaaaagctcggctccagaactggggaagatggtgccccagttccagggccctgccagcccctgccacccacagctttccccacatcagaccccaggctcactggggccaagcaggcaaggggagcagcccgcctggtgcaggggagcagcccgcctggtgcaggggcaccgcacactggtgctagcttctatttctcttgcctctcccctcccagccaaagccccacagcaagacggctgctgagccaacgacagcccttctgtgtggacatgtaggggtgtggttgggaccccagaactcatggacgagggtgcttggagctggccctggcccgcctggcctgtgcagtggtgtcacctgtgtctgggacacacccgtgtccttcctctgccccacactcacagcgtggccgactcggcccggggccctgtccttgccagcagggacccccgtgagccccgagccagcacctgagagtgtcgacacctgcttgggggtgggtgcccccccactgccccgctcccccagatgagcctcacgcacatccctctgcttcagcctcaggcccctggacatcgagtttatgaaacgcctgagcaaggtggtcaacatcgtccctgtcatcgccaaggcggacacactcaccctggaggagagggtccacttcaaacagcgggtagggttccatctctacttgccccagcccttctgtgcaacctggagacgctgcaggcctggcaggggccaccccgtctaaaggagtcacactgtcagggagaccgaaccgctggtcactctccccagcgggtggctggcctggtggtccctggcccaggtggctgctgggggccgtccctgagatggcctctccagctcccccatatctcaaaagcagctttgtgggagtgccaattctccagcagagtctctgaggggggttttggagaagacctggaccaggcagatggtgaatctctcttccagggagtgaggccgagcaggggccgtgcgacatggcccaccttgttttatgccccccctttttttttttgagaaagggtctggctcagttgccaaggttgcaatgtagtggcacaatcatggctcactgcagcctccacctcccaggctcagtccccgagtagctggaattacagacgcacaccaccatgtctggctaatttttgtatttttagtagagacgaggttttgccatgttgcccaggctggtctctaacccttgggctcaagggatcctcctgcctcagcctcccaaagtgctggggttacaggcatgagccacctcacctcgccctgcctggtttttattagatggaagagaagctgggccaggtgtggtggctcacgcctgtaatcccagcactttgggaggccgaggcgggcagatcacttgaggtcaggagtttgaggccaacatgatgaaaccccatctctactaaaaatacaaaaatattagtcgggcatggtggcgggcgcctgtagtcccagctacttgggaggctgaggcaggagaatctcttgaacccgggaggcggaggcttcagtgagccgagattgagccactgcactccagcctgggtgacagagcgagactccatctcaaaaaaaaaaaaaaaaaaaaaagtttcaggagggatggtctctgccaccttcttctccgccaccgtctgaggcccctgctgtgggatagggaggggcatccaagcaagagggcagccctgggctcttcctcctgacagggcagcacatcagagccacatggggtgcctttcaaaatgaaaccgaggtgcctgggctgcggcaccacatctgcctcggtgggtgtgggtggggcctgtaacctactccgtcctggggccaggtgtcagggaccttcccagcatgtgcaggggaagacagtccacacaaagtgggtgtgtctgccggaggctacacacgggctgtggtctgtgcctgggcaggcgagcagccgctcactgggatgtttctgttgcacgtacccatgtcgggctgctggcagggagctgagaggttactgcaggcggggcccctgctggaactggggactgtgacgagggttttttaggaagggtttcaggaggggaggtctcggtaaccctgagtactttcttggggctgtgatgagcaggagaagagaggtgggaggtgctcaggacgatgaccttaagcccctggggagttgcagcgtcgctcaggacagcaggtgcacctgcagctgcccctcttccctccaggaggcacaggagttggaggtgattggtgtcacagccccccagagcctgcccttgaacccgagcctggggcagcacacagtgtggaggtcatgtggcaaacaccagtgggtgggtagagcttgccacagggatgggcccatctctctccctccttatcccagatcaccgcagacctgctgtccaacggcatcgacgtgtacccccagaaggaatttgatgaggactcggaggaccggctggtgaacgagaagttccgggtgagtggatccactaggatgttgttcccaggggacccccagttcctgctgaagggtgggttgggggtttggaggaccttaagccatgaaattatattcttggggccagagggcactgagcccaggtgtctgtacccagtgctgtcaggctgaggctctcgtttttgggggaccccaggctcagggcagctcctcccgggggcccaggggagggaattgccttcccgcacatgtgtaaccaataccgtctgcccgttccccaggagatgatcccatttgctgtggtgggcagtgaccacgagtaccaggtcaacggcaagaggatccttgggaggaagaccaagtggggtaccatcgaaggtactcgccgcaggcgccggggctccagacagatgggaagacagtctcttctgctgacccagagcctgtgggccacgcctgagccagggactcgtggaacctcatccactgccttgccccacccagagggaggggtctccttgtccccattcaacccttgggaaagtgagagggcaagtggcctgtgcagatgcctccaccccagacctccccccgggcagggaaagattcagggagacaggagctgggatgggggccgccaagttctggatcctggtgcaggctctttcataggcacctgtgtggccctggacaaatcgcccaacctctctgggcctagaaaaggggtgggctgtagctctgtgagccagatggaccctcggccccttaccctgctgaagttcctgggaccctcacaccttagtctcttgagtggctgttgtaaccaattagcacaaacgaggggacttaaaacaacacaaacgtattttcacagttccagaggccagaggtccgaaatcaggggctgtttccttctgaggccctgaggaccagcctcatccatgccttcctccttctggtggcgcctggcattcctagttgtattgtaaaggcatcacatgctctaatctctgccccattgtcacagggccttcttccctgtgtctctgtcccgtccctcctcttcctttttttttttttttttttttgtttgagacggagtctcgttctgtcacccaggctggagtgcagtgttgcaatctcagctcactgcaacctctgcctcctgggttcaagtaattctcctgcctcagcctcccgagtatctgggattacagtcacgtaccacccacctgacttaatttttgtatttttagtagagacaggatttcgccatgttggccaggctggtcttaaactcctgacctcaggtgatctgcccaccttgcttggcctcccaaagtgctgggattacaggaatgagccaccgagcctgccctctttccttcttgtctttggacaaggatgcctgtctttggacttagggcctaccctaagtggatgatcccatttggagatccttaatgaatctataaagaaagacgttttccaagtaaggtcacaatcatgggttccaaggcctggaccttgaccatgtctttgaatggatgggagcccctggggggccacagttcaacccactcctggcggtgacaccccgggagggatgggcccgaacgtttccttccccttcctctctctgtcccttcatttctcattagaatggaagaggggaaggtgcagagggaaatgcagcaggaaaagccactttgttctgggagagcacttggctgaaaggcccagtagagcaggaagcacaagtctcttaatcttccagggcctcagttttcatcatccacaaagtgggtgcagtgtgccaagattttagtgagttgagagactgtcccaaagaccacagagctttttgggaagctgttgctctaaaaaaatggtcataatgacaattaccaggaggcatcagacactcctgtgccactggctagacatgggttatctcgtttcatgtccgaagctccccgcacccaccctccttgcagagttgaagaggtgctgtgagcagaaaacctgccaagggacccagaacgggaggcggctctagaatctacagctccagccctgcaccagactccctcgagatgggagttcatgcctggaggagggtgtggagaggcacacgggcctttcccctgtctgcactcctcccctaccaccacccctgccgggcccaccctgcgggagctgcccagctgggtgcagcctgggtgttttccagtatccgcctgtggtgtcaggctggcttgcctccccttggcccctctgcctgcagttcctctcttcctctctgcccaaagagttcttgctgtttaggaaactttttatgaaaggcaggtttgggagagttagggatggatgggcctgggacgggccggcggctttgctatgggcgtgcctctgctgcaccctggtggccaaccttgagtaccgcaggtggccggtgacagaaactgtcaggaaatgcacaagagagaggtccccgcacctctctgacctgtgcgttgttgagcaccactggctccagctgaggaagagtctggaacctgtcaggacagttgtgaggtggtggggcccactttccagcagtcttatatgaggaccctggaaatgtgccttcagcactgctgggtttttatatcaggggccccatgagttcatagctgacctgacacccggactagtaagggctgtgccttgttcttgcctcccacttggtgaacagcatcttgaggtatctttcccatccttagaaaccaccccaagtattgtcaatagaaatgtggggtgtaattgatcacgccatgaactcatttaatcctcatgtccctgagaggcgggtgacgttattatccacattttatggatgaggaaactgagggaatgagagtaacttgcccgagccagggagtggcgatcacacactccaactccagcctgagagccccattcttcctgccggctctcgctgcccgtcagtgttagatgagagtgctgctggtcagtctgcaggaggttctagtgtggacaccgccctacacagggccgtggcaggagggcctaggcaaaggcaaccggcatagcactgagagcacttgagggctgggcaaggtggaggccccggccctgcctgctggcctaccaagtaaaaactagacatttttaacttggggaaaagccatgtggctctgcgatggggcagcctggagccaggtgtatgggttctgcatcccgctccagccttatgcactgtggagctgagacagacacagttcttgcgttctctatgcctcattttcttttcttttctttttctttttctttttttttttttttgagacgaagtttcactcttttgcccaggctggagtgccgtggcgtgatcttggctcaccacaacctccacctcctgggttccagtgattctcctgcctcagcctcctgagtagctgggattacaggcgcctggtaccaggcctggctaatttttgtatttttaacagagacgagatttcatcatgttggccaggctggtctcgaactcctgacctcgtgatccacccacctcagcctcccaaagtgctgggattgcagacgtgagccgtggtgcccagcgtctacgccccattttcgtaagataatggggataacaaaggaatcacaagagacacttgcaggtgtgtgaagacgaagttcatcacatgggagggcaccgggtgtctttatttgccttccctgcccggctccccacctccagtgatgccgttcactgccctccttgttaaaaggccttctgttatataacagttacacatgccaggcaccgcgtgttcatataggagttacgaagcacagcaataaaatgaccactctgagatggccaccagctcgagcccgagggcacttgtgggtgcccgtggtctcctgcccagtctccctgagaagtggccactgtcccgagcttgggcttgtatgtattgtgtgaagtgcacatgtccctgagcaatgtttagcattgctgattcttgagcttgtgaatggtcgtccacagtacgtagcccctgtgtgtgtccctgtgtgtgtgtgctctgagcgcacacaaggtggatggggccgtgggggtaacaccctgtgggccacaggttttctttaaaatcccagctccgattcctgcttcatcccattcccagcagcccagccccctgcctgtcttcaggcccctgctgggacgtcctgctctccctggtcaccccagtggtgcgggggcccactgccctggcttctccactgtggcttccttccatgctcctatttggcctggtcactgtgccatctcccattagccaggaactttctggagagcaggagctgagctgtccaggagcaggagctggtgctggtcactccagtatcccccagactgagggcagtgccaggtgtcctatactcagctgcagagcaggtggttcccctgccctcctgcccatggggctgccctcagactctgcttttggcaccagcatttctgggcagggggagagaggtggggtccgggcagagtttctccactgggacattaaagcccctcctgtctcctctcctagttgaaaacaccacacactgtgagtttgcctacctgcgggaccttctcatcaggtgagagacagggtgcttgggtggggctgacggcttcacccctaagagggccctacagcgggtgggggcagtgggtgtggggccgaagccctgggcagagtgggtgccccctgccacctgcctgccctgccctcgggaagatcttggaagcccatcttctgaaaaagaaaacccactgggaaatgaagcaggcagtgaagatccttttcaacccctgcgaagttggctggatgggaaggctgagctttgatccactgtggtctggcccgttagagctgcccggtggccactaagggcccagtgaggcctcatgtgcaggccctgccggcagcgtggggcgtctccagctccgatcccactggcctctgacccctacccctttcacctggctgaggcttctccttgtttcccttgagtccaggcaaggaggggaagccctgatggagagggtgctgggtgggtggtccctggagtgtgggccctggcctgggcaggttcttcctcagcaagcagctggcatggatgatgggaatgttatcaagaggaggggcctccaggttggcgggggcaggggtggggggattccgggagccgttctgccattgtggggatactgggctttccaacctccctccagattattcctcctgagctgcagaggaatgaaaatccgagcccaggacttttttttcctggggacaagggcaacccagccctttgccccaggccacctgcctgccacaggccatagtcctggaggccggtggtcacccactgcttccaccctgccagcaccctggacaccggcctggagcaacaatgctccagccctgtccctctgagtctatgcactgtccctgggccctggacccagggccatagggtggacccagagggagacacatgcactggaatatgtgtgttctgaccgagtctgggcttaccagggggactgacccttcccccaaaacgtgtaccagatctggtccaacatggtgggcctgggggaccccatggggagccaagcagtcgggatggggagtgggggtgggggcaggcgggcctgagtccgaggcaggccgagcagggcccctgccccgctgcccccaccccgctgcgcccacctcactgacccgcccgccccccacccccacaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccagaa

SEQ ID NO: 1827 - DNA, 219188 bp, Homo sapiens
cactccagacggcgggccgccccctcttcccgccttcctactaccggcccaggattagcgccctgggagcgcgcgccccgctgcctcgccgccacactttcctgggagcggcggccacggaggcaccatgaagaagtcttactcaggtgggcttcgcgcccggggtggggaggggtcggtgtcccgggaccagcgctgctcacctgagtgcctgcggccgggagtggcgaggcgcccccggagctgagcgagtccccgcggcgggcacactgcaggtcgagttcctcccaggacagggccgctgtcgggccgctttcgacctgagccgaccgtcccctgcgctgtctccagcccttgctcgagtgtcggaggggctgccctgggggacgctccctcttcctcgccccttgcaccctcgcaggaatcgctgactttccaggtcggccgggtgctttgggtccctgtgcgtctgtgtgggtgaatggggtcggggctaggtggaggggtgtccttgggttcagcctctagggctggtggtccaggccgcagcatcctttcttcggattctcttcggtttctcctctacttagtggggcacgggacggcctccagatgggaccgtccagcagcgcccaaacttggcgactcgggttcacgttttgcgctcaggacgccgcccgcggctgacatcctcactccaccctagcagggcccgccttaagtaggcgaagggggcctgacttgggcctcaccatgagccggttcaggagctttcatttcataagaggctcccgctctggcactctgaagttccatttcacagatgggcacaccgaggccacaagggcaggttaagagaaatccagatcttcattatttgtcttttccttccttttttttttcctttgtggttttctccaaaggatccaggcaggcaggatcctttgtcctcctcagtcctcaaattataaatagcgtctcctcttctaaatctagaaaccgtttgtttaatgtccctcctttaattcattcagatagaaaggtacctgccaaggatccatgaattaatttttattgataggagaacagaatcatgggccttagttggaggtgaaggagtcatcggggccatccccctgcctttgggccattgtcggtttcctctggctttccatatttaggaaccaaaatgagtgataaagtaccttgtctcaaagaggattactcagaacttccccgaaaatacccttctgggtcagtagcttagaatttcaactttcacccggttgttgcgaacaagatggccctctacgcacccggagcacagctctgtcaggagcgtgggtgggttggtgtgctggtgggcgggagcgggcttccaggtggcacatgcttggttttggcaccggggcttcctccccaacatgctccaaatacttgagattgttgtggggatcgcgcggtgcatggccctttccaggggatctctagcccgcccagggagggccctttgcccttggtttcttacactttacctcccactggtgggtccagacagtgggggtgaccggggtcctcccaggtcgtgggtcctgggttttttctgcggagaccctcctgcacagatgccggaagggccctgaggcaggcttggagtctctgcacctgcggcttactgggaggtggggagaccatcacttgtccttttctcctctcctccacacacacctaccccacccctcactgggtttcttttttttttttttttttaaaaaaaaggacagaaccttttgcagtaggtggaagtagagtttgtggagtgagcaggaaccaactcttgtacagcagcctcggtgcctccttgtgtttacctaaaggggcaggcccctctgaggatgggggaagggagggctcagaccatttctggtttgctccctgcttggcagtggcccaaggtgtgctgggtcactgtgttgcagttgtatggagtgggactggagggggctgatggtgggggtggcctcttgccctcattctgagtgtcctggagctgtcttggcaccagcccttttccgggtacgggcactcgcaggagtcaggctgaccccccaacaagccatcgacaccatgaaattaaggaaagcagcaaaagatgttaaaaatcccccaaggctctgacaatccaaggacaacaggaaggtctttattttttcatctagactgtgcgggattattgcttccagacctgtatgtgggcttcagaataaacggaatgaccataatgttgttcccggtagacctggtttgaacattcgtgagcctctgaaaaggagaaagattttagaaggatgtgttggggcaatctcaagtaccgtgggtctatagacagtcatcgaagacactttatgtgctgggcacacatggccaagtctgagtgggtacagaaatggtaatgagatatagtccttgcctgcagagaacttacattctcaccgggagtcaggatgagggcgagacaccagctcattaacacccttccctcctgagcagttcagcctccaaatactacaggaatgccccggaggttttaggtggaggtgagattgagctgggccttgaggaaggagaagtcttgagtagtggagaataaaaagggacttggccaggtgcgcttgaagtcccagctactcaggaggctgagacacgaggatcgcttgagcccaggaggctactcaggaggctgagacacgaggatcgcttgagcccaggaggctactcaggaggctgagacaggaggatcgcttgaagccaggagttcaaggctgcagccctgtgacagcgcctggaaatagacacggcactccagcctgggtggcgtcatgagaccccatctgtaagaaggtcttttccaatgcggaaggcagcaagggcccacacagggcagctgcaggatccagggggacactggggacaggttctctctggcagctccactgctgctccaggctttcccgattgcctcacccggccttccaatggggtggaggtagtggtagtctacaggcagtgtggtccagtggttacacttgggggctcagagccgccagccccttgggattaaatctcaccaggctgcgcctctccctgtggcacaaggttctcacctcatgcatctcatttgcctcatttgtttttttgtgtgtgtggtgttttttaattttatttatttatttatttttgagacggagtctcactctgtctcccaggctggagtgcaatggcatgatctcagcttactgcaacctccgcctcccaggttcaagtgattctcctgcctcagcctcctgagtggctgggattgtaggaacgtgccactgcgcccagctaatttttatatttttactagagatggggtttcaccatgttggtcaggctgatctcgaactcctgacctcgtgatctgcctgccttggcctcccaaagtgctgtgattacaggcatgagccaccacgcccagcctgcctcatttgttaaatgggacagtgctatgttgttgtaaaggttaaacgagttcatatttgaaaaagctgagaaatgcctgctctgtaacctgttagctgctgtcatgatcatgattgtcattgacaggaggatggagaaggctggggttacgccattgctaggacgttccagaagcctccatgatcttcccttactgtggtcagagcatggtgcagggtctctcccccagcccctcagcactggagccagctgcactgtacccgccctggctctctaggttctgagttttgggactccctttgcatactaggtcacatggaacttgccgtcattcccaggctcccctggaaactctctgtgggtggcagcggcaggaggacttacccgaggccgatgagccacagaagcgggactgaggttgcgtcacacccctactggcacctgggaattactctggagattctttttttattttttatttttttgagatggagtcttgctctgttgcccaggctggagtgcagtggcacgatctcggttcactgcaacctctgcctcccaggttcaagcaattctcatgcctcagcctcctgagtagctgggattacaggcatgtgccaccgtgcccagctaatttttgtattttttagtagagatggggttttaccatactggccaggctggtctcgaactccggacctcaggtgatccacccgcctcagcctcccaaagtgctgggatcacaggcatgagccaccgtgcccagccactctggagtttctctgtggctttcaggagattcctgaaggggcaccagccacgattaaaaagctctatgctgtcgtgacttctgagtcctgggcagggagggaggctgcacccacacaggaagcagcttctgccgtgattcagtgtgctggctcgccgtggtggacagggctgcaccctcacccagcgccccgggagctgacttacgggaagggcaaggaattgcaccctcagagaacacttccccagtcagctaacccggtgacaggcgagcgtgggaagggcacaagcacagggtttcttcctcttctcccccagccccgtctccgcgcctgttctcgctgcctcttgcctcctcacgtccaagcttgtctgctctggcgcattcaggggacctggactggagagaaaaagccacctcgtacggttagtctgtggctctgtctgacttgtgtcctccgccgaggcccctcagttgtgagacagctggctgagcctaagtcctggggccagccctctccctagtctgttgcaaaggtagaaaggcatgcccaggcaggggccacctgccctgcccgctcacgccagaccgcaggcacttgcccgtcagatctccccggcctgcccagagggattctgatagccgagggcaatgcacctggcagcggagcattgcgtttgcgacagtccaccttcttcctggaaccaccccccacaagtgtgaccagctcaagccaggacaggtacagggggacccaggattgccacttaggggcagtggtctggaatccaggtccaggtgacatgggagccaaccctctgcttggagatcccaggtgggtgtttgcagaggacatctcacttgaggacccatggaaggggacacttcccaccccctacctggtccttgggctgccctcctctgacactctcctgccatcccaggcagccctgacagccccatgtgactgggacctagaggtggcccctgtttccgccccagtgtttgtccacaggcagtgttgcgtgggctctgaagtttgcctaagatggacctgataaggggagttcagtacacatcagtgcaggcccggccagggggtgatgatggcagttcctgggcagatccagctggctttagggtaggaggggctccagagagaggctccaggcccctaggggtgtgaacctttggggtgaggcgggaagtgacgcgctgggttcctgcgcctctgtttgttggagctattaccttggaaacatcccagctctaggcggttgccagggatttatggggatcagtgggtgccaatccctgggtgaagccctcggggcttgtacacagcacacagcgctgtggccccatggctcactttgctgtgtgaagtggctcagtctccgggagagtccttagccaggcaggcctgacggcaactgccaggtcatggtgatctggaatcgctgaccaaagggagtcagtcctggtgggtggagggacttggtgggcagccatcgtgatgccaggcatggggatcgtgtgtcacccaggcctgtgggtgccgagcttctgtgggagcagtgaagtgcccccgtggccgatgggctggtcacccctgcccctttcctgatgtgacagttgtgcctgggccccgggaaatttgccaggaggcctggcattggcctgctctactggagcggccctgctgagctgtgagctgcccgtctccctgaggttcctagcccatttcaactctccatgtggatttggtcattcattccagaagcgtctgccgggcgctgctgagtgtcaggttctgtttgcctcctctcctgtacgctggaggctctgggcaccagctctgcagggtggcctggccttgggtctccagggtagagcatggcactctctgctcccagcccagtttctctctgctttatctccctgaccccaccctgggcatgggcccatttgcagcccctgtgaagggagacattgagctgttgctggcagaggaggggcggctcctgggcactgcttgccaatggcctctcggcagctctgtgacagctgagctttgttcccagcctaatctgacctggttctccaaagcatgactgttggcagcctgaaaacctccaggacaggaaacaggagtggcgcagggaatgtaagatgatcccagcttcaagtcactgggcggcccttagacccaggctgcctgctgtctctggcaggaactcaagtcgctggtcatcctcagagcggtgttggcccggggccttcagtggcctttgtgtctgggtgagaggaaccctggatggccactctgccctgagtgtgtgggtccccagaagtgctgggttagggggcacggagggccagaaagtcccctttggagcgctggactctctcgctgactcctaccccaccccggcctggggtttcagagaaggggtccaggcaggagtgtcatcttttctcaatggggatgtggcttcagtctctgtccaggtgggtgcattgctctctttccggctcctcccaggctgcttaaatgacctgtgacgaggcctgcgccatggccggggccctctgcttttcccagcgctgcacctgggaaccaggggttgggccccggaagccgaggatgtccctgaatgccatgcctgggcacctgtcctggccaggcgaggcgtgttggggcagcggctgagatgggagcagcagcattgcctgccaggtttgagatgggccccgggtgagtgtggttaccaggaagggctgggcagagcaggcgggtgggccgcccctggggccttgttccgcagatcaacctgatccgcaccctggggccggggcttcctttcacagccttcccatgaactatggctcctgtttccatcccaaatcagatcccagaagaggaataatgtccatgtaacccaagccagttggaagtgggttacatccaacccctgtcatcttccagcttgttaaggacttgactaactcaacccagagggatttggagggttgtctgcaaaacccactaataacagggaactttagctctgtagccacagggtctacagaggtgtcgggctgtcgggttattgctgggaggtgagccggtggcgtagacaccatggaggcaccggtagtggaagagctgcaagtgcacacagaggccggcaccgaggggcggggaggaggaggtggtggatttctcgccagtgttggcatcatgttgcctccagcatcagagacccaaggtgtggctgaccttggctggggcgatgagtcattggatagcagagccttcctggtagctgggggttaacgctttaactgccgggactttgtattatgccgcttcttttttttgttttgtttggtttggtttggtttggtttttgagacggagtctcactctgtcacccaggctggagtgtggtggctcaatcttggctcactgcaacctctgcctcctgggttcaagcaattctcctgcctcagcctcctgaatagctgggattacaggcacgcgccaccatgcctggctaatttttgtatttttagtagagatggggtttcgccatgttggccgggttggtttcaaactcctgacctcaggtgatccacctgccccggcctcccaaagtgctgggattacaggcatgagctaccgcgcccagcttgcatttatgcttttttttttttttttttgagatggagtttcgctcttgttgcccaggctggagtgcaaaggcgcgatctcagctcactgcaacctccacctcccgggttcaagcgattctcttgcctcagcctcccaagtagctgggattacaggcctgcgtcaccatgcccggctaattttgtatttttagtacagacggggtgtccccatgttggtcaggctggtctcgaactcccgacctcaggtgatccgcccgccttggcctcccaaagtgctgggattacaggcgtgagccaccgcacccggcctatgctttttattattattatttaattttttaaggaaagcaatctaaactgtacactgtatcttttctttctcttttgctttttgttgtcagttttctgtattacttattgccaaacaacatgaacaggaaattgaaaggaaaacttcaacaatcattggctgtagcatttcttctgtgttccattcagtgcttgtctcctcaggaacatgacatagggtttgatttaattatgaaaggcgtatattttcagagttttatactccccatagaatgaatgttgaattctgttcttttcacttgaaattagatctcaggcatggatttcatgattatcactataatggctcttcagagtggacattgcatcttgtagggaaccaccctctccccagctgctggtgtggacgctcctccttgatggtgtgggtctgggcccctgaagggtggtgtcctgagtaaagatgttacagtagccatgcttatagctttgggcctggggctaggtggagactggcttcaaccctagagcttgctgtcttaaaataaattcttttttttttttttttgagatggagtctcgctctgttgcccaggctggagtgcagtggcgcgatctccgctcactgcaagctccgcctcccgggttcacaccattctcctgcctcagcatcccgcatagctgggactacaggcacccgcccccacgcccggctaattttttgtatttttttagtagaggcggggtttcaccatgttagccaggatggtctcaatcttctgacctcgtgatccactcgcctcagcctccaaagtgctgggataaaataaattcttagggccgggagcggtggctcacacctgtaatcccagcactttgagaggccgaggcgggcagatcacaaggtcagaagatcgagaccatggtgaaaccccgtctctactaaaaatacaaaaaattagctgggtgcagtggcgggcgcctgtagtcccagctactcgggaggctgaggcaggagaatggcatgaacccggaaggcggagcttgcagtgagccgagattgcgccagtgcactccagcctgggcgacagagtgagaccctgtctcataaataaataaataaataaataaataaataaattcttatacccacttgcattatttattattattattattaaacagggtcttgctgtgttgcccaggttggagtgcagtggcgtgatcatgacctcccagtctcgacctcccagtttcaattggtcctcccttctcagcctcctgagtagctgggactacaggtgtgcgctgcatgcctggctaattttttttttttttttttttttgagacagagtcttactctgttgcccaggctggagtgccgtggtgcaatctcggctcactgcaacccccggctcctggattaaagcaattctcctgcctcagcctcctgaatagctgcgattacaggcatgtgccgccacacctggctaatttttgtatttttagtagggacggggtttcaccatgttggtcaggctggtctcaaactcctgacctcgtgatccacctgccttggcctcccaaagtgctgggattacaggtgggagccaccgcgcctggcatgcctggctaatttttaaaaaatttttgtagcagccgggcgcggtggctcatgcctgtaatcctagcactttgggaggccaaggaggtcgggagttcgagaccagcctgaccaacatggagaaaccctgtctctactaaaactacaaaattagctgggcatggtggcacatgcctgtaatcccagctactcaggaggctgaggcaggagaattgcttgaatctaggaggcgggggttgcagtgagctgagatcgtgccacggcactccagcctgggcaaagagagtgaaactccgtctcaaaaaatttttgtttttgtttttgtagcgacagggtcttgttttgttgttgcctaggctggtactgaatttccagcctcaagcgatcctcctgcctcagcctcccaaagcgctgggagtacaggcgtgagtcactgtgcctggcctccacttgctttggctgcctttctctgtcttaggtaaccatacatttctccaggtaattaagaaaagattgcgcatgatgagtcccttttctggtatttctgggattgcccccaaaaccagacaagtgttcttaccttgacattttattaagactttaatgaacagaatgccgtttgccctcagtctgctggtccccctgcgaaggcccagggcttccttgtttgaaaagtcatccccttgtcgaggtctttgattccttttcaccacggcagtcatgccgagggtccacagagccaccccttccccatctcttcctcggcccctcaagacgcatctgtacccccggagatgtctctttgttttcttgggccacctctcctggccgtcactcaccctgctgactcattacttgtgcaacagtttcttctggaaccctcaggctcctgccacctaccctctgcagtccccgttttgttcctcttgcctcagtcttcctccccatcacccctctacctgttggtctccatctctgtctatggcacatccctgtgttatactctgatggctggataaaggttgagtgaaacgcatctacccctttggtgactggggtgcccattaatcagaagggatccaaggctggcgtagccttttcccgcatcctggggtatcgtcctgtggctcttccttgttggagtctgcagttttttgtttttttttttttaaattttttgagatggagtctcgctctgtcgcccaggctggagtgcagtggtgagatcccagctcactgcaacctccgcctcccgggttcaaccaattctcctgcttcagcctcccaagtagctgggactacaggcgcccgccaccatgcctggccaattttggtatttttagtagagacggggtttccctacattggccgggctggtctcgaactcttgacctcaggtgataggctcgcgtcggcctcccaaagtgctgagattacgggcatgagccaccaggcccggccgttgagattaccttcataagccaccaggcctggctgtagttggcagtttttgaccactggtctcgctccacgtgatctgtgatcttccccttggccccctggccctgccctgttcatctgctcacctttctcatgcatgcggtttgttcatagggtatgtaatggggtctaaccaggaaatggaaaccgcttgagcatttatttatttatttatttatttatttatttatttatttttcccaagacaaggtctcactctgtcacgcaagctgaagtgcagtggtgtgatcacagctcatggcagccttgaactcctgagctcaagcgatcctcccttctcagcctcccaagtagctcggactataggtgcacactatatgcctgcctaattttttcttttatttttgtagagacagggtcttgctttgttgcccaggctggtcctgaactcccaacctcaagcaatcctcctgcctcagcctcccaaagtactggagctacaggcatgtgccatcacgccttgctaatttttgtattttttgtgtgtgtgtaaagacaaggtcttactatgttgcccaggttggtcttgtactcctgggtttatgtgatcctcctgcctgggcctcccaaagtgctgggattacaggcgggagccacagtgcctggtccacttgagcatttagaacagaaggacttaaaggcggggaactagttacacagatgatgggagaggtgaaggccagacagggaacagagaggcaatcagcaggaaatcaaagtggtgtgggcttatacagccctctaaaggtatggatgcaatgattcatttagaatgagaaaataaataacagcaaattataaattataagcagctgttaaatatcacaaacatcactacatgcagaagagtaccagtcaactgtcagtcatatctccaaagttctatttctcccacatttttggcattacttcttcaatatgatgactttgtaatatcgttttctatttcgagaacagaaaactgatcaggctggacacagtggctcgtgcctgtaatcccagcactttgggaggccaaggcaggtggatcacttgaggccaggagttcaagaccggtccgggcagcgtggcgaaaccccgtctctactaaaaatacaaaaactagcagggcatggtggcatacacctgtagtcccagttacttaggaggctgaggtgggaggattgcttgagcccaggaggtcgaggctgcagtgagccgtgatcatgccactgcactccagcctgggtgagagagtgagaccatgtctcaaaaaaaaaaaaaaaacaacaaaaaaaaacataggctgggcgtggtggctcacgcctgtaattccagcactgtgggaggttgagatgggcggatcacttgaggtcaggagtttgaaaccagcctggtcaacatggtgaaaccccatctctaccaaaaacataaaaaattagccaggtgtgatgacgcacgcctgtaatcccagctacttgggaggctgaggcaggagaatggcttgaacccaggaggcagaggttgcagtgggccaagatcgtgccattgcactccagcctgggcaacagagtgagactccatctcaaaaataaataaataaataaagcgaatgaatctccttagttgatcaaattttgtttttatttttggtagttgggatgtatacaaaagtggcggtcaacatggagttggtggtgctgctacaattgttttgttcaagatacacaggaattctggtaaatcctgtttttttctttttttttaaatgtgattcccatcaagaaagaagtaggaaaatgggggagatttctaactgcatatgaggcatttgtgcatgtatttctgaccagagagacttttctgttttgactccacattgaaggaactgaatcctttgcttacaacttcacctctggtgatgggagtaattttccacagatttgcttctggacccgtgcatttcaaatcttgcttctctccactgcgcacgtttttccggcgccaggcaccgcaggatatgttcgtgtcttgtgatttttgattctgcgcggtaggtggaattggaacggtgagtggagcgagtattgctggaatccgtttccacaccgggatagcgagcagtaactgaactatacatggaaataaatgggaactacataaatataacccgaccaaagccaaactaaatatctttccagttcaacttctccttagcaggagcccccacgtggcagcaagcctccgtttccacctcacacaagagaaaatgtgacgggcaggaactcaagactggaaatgaacggggacgttaattgattgtagggaaaatattttccattttgtaaattttacaaaaaatgtttgaccctgtggacatgtggttagggcccttctcagtgccttgagagggaaccatgcaggtagagggagggttcttagcattgtgggggtgacctggagattggcagcagggtgccaccaccacccctaggtggggatgagagggaggaagtcctgtgaccagagtccaggggccagagtcacctgctgggagcccaaacaaaggtgggactctggcaggagctggaactacacagaggaccacctctcctgctggagaagctgtctgaggcagaggaggtggagagctcccgcgccctcccttgcttccacctcccaggttcctcccaagcctctcgttggttgaacccagcccaaagccagcaggcctggggacctggacacctgagccagcagaggtcggcgtttctcccacacaaaggagggcacaagaagtgggaggcacggagggggatcaggccaggacccacacaggatgtgcaaacaggagctcccctctcttcccaccccaaatggcatctgcagccggcctcacttccctgctgttagacaggaagaggaaccttgttcccggcaccagctgcccccaccgccccccaccccacggaggcccctttcctctctggcctttgcttgcaatcattggcgacgctgatggaccatatcttctggggagtttggtcatgaacatggtttcccatttgttgtggaccaaactgtgcccttccccttgaattcctgcgttgaagccctaactcccaatgcagctgtaattgaagatagggcttttagggaggtaattaaggttaaatgaagtcatagggcaggaccctaatctaataggattgatgtccttataagaagagggagagacaccagagatctctcctcccccctcacttgtaaacagaggaaaaatgacggaggacacagcagggaggtgggtacaagccaggaagaggggcctcgccgggaactaaccctgacggcaccttgatccgggactttgggcctctcaaactgagaaatacatgtctgttgtttaagtcactccctccacagtaatctggatggcagcctgagcttaccaaggcaccgtctgcatcagccagggctctccagggagacagccaataggagatggatggatggatggatggctagatagacagacaagcggacagagagagagagagacaggcagacacagacagacaggcagacaaatggctagatagacaagcagacagagagatagagacagacagacacaaacaggcaaacagacaggcagacaaatggatagatagatgatagatagccaggcaggcagatagacacagacaggcagacagacagacagacagatgataggttgggttcagtgactcttacctgtaataaccagcacattggtaggctgaggccggtggatcacttgaggccaggagtttgagaccagcctggctaacagggtgaaaccccatctctactaaaaatagaaaaattagctgggcgtggtggtgcatgtctgtaatcccagccactcgggaggctgaggcacgagaatcacttgaacctgggaggtggaggttgcagtgagctgagatcacgccactgcactccagcctaggcgacaaagtgagactccatctcaaaaagaaaaaaaagatagatagatgaatggatagatagctagatagatgacagatggatgataggtagatagataattgataaatagatataaatgaccgatggacaggcagacatagatacattgattaggtagatgatagatggatagatagaagatagatggtggatgggtgggtagataggcagatagacagttagaaagatagatgatagatagataggaaggaatttattaggggaattggctcataccattgtggaggccaagatgtaccacagaaggccgtccgcaagctggaggcccaggaaagccagtatcgtggctcagtccaagtctgcaggcctcaggactgggaagctgttgatgtaactcttagtttaaggccaaaggtttgagagcctggggaactgctggagaactgggagttctaagtccaagggcaggagaggaaggcatcccacctccaggagaaagagggaattcaccttttctctgcctttttgttgtctggcaatggaatggtgtcatccatattgagggaggatctttaccactcagcccaccaactcacatgcccatctcctccagaaacaccctcacagacacacccagaagcgatgcgttaccagccatcccttaatccagccaaactgacacctgccgtcagccaccacacaggctcagaagaatcgtggttgcatggtgatggtctccatcccgtctaaagaagttgaagatgaactgttggcacaagccatcgttctttcaggctccttccagtcgttcattcttttaaaaatgtattcattgagcacctgctgcatgccaggtgctgtgacaagcactggggcacagcagtgagcaaacaaggactcttgtttcttggagtttacatgcagtagaaggaaacagaatcaatgaattcatcagttctagaaactatcaaaataggactaagagctgtggtgagaattaagataaggtgattgcatagaaagtgactgatggctgctttggaatgagtggtgaggggtcacagagatgatgacagctgagttgagattgggaagacaggaaggagccagcagtgcaaggactaggctggaagcaagcttggtgcattccaggaacagcaaggaggccagaggggctgcagtagagcaggcgaggaggaggagggagacgcaggtcaaagaggagcctggggccagatggaggaccctccctccaaagctcagtcatttcctccttaaaggagaatgtgttacctccaaaagtcacatatgccagcacagtgtctggctcatcatatgccttcagtaggcggtgagcatggctgttcttgttattactacatcacaattactaggaataatggagtcaccaggctttgcatttacagcaatgtgagggagtcagcaagcttccctggggaacccatctcccctcactaagttcataagagcctgataaccaggtcaatgtagtgagagctatagctgcccagtgtactggactctttagccacgggccaggacactttcatctcagcagaaacctctaaggggactggggagtgtgctgtggatgtttctgggttactcagacctcctggggagccttccccaccgcagctgctgcagggagctcagctgcagtgatgaactgcggctcagccttgtttatgggaaaaccctacatgggagatgggacggtttcctgttggttctctcggcctcaggttgctttcacaagtgcagggattctcacctgggtgtgtgaatggggctcaggatgccccaagggtatgtggagatgggggtcagctgtcttctctgatgcctctgaacctcctccccctgcctttctgcatctcattgcttcctggcctctctcactttgggtgctttggaacaacatgcaatccaatacacaggctgactttattattttgttttgttttattttattttattttggaaacaaaggctctgtcattcagcctggagtgcagcggtgcaattgcaactcactgcagccttgaacttctgggctcaagtgattctctcgcctcagcctctcaaagtgctgggattacaggcatgagctgctgtgcctggcctaggctggctttaaaagctcctcactctctctgcatcctgatgatacctacctcctggagcaggctcccagccattggcttcggatactttgtagctattattggccagttgtggcatgtgaagctgaggctcaggagaagggcagtcctgtccaaggccacacggctcagtgctaacactcagacttcagtgtttttatctccctcctggtcgcttccacccttagtgcatctctggaggcccaagggagctaaaggccaggctttggtcagctaagaatttaaaaaagctgtctctgtgctcctctgtcaatccatcactccattatctcccccgacaatgaattcagtttgaatttcagataaacaaggattaatttttagtataagcatatcccacaacagacttgggatatacttatgcctaaaaatgattcattgtttgctggccttagtagctcatgcctacaatcccagtgctttgggaggctacagttggagaattgcttgagtccaggagttcaaggttacagtgagccatgatcatgccactgagctccagcttgggtgaagcagcaagatccttatctcttcaaaaaattgttgattgtttatctgaaatccaggtttaactgagcatcctgtattttatatgagaaccctatataggtgagacccagagtcccaatgcccactggtaagcctttgcagggaggctctgtgggtccttggctggcactgatgccctgtgatgagcagggccatctggcaaggtggacgcctgctgcccatgcaggcagagcaaggccctgggcaggtatgagctgatctcaccttccccagcctgggagccagatactgttggcagcttgccgtcaagagaggggctggtcaccaagagaggggcggcctccatgggccttctttggcttttggctctcccccagccctcctcctaccccaaacagaggccaacggcaccgcaccagaaccagtgtgctgcctcctttggttggcattttgtagttgggtagactgtttccttctcacaggagctggtggtgccccttccgcttcacagggaggatggctgagacccctgaccttgacacagggtgctgttctttttttgttttgagacagagtcttggtcttttcacccaggttggagtgcagtggcatgatgttggctcactgcagcctccacctcctgggttctagcaattcttctgcctcagcctcctgagtagctgagattacaggcgtgcaccaccactgagaacaatgccttctacagtgtttattctcctgtaggagcaagttcctaaggcaaggaggttgctcccctcatggatgaataaattgactttgatccacagccccacgtgtcagccttgagggtggggaaaggttgttctgtgtctaggcagggggtgggggcaaggccaggagggcctggtgcccagtgtacctcttcaggacacaactccaggtagcagaggccaaggacagaggggaggagaagagggaggtggccattatctccttatctcagcttcctttggagataagcttgagtattttagttgtccactaagtctggagataagtctggaatttaaacctttgactttgatccagcccttcacagctcctgtgagcaaactgagcctcagaaaaagggagtgaagcctgtgcatcctggacgcccccaccccaggctcaaaccgcccccaccccaggctcaaaccgcccccatcccagctcaaaccgcccccatcccaggctcaaagcgcccccatcccagctcaaagcgcccccatcccaggctcaaagtgcccccatcccaggctcaaagcgcccccaccccaggctcaaaccgcccccatcccagctcaaaccgcccccatcccagctcaaaccacccccaacacaggctcaaaccaccctcaacccaggctcaaagcacccccaccccaggctcaaagcatccccaccccaggctcaaagtgcccgcaacccaggcttaaagcgcccccaccccagctcaaaccgccctatcccaggctcaaaccgctcccaccccaggctcaaaccacccccatcctaggctcaaaccgcccccaccccaggctcaaagtgggaaggagccacagggaaacaaacgggggaggcacggatgaccaggatgagggtctccatgacccacctttccccaggggctatctcaagagctttttaaacttttattattttttaatagagatggggtcttgctgtgttgcccaggctgatctccaactcctagcctcaagccatcctcccacctcagcctcccaaactgctgaggttacaggtgtgagccactgcacctggcctctctcaggagtttcaagaaaaaaaatgggaatagatttgtgtgtgtgtgtgtgtgtgtgtgtgtgtgtgtgtgtgtgtgtgttttgagaaagagtttcgctctgtcacccaggctggagtgcaatggcacgatctcggctcactgcaacctccgcctctcgggctcaagtgcttcttctgcctcagcttcctgagtagctgggattacaaacatgcaggctgattttgtattttcattagagacggggtttcaccatgttggtcaggctgatctcgaactccggacctcagatgatttgcctgccttggcctctcaaagtgctgggattacaggcctgagccaccgtgcccggccaggaatagattcttttctgtagatgacttctgtcattattgaaaatggatgtttatgcacaattgaattgtcataacgcctcatcctaaaaagctcctttttgagaaaatgtgacttttgatagaggagagactgtccaggcctcattcattgtcagcacaaaggcagagcaggggtgtggcggtgtcaccctcctctgagacagccccatccctgctctgcccaggggttcagaagtctggtctattcgagcccacagaggggtttggagtggctgtcttacatcacaggtggggtctgtaaggatctgaaatgacctttgagaaggcgggtgtggtgggtgcatttcaatcattaaagtaacaacaatgatacatcaaatagtgtctgctcagattctgagtgcctgtttaaacatttccatcttgtgacttgccagattctagcataacaacccaggtaaaagaaaaaatagctgggcgtggtggcttgtgcctgtaatcccagcgtgaggccaaggcaggaggattgcttgagaccaggagtttgagaccagcctgggccacctgagaccccacctctgaaaataaacaaaccaataaaagaccttcatgctctatgtctttcttatatctaggttccccaaattatatgcattggggaaagtccattaagagaagcccctggccgggcgtggtggctcacgtctgtaatcccagcactttgggaggccaaggtgggaggatcacaaggtcaggagttcgagaccagcctggccaacatggtgaaaccccatctctactaaaaatacaaaaattagccgggcgtggtagtgcatgcttgtaatcccagctacgcaggaggttgaggcaggagaatcacttgaacctgggaggtagaggttgcagtgagccaagttggtgccactgcactccagcctgggcgacagaaaaagactccatctctaaataaataaataaagggagagaagcctctgggctcctagatacatgggtcagtgtccacccctgcaaagctgctgtgcccaaagaggggctgtacttggtggaattggggcaaaagagcagggagggcactgggcagttgacctggtctccactactggaaaggggctgtgctgctggtgccctgagctggttccacaaggaagacactgcacagggcgccctaagtttgctctttctgcctaggctcaccctttcctctccaggaccagggagccccgctcgtctcctgtcttcggcatctgctctctggcttgtgagcactgcatttctttctgcttggaacgccggcccatggtgggtccccggactcctgccttctgctgtcttttgccatatctcgtcaaagtgtgttttatttatttattgttattattttttgaaacagagtcttgctctgtcgcccaggctggagtgcaatggtgtgatctcggctcactgcaacctccgtctcctgggttcaagcgattctcctgccttggcctcccgagtagctgggattacaggcgaatgccaccacgcccggctaatttttgtatttttagtagagatggggtttccctatgttggtcaggctggtctcgaactgacctcgggtgactggcccacgtcagcctcccaaattgctgggattacaggcgtgagtcaccatgcctggccaactattataatattgatattataataatatcacagccagataacggtgactaacgcctgtaatccgaacactttgggaggctgaggcaggcagatcacctgaggtcagttcgagaccagcctggccaacgtggtgaaaccctgtctctaccgaatatacaaaaattagccggagcgtgatggcaggtgcctgtaatctcagctacttgggaggcggaggttgcggtgaactgagatcgtgccactgcagtccaacctgggtgacagagcaagactccatctcaaaagtagtaataataataataataataataatatcacttattgagttttaattttgtgccaggcactgtgctagtacttgcgccatgtgacctcattgactcggaacaacctatgagtaagcaccatctctgtccccaaggaagctgagactcaggaaatggaagtcatctcccagggcccacagcaagggcctggcgaggtctgcgttcaaattctgatcatctgactccaggctttcctgcctcctttgcctcccaaaaactcaaatactttcatctgggatgactccagacagctagatttcaattgtcttctctccttctgagtatgttttattttaaaatcacataaagataactcacttctcaactggagccacggaatcgttagatgtcttggagacttttctagctacctctttgctggactcagacacaggcctgaataattaggtccaaggagctgaactggagccgctcgtggccagaggtcccttcctgggaacagcagtggcggcagcggctgcgctgagcctggcaatttgttcaagagcaggggatgctcaggctgcgctcgcccccttcttatgaacggtttgctttgcgtcttctctgtgccaagggctgccaggcaccagatgcccattttaggaaatcagaaaaataaacagtgtaaataaaacaaaaactccacccaagaaatctgagacagatgctgttttccccaccgtttctccacccccatgctgggtttggagagagtgggccagcatgtttcctacggataagaggccctggggtatttaacctggatggaacctcttctattttccttttgcctggtgctagggggcagaaggcaggggtggtgtccatctggcccagggaggaggatagggcagcctttgtcgccggcatcccctgcagagatgtctcagccagaagtgactccatcctcaggaacgtgtgtcctgttctttgctgggcggcccctccttaccccccattgtttccacagtggggtgtgctagatttatgggcagagttctggttcactctcagccccggacagcagaatgtcccagtagtgcactgatggtgtgtgcgtggggatgtgtggaacaggggatagtgaccccgtgtgcgttatatgcagtgcggcttccagtcgggtgtgtgaagggggtgctcatggccatcgtggaagtgagctcagctggggctggagggtccaggctcactgtatgccactcagcagccttgggagtggggttcatcctcctccccgctcctctcccctcctggtcctgggcagcccaccggagctgcactctgggccatctctcctggtcttaaggaggctgtcatttctgggaggcagatgctggcccttccatccttgcttcctggagatctgcgccgaggtctgcctttctgtctggagggactggccaggaacccctgggttttcctggtggggtttttgttgcttagcagtgagcagagtgagtgggcaccaagaggaggatgctgggtgaggtcacggacatggctggggcaggctgggggtgctggaggtgaattccgcagctgtgcgaccttgggcagtttgcccagccctgggcctcgcttcctcctctatgaaatggggcgggagcacctgcctgctggggttgtgggttgggtgaatcggagctaaggtacagctcacagcctgccgtcagaccctcgcaagcagaagtgggtgtccctgctcagcgtcctccggtccctccttcaaggctcagctttgtcctcatctcctccatgaagcctccctggttactccaggagtcacgacccacaccctctttggagccttgtgtcacacgcatttctcacggtgttgctttccctggaggatgggttcaactaaaattggggcccatctgggggttccctccagcaccagagaagctcaggcttagtagagatgggtaccctgtcaatactagttccgcgaaggatacactgtgctcattctgctgccagttgctgagtctggtgtcctgtagttatggaacatgtgtacaggcctgggctgctggacacgaaggccagatgggcagttcactctgcctccgctctgagcctttagaaacaagctggctgcacccatttccatctggtcacagtttaggagtggggttgtggaatggatggaaggaaggatgagtgggtgggtgggggggtgggtgggtgggtggatggatggatggatgatgggtggatgggttgatggatgggtggattaggtggacaggtgaatggattggtgggtgggtgggtgggtgaagggctgaataggtgggttgggtggatgggtggatggatgtgtggaggggtggtggggtggatggggtccatgggtgaatggatggatggatgggtgaatggagtaaatgagtgggtggatggatggatggatgctgcaagagcctttctggagggttccagggaggaactggcatctttgaccagcagccagcatggtgatcagatacagggaggtgtctgggtctgcctgatcccttatctcactgttggtgggactgggctggttatgtgtccctgaagctctctgaagggtggctgtatggcattgcccaggggacatccccagagtgccgtgctctacagcaatagggtggccgcctgtgctcccagggccgctcctcctggcagcctttcgggtttgcttggcttagcacctcagcaaatctcctcgagttaggacttgcctgccatgagcctctccaacaagcagccccaggccaaggcctgtgtgtgggcagagggagcgcatgccgcgggaggctgcattaatctgaggttctgtttttgttccctcctggggcaaaaggtaaaaatagcctgtcccactccatccccaaatccagcccggctgcacccagccctgggagtgaagggggctgggtcaggactgcccgtgagttgtagaccctggtgtagggaaaccctgattcataagacgggtggacatggaggaaggaggagactccgtccagcagagacacgcttgggtgcagcccagcttggagtctgatggacgtgggctcacctgtgtgcaactctcattcactgtgtggccacagggaagtgacactctgtggagactcagattccttatctgcaaaacaggggtagtagggcttgggggaggatgtgtgtgaaggtttggcccagggcccctccagcagccagacagcagtggctgtcatccctccagcgtccagggttacctgggggagtagggcctctgtccccagatgggccccgtttctggctctggaactcacagcaggagcaaaggcgaggacattcctggtgttaatcatccacccggagggagagcgccagtggccttgtgtgacctttgccctttgtctctgtctttaggaggcacgcggacctccagtggccggctccggaggcttggtgactccagtggcccaggtaggtggctcgctccgctctggccccacccagctcatgggtgtgtttgtgctggggtcccttcattctggtctgggacctgcctccccacctggcttccctggatgagtggggccacttgcccatttcccagggagacgcagtctttgacggctttggactcaggtggcttccaggcctgtcgacgctgccctgctggagatgatccttgtgggggcaggggcagccacccccaggctcagggagcaagcccgtgtgtgcgggacagaggagagaacaggagatagatagggctggatgatttggtttgagatgctgaggggacagatgtgccatggacaggtggctttggccgtgagcctctcggtgttggttcagtatctgtgggctccctgcaaccttgcaggatggaagatgctccaggatagagcagatacgtccggtgttatctaggaggaaataagtgggcctctggcagtggtcactgtgctactccttgtgctttttccatgtgtttggaaattttccacactaaccagtagggaagggaaacagatgcacccatcagagctctggggctggccgtccaggacacgagttacagcttataggcttgaagggactctaccaacactgggtgcagcctgggcaagggagtgggacagagaggtcagggctctgcctccagcccttgccccccagggctgagtctgcgcgtcatcttctccccactgggtgtccctgatctcccctgcctgaccccagtgtggccatgctagtgcctctgtttctgggagcctacgttgttcttggctgtcacttccagcggccaggctgggacaggtgcccatctagtggcttttctatttggagaggatgatgggtcacagcaatgaatggacttacctcccctaggagacgaggagctctgagaagagcagagatggcgtggtcacctgtgcatatgtgctgggggccaactgggtgccagacccctggctgccatcatggtggcagacaggcagggactgtgccttcatgaattagccattctagaggagacaaagttaccaaaggacacggacccggagtcaaatccacacaaatagagcgcctgtggaccagggctgccttcagaacaaggtgagacagccgtcctgccaggacaaggcgcctacgggggcaagggcatgtgcccatctggagccgccacctccatgctctagaccagctccgtctaatagaaccttctgtgatggtgggtctgttctatacatctgcactccgccatcctgtatggtagccgcttagccgcctgggtctattgcacactcaaagtataaatgtttacgtttactttattcactcatttacttgcatagaattatttatttattttaaatggatttccacttatatctacgtgtggctagtggctatgaaactgaacagttccagaccacactggcacctgagacctcagaattctagacccaaagcctgcttctgatcctgagcttgcttctgtggggacagcacagacgcctcctaagtctgccttccagaggtggatgcagtgcccgtggactgtgcaccaccaggcctggacagtggagagggtggctttttacagggagtgggagtggaggggatgccgtgtccacattgagtgcatgtgaggccccttgcagtacaggatgggactgtatgtgggaagaggggggtgatgctctggctggaggcccctgggcagctgcatgattcagcgctgtggttaagaggggctccgcccatcgcagtcatgttgggcactaaccactggacagcccagccgctgctgtgtttctggggagcttttctccggctccgcatctgatctgcctctccatctccttccctctcattggccagcttctggtggaatgggtggggagggtcccccagttcttgtgggggttgcatcttgggaacctggcaccctgggctgcatggacacagcctcccccggcggttgcttccctctgctcagactggctggttctgtgctgtcagcacttggcagccacgatcacagctcagcttggaagcctaaggcataatttgctgaatcccaaagctgcaagctggtgatctgggtttgcgtgggactgcctgctgacacacggggtcctccctctgtgggcctctgtgggctctggcccgagacaccctttcctcatcttcttggcttctttctttctccctgcctcccttttgctaagaccctggtccaggcaggagttcattcctagacgccccagcatctccggcctccccatttgacactccccagacgactgtctgccatcccatcctcccagcccagcttctctgtagatccacatctggccaatctcctatgtctgggactcttgccctccccagaaggacgaaggctcttctcgaggttgtgtttgggactgggccagggatgacatttctggcaaaagcttaaatgacaccatgatcaacgctttggtcagctcacacactttctttccttttaaaaaaaaaatggaattcttagagctacaaaacaaaaatgtaaagaataaggtaataaaacacctgtgtactcaccatcccgcttaagaagtgagacattgcaggtgtagccgcagccctgggtgaccttctccatcctagccccactcctgctgcggtgcccgcccctctggattgggatctggccccgggcaggcacatctgtgctgggcagtggtgtgtctgagaagcctaggtctccttttttttttttttgagatagagtctcgctctatcgcccaggctggagtgcagtggcaccatctcggctcactgcaacctctgcctcctgggttcaagcgattcttctgcctcagcctcctcagtagccaggattacaggcacccgccaccatgtctggctaattttttttgtatttttagtagacacagggtttcaccatgttggtcaggctggtctcatacccctgacctcaggtgatccacctgccttggcctcccaaagtgctgggattataggtgtgagccaccgcatccggcctggtctcctcttgcatacggtcatcagcatcgtgtgactgagcagcctaggtctgtctcctcttgaatgccgtcatcagcatcacatccttggtgcctcactggagtcagtggctgccctgcctgtgcccacaacgtgacggcgtggagacttatccgtgtagatccacgaagccttggttcacttattttggcagctagcgagtgttcctctgtgtggggaggcagagtttgcccgtcccgtggcccactggtgacatcgccgaaggtcttctctgttactagtgctgccgggaacgtgtgtttccccaggtggatttggctgggctgtggagatgcgcttctcagcccttctagatgttaccaccacgccctcccgagtggccttctggtaggctctcccatgttcgctcattttctgtgcctcaggcagccgcctctctgactgagcgtccagcggacttttgccctgtttcccacggtgcacggagcatttcatctcagtggtgcctgagcttccctccctctggccctcagaccccggctgggatccttggagccaactcctctgcctgacatcccgtgtcgctaggtcctgctcttccatcttccaatacctctggggtgtgtggccttttccccagtgcccccatcatcccttctgtcctaggttgaaccgtgtcccccacaaactcatgtccaccaaaaacctcagaatgtgacctgggagttggagatggggtctttgcagatgtaagtagttaaggatcttgagatgaggtcattctggattagggtgggccctaaatccaacaactggtgtccttaaaagaagcagagaggccacagacacaccggggagagccacgtgaaggcaggagcagatgatggagtgacgcagccccaggccagggagcgtctgggaagaggcaaggaaggaccccccccccaccccaccccagagcctccctagggagtgtggccttgctgacaccttgattttggacctctggcctccagcatgggagagaacccgcttccattttttcaagccccacagctgtggtccattatggcagccacaggacactgatgcacctcccacctggccgctgtggatggacgaccccgcccgcaggaagtctccctcaagcactgcaggtgtctctgccctcacaggggacgcctgcacaagtaggtgtgaaaaaagggccctgtgggggcaaggcctgggctggtgctcgctgcctcccttcatcctatgctagttcccatgcctcttccggcaggagtgcctggctccacctggtgaatcagagccaaactctcctgacaattggctgtcacttatttaactgccaccatccccaggagacagaaaatgccagaagggtggggcctgtgcagtgcctcctcgctatttccccagggcaccgtgccacgttgcctcaatgcacagagtagctgctcaaagtgtgtcggacgaacaggtgccccatgcccagccatgcagacaaaagtgtgccacgtggagggagctggtcgtggaagagaccaccagcatcttggctgcccgaggaccttgcccctgggctcttgcaggcacccctagttcattacttcctctctcacccatagctacccactcttcctctatttctctgatatcagccttgccacccacccaggtttgcaagcaggaaatctcagagttgaccttgacctctgcctccccagcacccccaggtctcaacaggctgccaagatctcatcaactcgccctctgcatactgacccttggacaggctgccccggtcacggtcatgtcttggttgggcctccatcatccctccttggaccagcaggtgccatcctccccacccctgccctgctgtggctccttcccctccacggccaacatttagaggacgattaccacttccctccctgtgtgctggggaccgggtgataggatccctccacccgatcatttccattagacctgggccgggtcttcttactcatagagcccttagtttccgcccccaaagcctcgagggtggattcgtgctgccgcccagcctggccctgataccgctttccagcctggagccccctgcttctgcgctcctggctctgagtgctcgggccccccctggatgggttgccacttgtcctctggaaagcagggcttccatgctcctggacctcctagctgactcagtgactttgggccatcttgtcacaccccttctatcagcttggccttggttatttctgtgtcctccatagcctcggaccagagccacggcgggatgctttcctggtgcgtggcaggcagtcaggaaatattgctggactgaccttgataggagatgcttgggagaattgcccaaaaaactagcttaaaatgcaaatattggccttcttttgcgttggctaaagagtagcatttctccgtttgcctcccgggtaagaaattgatggcgaatgcaatgtctctagggaggagaagaaggtgacaaaaagggtctgtataacggggcacacgctaggcatttgtgactatttaagtttaaattataacataaatgcgaaactctttgccttggtagcccttccacattgcaagcgttcactgccacatgtggctgccatattgactacggcagatacagaacattgacatcattgcggagagttctatgggggggcgctggtttagatcatcttcacgttggatccacaaattcattgtttatccagtgaacggttactgggcacctactgagcaagcaggatgaaagacacccgctctcgggggagtcttccgttggctgcagagaagcttaaactcaggggacctggggcaaactctgcaagggcccttggcctctgcacccccagacctccctcgctctgcaggggcagtcgggggccccctctaggaatggagcgccagctccagctcctgtcaggctacagcccagatggttggctgagcacgagcatgtgagagtggaattgggcccaaccgggctgcttctccccgttgtcttggtttccttccacgctgacctggaaggactcctaaagcaacaggcctgcccaggcggtttgcaccagtaaaccctgcagcggccccaagggcagagatagctggattgtatttatttaggaacagccaaagtctgaggcacaataaaaagtggagaaagattccagagaggaatgcagctggcctcagcctgggaatccgtcttgcttgggaggctgtaggcgggccaggctggggccagcctggagggtcttggctggctctgctggcaggtacagtagcagggtcagcaggagggagtccaggacggagctccttcatttttaattcagggaagcaaacttcagtggttgagtctgaggatgagcaggaaatgaatggaaaagtcttttttttttcttttttctttctaggcagggtctttctctgtcccccaggctggagtgcagtggcacaattatagctcactgcagcctcaacctgccaggctcaagggatcctcctgccttagcctcctaagtagctgggactacagttgtgcgccaccatgactggctaattcttaaaagaaatgttttcaggctaggcatggtgacccatgcctgtaatcccagtacttttggagccgaggtgggaggatcacttgagctcaggtgctccagaccagcctgggcaacatgacgagaccccgtcttgactaaaaatacaaaaagttagctgggcgtggtggtacagccctgtagttccagctacccgggaagctgaggctgcagtgagttgtgatcacgtcactgtcctccagcctgggcaaagggagtaaggccctgtttcaaaaaaaaaaattttttttttttttgaggtggagtcttgctctgttgcccaggctggagtgcagtggcatgatcttggctcactgcaatctctgcctcccaggttcaagtgattctcctgcctcagcctcccaagtagctgggattacaggcatgagccactgtgcctggactttttttttttttttttttttttgtagagatgggatttctctatgttgcccaggctggtcttgaactcttggcctcaagtgatcctcccactttggcctcccaaagtgttggaattacaggtgtgagccaccacacccagcaggaaaagtcactttttaaagcgagaggttgtgcgtcctctatagcttggcgctcatcagcatggaggatttactggaacgtgtgttaggtgaggggacatggaagatggcagcaaatccgagcccagagcatcagaaagcatgctttcagccaaagatgcgttctctccacctccgcgcagcacccttccccagtgtgtactcctggagcaaggtggggccgatcctacgaagaccctttcccgaaggcccctgctgcccacatcagtgtcacctggaccgcctgctcccttttctggatggctggaccagccccagggcctcctggcctggtgtggggagcacagtccaccctggggaatgcctggtatgtgtcccctccccactgggtaccaggggatgaagctgtgcttcgtggaaggggacagaggcgctggtgcccaggatggtgcacctggggcggctgaactggacctggctcctactgggcccctgtggagcccagattgttgtgagaaggggtggggaaaggcaggtgatccgcacctttcacttttgtttcacatgggaacaggggcttatcctgcacacatattcagtttggagtatgaatttccatgaagaggaaaatctctattaggctctgatgtcaggattgtccgtgagggccgggccgtgttctggggcaaggacaggagtggagggggcaaccagggaaggcttcctaatggaggaggcatttgatagcatcttgaaaaagaagcagttcctaggccaagccagagactgaagaatgaccacctaacttcttttttttttttttgagatggaatctcgcgctgtcgcccaggctggagtgcagtggcgtgatctaggctcactgcaacctccacctcccaggttcaagcaattctcctgcctcagccttctgaatagctgggattacaggcatgcgccaccatgcccagctaatttttgtatttttagtagagacggggtttcaccatgttggtcaggctggtctggaacccctgaccttgtgatccacctgcctcggcctcccaaagtgctgggattacaggcatgagccactgcacccggccacgaccacctaacttctttctacaagatgccccctggctgacgcaaagcaggttgagtgagtgtgacacttccttcctgtctgtgggttccggcctttccagagcccggccagtgctattggagacaaagtggccttcgctcttccttcccgccctgccaggcccagcctgtgccgctgagccccactttgcaattaagaggagctgtgaaccagtgatgctgatgtcgcagaaaagtggccaggggtctatggggggtgaaggacagggatgccgccctgagaactgtctggaaggggcttttgggtaacagtgcccactccagggtgtgggcaggctggggtggctgggagctgggctcataggctggcacaaccagagtttcccaaagccgtgggcctgagggccctgccttcctgggacagcaacctttggtccaatttgggaaaaggtgggttaaaccaagcccggctccctcactgtaggattactcagtgcgtttagtatgcaaatgtgcctctgaatctaagacaggaccacagaaacctcttcagtgttcctctggagggagggaccgcgggggatccaccgcaggggcctgggtctgcactggcctggtgaagtgcccccttagtgcttacaccatgcgcggtgagaggttggccctcgcctcccccaccctctgctggccttacctcaccacctctgcactcgcctcccagccggctcatgactaactcctgcctcttcagagccaatcggtgctgccaggttttccatttcaagtgatcccccgcctgggccaaaatgtttggattttcaggcacggaggggagatggacctcaggccaaaccatgctgggtaaaactgagggtcaaggctgtgctcagcaagtgctccagccctggccgtcaaacccatagtgtgcacagcgtgcaggaggtggctgggtgaatgaactcagtcatagcccggcccctcactcggggctgttcccaagttcccaccgccagccaggctgggtcagagcctcgtggggccttcctgggcttccctgccccacagcaggagttcgtatggagagtctcgagtgaggttaatgggttttcttcctcttctttttttttttttttaatttgagacagggtctcactctttttacccagccagggtgcagtagtgcaattatagctcacagcagcctcgaactcctggcttcaagcaatccttccgccgcagcctcccaaagtgctgagattacaggcacgtgccaccttgcccagctggggtttctgctttttactttttctcttgtttctaaactcaatacaaagaaagatattacatttataatcagaaaaaccaacaaggaatattatttcaaaattggaaaagggattaaagaaacaaaccaagaaacctctgcgattcctgcccatcggagtcagtggttgttagtggttggcttaacacaatgttttaggaagaaatagaataacagaaagcaactccagtgagctgagccctggctccgtctgtggcgctgcatcagtttcctgcagctgctgtaacgagtggccacaagctggctgggtcacaacaacgcccagccatcctctcacagctctgcaggccacacatccgagatcagggtcaccaggctgaaatcagggtgtccactgggcatagccctctggaggctctagggcaggggttcccagccccgtgtgtcctattaggaactggcctgcacagcaggaggtgagtgactggcaagcgagcgaagcttcatctgtatttacagtcactccccattgctcgcattactgcccaagctctgcctcctgtctgatcagccatggcattggattcttataggagagtgaaccgtattgtgaacggcacatgtgagggatctaggttgcgtgcttcttatgagaatctgatgcctgatgatctgtcaccgtctcccatcaccaccagatgggaccgtctggttgcaggaaaataagctcagggctccaactgattctacattatggtgagttgtataattatctcattatatattataataataatagaaataaagtgcacaatcaatacaacgtgcttgtggccgggtgcagtggctcacacctgtaatcccagagtgaaactctgtctcaaaaaataaaaaataaaggccaggcacagtggcttatgcctgtaatcccagcactttgggaggccaaggctggcggatcacgaggtcaggagttcaagatcagcctggccaatatggtgaaaccccgtttctactaaaaatacaaaaattagccggacacggtggcaggcgtctgtagtcccagcttcttgggaggctgaggcagaagaattgcttgaacccaggtggcggaggttgcagtgaactgagatagtgccactgtactccagcctgggtggcagagcgagactctgtctcaataaaataaaataaaataaaataataaatataatacacttgaatcatctcaaaaccatctccccactccctggtctgtggaaaaattgtcttccctgaaaccgatcccaggtgccaaaaaggttgggggccactgccttcatcgcctgcccctttgagcctctggtggctgtgggtgtcccttggcttgtggctgcatggcccttaccttcaacaccagcatctacagatctctccgggccccatctccacttggccatccctgtctgtgtcaaatctccctctgcccccgtcttgtatgagcaccgagactgcctttagggaccacctagaccatccagggtgctctcgccacagcaagatctgcaactgaatcacagatgcaaaaactcttgttccaaacaaggtcccatttgcaggtctagggattaggacatgctatccctggggccattattcagccttctctcgtgactatgatccctcccttcctccccagcctcccacctcggctgagatgctgtccccacctccctcactgtctggctgcctgtggggctgtcctccaggctctttgggaggaggtggttgcttgatgtctcccagaaggctgggaatggtcctccccaccccccaggaagatgtcctttctgccaaggagattgcatttggggtcctatcccaggcagagagcggacgggactgtggcctgaagtggcacttcagggcctttggctctgtcatctagccgagggctgtgcatgggcctcacctggtcacaggtaactcacctggctctgtggggcagggattgtaaactcagaggcctgcggggtgtgtcgaggtagaggggtgcaaatattgtaaatttgttgggggccttggggagcagcacagactgaaaagtgttttgtctgaagagcagaactgtcttataccagccctgtgcggccaggcaggaaggcttccgtggtgcggccacgcgtcctccctttctcaacagaagctgacagtctggagttttcagagagattgcctgagttctcagccttggcacaaacacacattctctttaaacaggcttgggccaacagaaccagcctccgtgtctcgggtttgaatgaacccttgaggtgaagcttaaagacagagaggatgcccctgattcccaccccagggacccacattgtaaacccccacctgctctgctgagcccttggcctcagcatggaccctgaccatgtgctggtggggaccccccaggtaagtaagcagcctctgaggaccccggatgaacagtggggaacagcactgatcccccagtggggccccgagttcccggagaggaagactcgctccctcccaggggacggctagagactcactgactcatgcgtgtgtggtaggaatcttccaggaagtccccgtcccgttcgccctctctgcctgggcggggacggcaactgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcaggtacgcagacagccccctccccatcggccgccccccactgccctggactcggggctttatttatgcctgggggaataagcatgcaaagggcgcttttgctcatttttcacagaaatatttcttttctttttgacggttccaagctcgtgggatgaactccgtctcagaagctaagctctcctgagtctggcttttatttaaactcggctctcctctctcctggctacttccctttcattttccagtgtgccattcttgcatgtcatggccactgtcaatgctgaggctgttggcgccgaaaccttgggagggtgtgggggacctgcccccctggctcgggtctggggcggcggcgcttggacctggctggtggttggtttgtccactgtgtggtttgttttttgcttccagccaaagtctgtcttcaaggctgcctcggtctcctacctaaaatagcatttctgtgccttcctggcagttgattatagagggggaagctcccggcgctcagaggagcctggcgtgtgtgtgcacgtgtgtgtgcatgtgtgtgcgtgtgtccattcacgctggcagcccccttgccgcaggcacagacccatcagggcgtgaacaggcaaatgaagagaaagggggctcccctgcctttagttcaccccagctttccaggccctccctcccaggcccagcctccttggtcccttcactcacatgcggtgccgtggctgccatctcacgtggccagcgccgtcatcggtaattagcagtgatgacagtttctgccgctcatgccgccctctgagcccagcgctgggagacatggggtggctgagccaagctccaggctttgggtattctgaagtgacctacgggccatggagcgggaggtcgctaagagtgtcaacccctacgtgccttgggccctggtctgttggttgccactatgtgtgtgttggggggtccctgagaggcctgagagagggaggcccatctcggtggctcctctctaggacgtgtggtcccctccaccactgctcccagggccacatctttttttttttttttctttgagacggagtctggctctgttgcccaggctggagtgcagtggcgcgatctcagctcactgcaagctccgcctccctagttcatgccattctcctgcctcagcctcccaagcagctgggactataggcgcccgccatatttttttgtatttttagtagagatggggtttcaccgtgtcaaccaggatggtctcgatctcctgatctcgtgatccgcccgcctcagcctcccaaagtgctgggattacaggcgtgagccacggcgcccggcctcagggccacatcttgattgtcacgttgggactggtggagcgggtgtgtgttgtgccgctgagcacacccagtcgggcacagcaggcggacctcaggagggggccaggggagacggcagaaggcttgggtggcagtgaaactgcatcttatctgtttgagctcgggggctcaggcccgctgggacgggtgggtgtggagcccagcgtcctgctctccgcccagcaggagccgcagggcagggagcgctgagagggaccttcgtcaggcttgcacagtggagccgtcctcggagtgaccaccccaccaggcagcctgggcagaccacagtgggtcccctgcctcctgggccaccagccccaggaggacgtcactccacccgcctggctggcaggggcctcggggagcctcgggttcggccttcactttatagatgatctagccgaggcccagatgggtgaccagcaggggatctgagagctgagcagagaggcgtgggtttgggggtggtgctccctggggagctggaagtgatggcaccctcccaggctcacaaaacacgggcttttcatgaactgaacaaaacactctttgaaagcagccagtgctgtgccccagagaccactctgatccctgctgcccttggctgaggacagcacagccagggatgaagcggggacctcccctcgggctgtgccttgatgaaagatgctttctacaaaatcccattcggatgtgttttcatgtaagaaaacgtacatttttagaaactcagttgtaaactggctgccttccgaatgaacacgacagtcccggagctgtttcccttaatgaggttctcgtcctgggcaaactttagcgctggtctttaattgtcactgaactcccgcacagtccctggggaagtgacttccttcctgtccctgctgggtggccttgagcaagccacttggcagctctgggccgcagttccgtcatctgcaaggtgaggggtgggagcggcacggcccctaggcagcgcccccacctcctgcgggtttctgcgcgtgtcctgagttttgtgggcgcctcttccctcactgaggggctcttcttctctgcagggcatggctcacgccgcgttgtcaggctgcaagccactgcgagagctgctctgatccccaagcatgctctggcctgaggaggagccatggggaggacgctgtgcctgtgtgacagaggcctgcccggcagatgccggcccgctgacttccagacgtggctgtgggtgcctcatgccccactgggctggcgtgtgaggcgtgtccagctcaggctgccctacagctgcccaggaagggtttgtgggagggggtggtcctaccctggtgagtccacggtggtctgccagccccagggaaggcttaggagccccaagacctgccctcttgtccctccctcggcagtgtctggctccggtctggtttgtgaacgggggcctgggtactctcccgccctccctgggggctgtggccttcccctgggaaggtgctggagggtttgtcagcagggccggcatgagtcatggagtggtgactggccgctgaggcatggaaggccactccttccagccaagggtcggagctttttttttgttctggaacggctttgtggcttttacaaattaagcagttttatcttgttccaagagcttgtatttcagcagggagagagtctccaagaagggaactttccactggggagctctgttgggctgggaggctaggaacaggccacgagggagggctgcaggcaggggaagtggccgtctgtgcatggtcatgaatgcaggcccggggtcctggagggggcttggccacgctgtcgctggacgtctgtccccaccagggtccatctgatgcagtacggcacagggtaaagcccagctcctcttacggggttcctgggtcatcagtgggcggggaaccgaggcctcctggagggcggtgcctcagccctcacccctccctcctgtccctcgctgtgctgtccccgatggcctctgccatcccctgggagttcttacccctggacgctcggtgcctgtccggtctcaacctctccagctctgcttttccatctccgaggtgagaggcctggcctgacgcgctctgcacccgcttcctgcccagccccgtgggaactctggtccctgtagtggtttcctggggctgccatcaccaagtgccacaaactgggtggctcaaaacaccagacatttcttctctcgccgttctggaggccagaagtccgaaatcacggcatcagcaggcctggttctttccggaggctccgagggggagcctgcttctcgcctctggcagcttctggcggctcccgaaacccttggcgttccttggctcgtggccacaccactcgacctctgcctccgttgtcacggggcctccttctgtgccctaaatctccccctgtctgtctctcatacggacagtctttctcggatttagggcccactgggtaacccaaaatggtcccatctcaagatccttaacttcataacgtctgcaaagaccctttttccaaataggccatgttcataggctctggggtggatgtaaattttaggggccacctttcatccccctgttgtccccgtgtgtctggatgcacagcatggttccatgtcccagactccttgctggacccctctggccctttggggtggcctttggccttttccactcgtttctgtgctcctggtgaggtgtcggggtcgggcttagcccctgcaggaattctggggacagcatggagccggcaactccccaccaggcgtcttcctacctgcccagagctcatggttgtgaggggtctctccttgtggttttgatttgcaattccccagtggttagtgatgttgagcatcttttcgtgtttattgctcatttgcacatattcttgcagaaatgtctgtccaagtcctttacctgtgtttgatttggatgattgttgttgctgagtgttaggagatctgtagattaatatccagatactaatcccatatctgacctatgatttgctgccattccatggattgccttctccccacgttgttagtgccctttgatatgcaatttttttttttttttttgagatggagtctgactctgttgcccaggctggagtgcagtggcatgatcttggctcactgcaacctccgcctccctggttccagcgattttcctgcctcagcctcctgagtagttgggattacaggcacccgccaccacacccagctaatttttgtatttttagtagagacggggtttcactgtgttgactaagttggtctcgaactcctgacctcaagtaatccacccgtctcggcctcccaaagtgccggagttacaggcgtgagtcaccgcacccaggctgatatgcaaatattttaaacttctatgacgttccactttatctatttgttcttctgttgcctgtgcttttggcgccatatccaagaaatcattgccaaatgcaacgtcaggaagcttttcccctgtgttttcttctaagagttttgtggttttagctcttgagtttaggtctttgatgcaagttgagttgatttttgcatgtggtgtaagggctggtccagcctcatgctctgggctcttgattcacttctcttcttttctcacgcccagctggttccgctgggtggcggggaggagtggggaagtcccgggctgggcctgcactcgatcatcccctctcaggccagccagggagtctcagctcctgcccaggacctggctggacgtgctccctaccgggaaagcctgggccgtctttctaggctgatggcagggccagcccggggcgtcctgaggcctgccctgcggacatgccccttgttctaggtggtgtggctgcccggcctgcgtgtgagaccagctgtctgtgcttcaggccatggaggctgagtgtttccagcctgtccccttgctcggctctccctctggggaagcccctgcagcccattctctgcctccgcttctgccatctgtgcctttgtctgcttcctgtttggaggtggtcatccctggggccacccctcatgatctggacacaagtctccatcctgaagccaccacccaaacccctgtgcctcaaacccctcccacccaccacatgggtttccactgtgaccaactcagcagctgatgaagcttcccttggggctctcctagcaacggggagctggctttcccggaggcctggcctctccctaagtggaagtggggcgtgagggtgtcagcctttttctgctgcctggtgctctaggttggcttgtcacccctggaagcacttgccatccttatacagcaccccacacccacctccccgcctcctaccccttcttccaaggggtcatctctgcttccctccccacccaacctcacccatgtggtccgcccagcaacctttgacccccaacatgacaaaataaacctcccttgccggtcactcattcattcattcagcattgggtgctccctgtggacttggcgctggggtcccgtggaggacaaagccagacacagtccttgccctcatgggactgcacaagtgcaagaccacatcagtaaacgtgaaacacaggaagtgacaggtgtgacaaaggggaccagtggcaggacagaacctgcggttcgtaggaccaggtcaggagggctgcctcggggggacaccttcgggctgagcgcagaaggatgaggggagtaaaccaggctcaaacccagcaggcagaggcgatcgctgcaggcaaccggcaatgtgttcaaaggccctggggcgcggggggctgaggccggcagcacggcaggaagtaagactggggttgaaagagactgactgtcatgttgtgaaatatacacttggttttcatctccatttcctggcacacaactcctaaaatccttggaatctccaaagtgatgtctttttggatgctcatgattgacagaccagctggcagcttcaggatggttcccagggaagaccaggtagaatcacaaggttcagcaccaccccgcaacctccaggtaggggagaggggctgaaggttaagcagatcatcagcggccaatgattgaatcaatcatgccttcgtaatgaggcctccgtgaacactcagaaggatggggttccgggagcttctggatggatgagcatgtggaggctcctggagggtggagcgcctggggagcacatggaagctctgcgtccctcccccataccttgccctacacatctcttcccctgtatcctttgtaatatcctttataataaactagtaaattccatgagccccaggaacatgtgtaaaagaaaaaaaaaagaataaaccatagctgctgtagcaagttaatcctaccagcactggctctcatctgccgaccttacctctggcaatgcctccctctcctgggctcctgggacccctccggccccaccacccctcctgtagtggtctcgctggctgctgccctcaggttagtttatttttacccggcctgctcccaccaggggctgaggcctccttgctcactccagcttcctggcccgtctcttgctctgggcacccccccactccgaacggccagagcttctgaagccgctcgctgtgtgcccccgcctggccccatgcatcccgcacggtgctccccagggtctcccactggcaagggcattggcatagattctggggctgccttggttcaagcccaccctgacttggagcctgagggtccctgagggggtcctgaaggccagggcaggcaaggctggcatgctctgggcagtgggggctgggtatgggaggggatcgtgggtggggagattcctcttaaccagcggcccacgtttggagactgatttgggctccaggctacgccttgaaattgggacagagagtggcgcagatctcagcccggagactccctctgcctgtggacgccctcatacctccatccgtggagccaccctcctctttttttttctaaatggggaaactctgacttgaacactgaataaacaacacaccctcgaaatcagcgaagaggcactggctctgaaactttgccatgaaagcttgaaaatgctctttggaccgatttgctggaacagacgggtgtgatggggctgcggggtttcaggtggcaggaggcgtccccgtgcctagggcatcccgatgctcagagtttccccgtgcccagtgtgtccctgtatccagggcatccccatgcccagggtgtccccgtgcctagtgtgtccctgtatccagggcatccccatgcccagggtttccccgtgcccagggtgtccctgtatccagagcatccccatgcccagggtgtccccgtacccagggtgtccccgttcccagggcgtcctgtgcccagggtgtccccgtgcccagtgtgtccctgtatccagggcgtccccatgcccagggtgtccccatgcccaggcactgcctctccccactttcctaatctccctccaccaacaggtgtcagctgtgaaatgcctgctgtgtgtgtcctttggttgagttcatcttgtgctcttaagttcctgttagacacaggcaggctgctttagttcttctggcaaatgttttgttgttgttgtttgatacggggtctcactccgtcacccaggctggagtgcagtggcgccatctcgcctcactgcaacctccgcctcccaggttcaagcgattctcctgcctcagcctcccaaatagctgggatgacaggcgtccgccaccatgcctggttaatttttgtatttttagtagagatggggtttcaccatgttggtcaggctggtcccgatctcctgacctcaagtgatccacccagcttggcctcccaaagtgctgggattacaggcatgagccaccgtgcctggcccgtctggtgaatgtttattgaggcctactatgtgcagcccctctcttaggtgcttggcctgtaatgaggagcaacaaagacacagtcgctggtcgcttgttacttaacagttggaactgagaggcagtccacaaatgagcaaatccataggtggttttagatgaggactgtgaagaagctaagaacaggttgctgggggtgcatatctgtgtgtgtggcgaggggattaatggaagccctttctgagtggtgacactgagctgaagctgtaatgaccagaaggacccagccaggccaaaatccaagggaagagcaacctggcaaaggaaacagcaggtgtgaaggcccgaggctggagcctggggaaggtgggagtggctggagtgtgttttcagagacgggccatggtgacaccaatgcgacaggcagggccaggtcgtgccgggccttggaggccctggtgagggcttgattttattctcactatggtgggacctcagtgccctgtggctgctgagaatggccaggggcaggcagggaggcctgctagggaggaggctgctgcaggccctgcagctggagagggaggatcaggatctctttagagaggaagttggagagggaggatctctttgattgctggatggacccacctgcctggctgcccccgtcagcatccagcagaggccactggatgctgacaggtggccggccctgcccagccttgcactgccctgtgctgccctggtggctgccggctttaggaggagcgcttttggtgtctgagcccagtggtcctggctgtggtttggtacacttggccgtgggtgaggccaaggtggtttggatcctgggaaggttgggtacctggcagcctcaaggcaggagctggggtgttggaggaggaagcacgctcatccctcgttccttcctgtttcgtgggatgctgagtctctgggcagggacatggtgagccctggtgtgatgcacttaacacctgctggtgcccccatccccaagcaggaaccctggtgcctggtgcctgaggactgctgtccaccgtcccaccatccttcaggtttcttcccagcctctgactcggggcaaggttcagatatccagaacattcttggctggctcttggagctggggtgaggcagaacctccctcccatatttacagcaccagccaaggcttcggggtttggacaccatccctgggaggggtgagcaggacaagtgaggtctccagacttggggtggcttcggactggccaggcaggtgggtgggggctgcagtccatgcccccgctccaggcaacacagtcgagctgcagcccccgctccatccccagctggggctccctgtgctcaccttctgcttccttcctctccctcggaatggggggtggacactccaagactagcctcccagccactctccctgcctcctgcctcctctccttcgggacagacccctgtgatcgctgggtgttcctgatgctctgtcccctctgcgtcctgtgccgtgggtgagagagggcttcggggggacttccccctcttggagcacctgctgctccgggtgcctctgggggcgggcccccacctcacattgtggagctggtgtaggaaggaaggtgccgggagccagctccaattcacgtgctggctgtggccctcaaggtgtggatggcaggaggtggtgagacagggactcattgatcatgggactgacaccccctcatgttgatgtgggccctgagccataatctcaccagctcctgagttttggcgctgctcttggcgatggcgtggactcagccaggctctcgggcagcctttcctggattcttcctccgttctcccctgggcagtgtttctgttcacctggaaaggatgggtaggacttggagacaacagggattcaaagaagtcgggagtgggggcacctgtgcagctcaccctgcagaacagacaatttggttaaagcctaaagcctgctgtcaggagcctcgcttgcctctcagagagcacatggcttgaccatcacggggactgggggagaggcacaggcatgcctgtccggcagcagaagggaaccccgggcctgggcctctccattctgtggcgttgtctttcctcagagttgcactgtctccttcactgtccctgcctggccccagtgctcatgtggcttgtggccctcagtctgggcttggtctcccgcaattcaccctgcccagccccacacagcttgtccctccagctgggaatcggagctcacctggagtcccaggcagcagattcgatgcagtgatgcagggctgtcagccatgccagcaggccctgctgctcacagagggatgggtattgctgttgacaataattaaagaactacggcttcaggctgggtacagtggctcacacctgcaatcccagaactttgggaggccgaggcaggagaatcaattgaatccaggagttccagaccaggctgggcaacatagcaaggctttgtctttacaaaaaataaaaaataataataataataaaaactacagcttcagaatgattgacttcagcatgtttataaagtcaagggtcttcagtgtcctgggcctatgtcactgcgtcagagggagagaggaagaggctggggtgatgggcactggggcttatgctcctcctggaatgggtggtcttggactgtgcctgtgtgatatgtttgtcgagcgggggcggtgtccactgaggactggatgttgaggtgtgggtggggggaggttatgaagcactgggcatttcccgtgcaccagtgccccgagattgcagagaggggacccgcccagcctgggcagggaggcgggtggcagcgaggaaggggagaggaactcgggtgcagaaagcctttcctccagcaggtggcgccgcaagctctcgagagtccagctcctgcggggtttgcattttcactgaatttgtgggcagaggctgcctgggtgtagtttccgccaactgtgactgctcactgcgggcgaggggaagtggagtgcagagaatgcaccggagggcagatgaccagcccccgcacaggcacgggggtgcctccttccccgcacaggcacggggggcccgagcccttggggttcctgtcctaactgggcggggaaagggagggttggaagctgagttagggggaaagggggtggtctcctgccatctcttttattttatttttcctatttttggttgataggtttcaatcttttttacatttttccaactttttgccgtaaaacttttcaaacatagaaaagatgaaagagggctgagtgtggtggctcatgactgtaatcccagcactttgggaggttgaggtaggaggatcacttgagcccaggagttcaagaccagcccgggcaatatagtgagatcccatctctataaaggatacaaaaaattagtcaggcatggtggtgcaggcttggagtcccagctactcggaaggttgaggtgagaggattgcttgaacctgggaggttgaggctgcagtgagctgggattgtgccaatgcactccagcctgggcgacagaacaaaaccctgtctcaaaaacaaaacaaaacaaaaccacaaaaaagaaaccatgaaagattctaaagtaaacacccatgcacctaccacctagattccacagcaaccattttgctgtttgcttcaccacaaatccctctggccaccagcatccacgctggttttgatgcacttaaaataagctgcagaaatcagcacacaacatcctgtcaacacctcagtttgcatttcattaactagagtccggcatttgtctgtgattatttttgtttttctttgaagtaaaatgtatataccctgagatgcacaggtgtgaaacgttccgttctttgaattttaacaaaggtatccacgtgtatcccagcctgaccagaacatagaacatcactatcaccccagtaagttcctcatgcccctccaggtgcatcacagtccccaccttccccagggcaaccacaattgtgctttttttccaccacgaaataattttgccagtttgagtgtttcttagagctacccatgttgctgcaggtgccagcgatttgttctgttttattgctgagtaacgtccactgtgtgaacattctgtgggtttttagtcattctcttgttgaaagacccctggctgtttccatctggaggctcttatgagtaaacctgttacgctggttcttcttgtacaagtttttctgtgcatatgggcgttcatttattctgtagaaacacctagagtaggtatagggtaggtatacatttagttttataagaaactgccagatcttttcccaaagtggcccttccatttcacactcccaccagcaatggatacgagttctagttgctccacatcctggccaacatttggtgctgtcactctgtgaaatcttagtcattctggtgggcgtgtagtggtatcatctcattatggctttaatttgctttggcctgatgactaatgcggttgagcacattttcatgattggctcttcatatatttttcctttgtgaaatgtcttttcaaatctgttgctcattttaaaattgggttgcttgactttttcttctggatactgatcttttgtcagatacgtgttttacaaatattttattccagtctgtggcttgcctgttcattttctttcctttttcaagaacaaggtctcgctgtattgcccaagcaggtctgaaactcctgggctcaagctgtcctcctgcctctgcctccccaagagccggttttacaggcatgagccaccatgcccggcctgttcattttcttagtggtattttccaataagcaaaagtgtgtcactttaatttttatgaagtctaatttaacaaactcctttctttgtggttctctctctgtgttctttgtaagaaacctttgcctaccctgccaaattgcaaagatatttatgttttcctttagaaggcttagagttatatagcttttatgaattaacttttgcatatggtgtgaggtagagggtcagggttcattttgttgtcgttttatgtgtttattcagttgttccaaacttcatttttttttaaagcttttattttgtattttcttggtgacttatgaggtcgcacaattttccaagatccttgttggtcatttacgtattttcctttgtaaaattatctgtccacgtcttacttctttttaaaattatgttgtttcaagatcgagtgatttctgaagccttcattttataatgcttgaaagaatgaacaccttgttccccagctacaggcttctgctctttgtcctgcagctgcacagtggggtaagacttgggttttgttttgttgctgctttgttgtttcttcatttgactgtttccccatgggtctcatttaaaaaaaaaattggccgggcacagtggctcacgcctgtaatcccagcactttgggaggccgaggcgggcagatcacgaggtcaggagatcaagaccatcctggctaacacggtgaaaccccatctctactaaaaatacaaaaaattagccgggcgtggtggcgggcgcctgtagtcccagataatcgggaggccgaggcaggaaaatggtgtgaacctgggaggcggagcttgcagtgagccgagattgcaccactgcactccagcctaggtgacagagcaagactctgtctcaaaaaaaaaaaaaaaaaaaaatgttgtttcatatgttttttatatattctggatataagtcctttatcagatatatgtatcataagtttttttttccacattgctcctttccttttggttttcttaatgatgttatttaatgagcaagagtattttgttttcataaagtccaatttatcaactttttccagtttcgatttatgatttttgtgacctatggaggaaatctttgcctacactaaggtcaaaagaagttctcttattttctagaaattttatagttgtatattctatgattccttttattttttaattttttaaatttttacattttttaacctattatagccgtcaggatgttgtatgatccattttaaatcagtttttgtatttggtttgaggtcagggttaattcttgtttttctatactcatatccagttctagcaccgtttgttgaaaagacataccttactctattgaattacctgacacctttgctaaaaatcattgactgtatatgtggccctatattagtatatgtacgtatatacatgtaggccctgtgttgactgtatgtgtggtcctatattagtatatgtacgtatatacatattggccctatgttgactgtatatgtggtcctgtattagtatatacatatcagccctatattgactgtatatgtggtcctgtattagtatatgtacatatatacatgtaggccctatgttgactgtatatgtggtcctatattagtatatgtacatttatacatgtaggccctgtgttgactgtatatgtggtcctgtattagtatatgtacatatatacatataggccccgtgttgactgtatatgtggtcctgtattagtatatgtacatatatacatgtaggccccatgttgactgtatatgtggtcctgtattagtatatgtacatatatacatataggccccgtgttgactgtatatgtggtcctgtattagtatatgtacatatatacatgtaggccccatgttgactgtatatgtggtcttgtattagtatatgtacatatatacatgtaggccctatgttgactgtatatgtagtcctatattagtatatgtacatatatacatgtaggccctatgttgactgtatatgtagtcctatattagtatatgtacatatatacatgtaggccccatgttgactgtatatgtggtcctgtattagtatatgtacatatatacatgtaggccctatgttgactgtatatgtggtcctgtattagtatatgtacatatatacatgtaggccctatgttgactgtatatgtggtcctgtattagtatatgtacatatatacatgtaggccctatgttgactgtatatgtggtcctgtattagtatatgtacatatatacatgtaggccctatgttgactgtatatatatatgtggtcctgtattagtatatgtacatatatacatgtaggccccgtgttgactgtatatgtggtcctgtattagtatatgtacatatatacatgtaggtcctatgttgactgtatatgtggtcctatattagtatatgtactgtatacatgtaggtcctatgttgactgtatatgtggtcctatattagtatatgtactgtatacatgtaggccctgtgttgagacactattgtgttttcttgatattttgtccattcctttgctgatgccacatcttgattaatgtggctttacagtaagtcttaatataaagtctctcaaatatctaaaatattactttgaatattctaggtcctttgagtttccttataaatttaagaagtagcttgttgatgtctacaaaaatgcagtgtgaattttggttgagattgtgttgaatctgtagatcaattaaggaagaattggcattttaacaatattgagtcttttgtatagatggtatatctccgttttaaaggtccttttgtatttcttttatttctctactgaaaaaaaatctctacagaattacattgttttgtagttttcaagaaaaagatcttgcatgccatttgttaaatttattcctaagaattttacttttggcactattttaagctgaaatagattttaaatttcatttttaattatttgctgctagtatgtaaaaatacaatagatttttgtatgtaaatcttatatcctatgatcttttccaaagtcatttattactctggtaatggttttgtaggtcttttaggatttaaatacatagttttacttctttctgatcttgatgccttgtttttttttcttgctttattgcactggttagagctgccagttcagtattgaatagtagtgattagtggacatccttgcctgtgccaaacttataatgttaactttagatttgtcatatatgacctttgtcagattgaggaaattcccttctattcttaatttgctgaaattttttaacatgaatgggtatgattttagtaaatgctttttctgcatctatggaaatgatcattgttttgtcttttattcgtttaataggataaattacaatgattgatttttgccccccgttttttttttttttttttttaaagaaacagagtctcactcttgcccaggctgtagcacagtggtgccatcgtagctcactgcagcctgaactcctggacttaagcaatcctcccacctcagcctcctaagtagcagggactataggcacatgccaccatgccaagctaatttttaatttttaaaattttttgtacagatggggtctcattgtgttgctcaggctggtctgcaattcttgagcttaagcaatactcccacctctgcctcccaaagtgctgagattacaggtgtgagccactgtgcaggcctgattttttaatattgaaccaaccttgcatttctggaagaagtccaacttgcttatgagatatcatcctttttatatattgctaaatttgatttgcccagtttttaaggatttttgcgtgttgattcatgagggatattggtgtggtattttctttgtttgttagtttgtttcggtaatgtctttgtcagcctcattttggcttcataaaattagtttggaagtgttcccttctctttgttttctgtgttttcataaggttgatgttgtttcttccttaaatgtttgatagaatccaccaagaaaaccgtctggacctagaattttctactaggaaaggtgattgtttgtttttaatcacaaattcaatttaatgtatagaaagagttattcaggtttttttacttccccttgtcttacttttggtaagttgtactttgaaggaatttgtccctttcaggtaagttgttgaatttactcatttaaagttgttcgtaatacaagcatacctagggtttgcttccagacctcggcaataaagcaaatattgcaataaagcacgtcacacaaactttttggtttcccagtacatataaaagttatgtttaggccaggcatggtggctcatgcctgtaatcctagccctttgggaggccaaggtgggcggatcatttgaggttaggagtttgagaacagcctggccaacatggtgaaacctcatctctattagaaatacaaaaattagctgggtgtggtggcacatgcctgtagtcccagctgcttgggaggctgaggtgggagaattgctcgaacctgggaggtggaggttgcggtgagctgagatcacaccactgtactccagactgggtgacagggcgagactccatctcaaaaaaaaaagaaaaaagttatgtttacactatactatagtctattaaagtgtataagatcattatgtctttttgctaaaaaatgctaataatcatctgagccttcagcaagccataatctttttcttggtagaaggtctgcctcaatgttgatggctgctgaccaggtggtggttgctgaaagttgaaggtagctgtggcagcagtttctttgtttcttttttctttttctttttttttgagacagagtcttgctctattgcccaggctggagtgcagtggcacgatttcagctcactgcaacctctgcctcccgggttcaagcaattctcctgcctcagcctcccgagtagctgggactacaggtgcctgccaccacgcctggctaatttttgtatttttagtagagacagggtttcaccttgttggccaggctggtctcaaactcctgacctcaggtgatccacctgccttggcctcccaaagtgctgggattacaggcgtgagccactgcacctggccggcagtttcttaactgaagtttttgacatgggttgactctttctttcatgaaagatttttctgtggcacgcattatgtttgatagcatcttacccacaatagagcttccttcaaaattagagtcaattctttcaaccctggccacggattgatcaaataagttgatgtaatattctaaatcttttgttgtcatttcaacaatgttcacagcatcttcgcctggagtagatcccatctccaggaaccactttgtctgctcatccataagaagcaactcctcatctgttcaagtttgatcatgggattgcagcaatccagtcccatctccaggctccacttctaattctagttctctgctatttccaccacatctgcagtgacttcctctgctgaagtcttaaaccgctcatccatgagggttggaatcaacttcttccaaactcctgttaatgttgatatttcaacctcttcttgtgaatcacaagtgttcttaatggcatctagaatggggaatcctttccagaaggttttcaatttactttgcccagatccattagaggaatcactaactatggcagatactgctttataaaatatatttcttaaataataagacttgaaaatcaaatttatcccttctccatgggctgcagaatgggtgttacattagcaggcatgaaaacaacattcatctttacatacatctccgtcagagctcttgggtcacaaggtgcattgtcaatgagcaataatattttgaaaggattcttttttcctgagcagtaggtctcaatgatttttttttttttttgatggagtctcgctgtgtcacccagaatggaatgcggtggcatgatctcggctcattgtaacctctgcctcccgggttcaagtgattcttgtgcctcagcctcctgagtagttgggattacaggcacacaccaccatgcttggctagtttttgtattttttgtagaaacagggtttcaccatgttggccaggctggtctcgaactcctgacctcaggtgatccacctgcctcagcctctcaaagcattgggactacaggcatgagccactgcaccgggccctatttgttttttttttgttgttgttttttaattgagacagagtctcgctttgttgcctagactggagtgcagcagcgctatctcagctcaccgcagcctccgcctcccaggttcaagtgattctcctgcctcagcctcctgagtagctgggactgcaggtgtgcactaccatgcctggctaatttttgtatttttaatagagatgaggtttcaccaccatgttggccaggctggtcttgaactcctgaactcaggtgatttgcctgccttggcctcccaaaatgctgggattacagctgtgagccaccgtgcttggcccttttttgtttttttgttttttttcaaattgagacagagtctccctctgttgcccaggctggagtacagtggcacgatctcggctcactgcaacctccgcctcctgggctcaagcggttctcctgcctcagcctcccaagtagctggaattacaggcgtgtgacaccatgcctgaataatttttgtatttttagtagagatgcggtttcaccatgttggccaggctggtctcgaactcctgacctcaagtgatccccccgccccagccttcaaaagtgctgggattacaggcgtgagttgccgcaccaggcctcaatgggtttttaatattcagtaaaccatgctgtaaacagatgtgctgtcaagtagggcctgttattccatttctgaagcatagacagaatagatttggcagaattcttaagggccctaggatttttggaacggtcaatgagtattggctttaacttacggtcaacagctgcgttagcctctcatgagagtcagcctgtcctttgaagctttaaagacaggcattgacttctcccctctagctatgaaaatcctagatgacatcttcttccagtagaaggtgggacatctatgctgaaattctgttgcttagtgtagccaccttcatcagtgctctgagctagatcttctgggtaacttgctgccgcttctccatcagcacctgctgcttcaccttgcacttttacattatagagatggcttctttccttaaacttcatgacctgacctctgctagcctcaaactttccttctccagcttcctcacttctcttagccttcataccattgaagagagttagggctttgccctggattaggcttttgtttaagggaatgttgtggctgatttgatcttctatccagaccactcaaactttcttcatatcagcattaaggctgttttgctttcttcttcttcatgtgtgcactggaatcgcacttttaatttctttcaataactttttcttggcattcacaacttggctagctatttggcataagagatctcacttttgcctgtcttggctttcgacacgccttcctcactcagcttaatcatttctagcttttgatttaaagtgagagacgggtgactcttcctttcacttgaacacttagaggccattgtagggttattaattggcctaatttcaatattgttgagtctcagggaatagggatgcctgagcagagggagagagagcggggaacagccagtcagtggagcagtcagaacatacaacgtttattgaataagttcactgtcttatctggatgtggctcgtcatgccccaaaaacaactgcaataatggcattgaagatcactgatcactgggcgcggtggcccatgcctgtaatcccagcactttgggaggccgaggcaggtggatcacctgaggtcaggagtttgagaccagcctggccaacatggtgaaacctcgtctctactaaaaataccaaaattagccaggcgtggtggcgggtgcctgtagtcccagctactggggaagctggggcagaagagtcgcttgaacctgggaggtggaggttgcagtgagccgagatcacaccactgcactccactgcactccagcctgggcaacagagcgagactccatctcaaaaaaaaaaaaaaagggccgggcgcagtggctcacgcctgtaatcccagcactttgggaggccgaggcgggcagatcatgaggtcaggggattgagaccatcctggctaacacgatgaaaccccgtctctactaaagatacgaaaaaaatagccgggcgtggtggtgggtgcctgtagtcccagctactcgggaggctgaggcaggagaatggcgtgaacccgggaggcggagcttgcagtgagccgagatcgcgccgctgcactccagacagagcaagactctgtctcaaaaaaaaaaaaacaaagaaagaaaaaagaaaaaagagatcacagatcaccatagcagatataataataatgaaaaagtttgaactatttcaagaatcatcaaactcctacacagagacacagtgttaacatgttgttggaaaaatggtgccagcagacttacttgatgcagggctgccacgaaccttcaatttgtaaaaagtgcagtatctgtgaagcacaatgaaatgaggtgtgcctgtgttccttgtcactgtaatgtcggtaggatccgtaaggaaaacacttcattccttttattgtgactttatgttcgccatctccctctcatcagcagcctggctaggaggttatcaatctagatctttttaaagaaccagcattggactccccttttctggtgtccatttccttgagtttctctgttatcttcattacttccttccttgtacttgcttcagcgcattagtcagggcccagtcaggaaacaaaaaccacaccggcaatttgaatagcaacttgtaatataaagtgttcttaactgtaagaggtagttaactattaaagggatcacaaaggggtgacattgtgatataagaaagatgtatttgggctgggctcggtgcagtggctcatgtttgtaatcccagcactttgggaggctgaggcaggcggatcccttgagctcaggagtttgagaccagcctgggcaacatggtgaaacctcatgtctaccaaaaatacaaaaaattatcctggcgtggcggtgtgtgcctgcggttccagctacttgggaggttgaggtgagaggatagtttgagcccgggaaggcagacgttgtggtgagccgagattgcactactgcactccagcctggatgacagagggagactctgtctcaaaaatcaatgtatctgtctgtctgtctgtctatctatctatctatctatctatctatctatctatctagtctctgtcccccaactttgtttggcatgtagctcctaaaactcttgaaatctccaaagtgatgggtgtctttttgtttgctaaggaggcgactggtggctggaggctcctggacagcctggggataagggctggttgccaggggacccagccttgtgattagaaggctagaacttgcagcctttcccatccacctcctgcgaggcaagaggggatgaaggttgagttgatcatcaatggccaaagatttcatgtcatgcttatgtagtgaagcctccctgaaaacccaaaaggatgaggtttgtagagtttcaggttgttgaatacctgcaggtgctgggagggcagtgtaccctcccgtggaagctccatgccgcttccttcatacctttcttatgcatctcttccagttggctgttcatttgtatcctttgaaatatcatttgtaataagtcagcaattttaagtaaactgatttcctgggttctgtgagtcactcaagcaaattattgaacctgagaagggagttgtgaagacctcaaatttgtagccaagtcagacagaagttatgggtaacctggtgtcttaccacttgcgactgatctctgaagttgagggcagtcttgtgagatggaacccttaacctatgggatctgcactaactctggttggtgtcagaattgaactgaattgcaggacacccagttggggactgctgagtattggagaattgcttgggggtcggcgggaggaaaccacacatctggtgtcagagctgaagcactgagtgttgtgaatgagagtggagagatagagtttgttttgccttatgcaagaggactctaaggagtatagaaagagcaaatatgagaagcagctactttagaagaaaacataggaggaaagcttcgtgacattggagttggcaatgctttcttggatgtgacaccgaaaatacaacaaaagaaataaatgataaattggacttcaccaaaacttaaaacttttgtgcatcaaggaatactaccaatggcgtgaaaaggaaatccacagaatggaagaaagtatttgaaaatcgtatatccgataaaggactagtatccagaatatataaagaactcctacaactaagccacaaaacaaaaaaaaacaacccagtgaacagacatttttccacagaagacataccaatggccaagaagcacaggaagagatgcgcagtgtcactaatcatcagggaaatgaaaatcaaagccacaataaaatatgatttcacaccctttaaggtggctgttagccaaaacatggataacagcaagtgttggcaaggatatggagaaattggagccccgtgcactgctggtgggaatgtaaaatggtgcagctgctgtggaaaagatataacaattgctcaaaaaattaaactcagaatgaccataacatccagtgattccacttctagatgtatactccaaagaactgacagcagggacttgaacaggtgtgctacattcttgtttgtagcagcacttttcccataaccaaaagatgcaggcaacccaggtgtccaccagcggatgaatgaacagacaaaatgtggtccatctgtacagtggaatattattctgccttaaaaaggaaggagaggccaggtgtggtggctcacgcctgtaatcccagcgctttggaaggccgaggtgggcagatcacttgaggtcaggagtttgagactagcctggccagcatggcgaaaccctgtctctgctaaaaatacaaaaattagccaggcatgggggcatgtgcctgtaatcccagctactagggaggctgaggcaggagaatcgcttgaactagggaggtggaggttgcagtgagccgagaccatgccactgcactccagcttgggcgacagagcaagactgcctcaaaaaaaaaaaaaaaaaaaaaaaaaaaggagattctgacacatgctatagcatagatgagccttgaagacatgctaagtgacagaagccagacatgaaaagacaaatactgtatgatttcacttttatgaggtccctagagtagtcaaattcagagagacagaaagtgggatggaggttgccagaggctgggggaagggagaatgaatgggaagttggtgtttaatggggatagaattgcagtttgggaagatgagatggatggtggtgatggttacacaacagtgtgaatgtgcttcatgccaccaaactgcacacctgaaaatggttaaaatggtaaattttctgtgatggatactttaaggcatgtatgcaaacacacagaagcagttactaccactggggttgatggaaaagaaaccaagaactcggagcgtcctccacaccttgccacgtcttacgttcaggccttgttggagagtgtgtgactgccacagaaacctgcagcctactggtaacaaaaaggttcttgccagaaggtgtagaaagagtggatctgcaggatcagcttactgggtagccgagaaacctactagagggtatgggtgggcaggagctgggtgtctgagaagtttgctgaggtcccattgggctagagctggggtgctggagaaactcagtacagagcaggccccactgggcacacgccactggcagctgtgccttcagaggaaaaagagaccctggaaccaggaagagaagctgctacctcagcaaggcctggcagctccccacagtgttgtcccctgtggatagagcctgacatgactgtatttggccaaggagaaagactcataaggcctcggtccagtatcacggagcggggcctggcaggatgtatgcagagttaagaggcaatacatgggtaactggcatatttttccagattctttgttttttttgttgttttgttttgttttgttttgttttgttttgttttgagagagcatcctgctctgttgcccaggctggagtgcagtggcatgatctaggctcactgcaacctccacctcccgggttcaagccattctcctgcctcagccttctaagtagctggagatgcccaccatgcccagctaatttttgtatttttagtagagacagggtttcaccatgttggccaggctggtcttgaactcctgatctcaggtgatccacctgccttggcctcccaaagtgctgggattacaggcgtgagctacactgcacctggcccatttttccagattcttaaagcagatccttaggtctttttttttttttttttttttttttttttacttcttttctaatataagcacttacagtttccctctaagcactagcttcagcctacgtattttagtatgctgtgttttcattatcatttcatttgaaatattgtaaaatttttcttgtgatttcctctttgactcatgggttatttagaagtatgttgtttaatttgcaaatagtcaaggctcctctgagtatcttagagctattgatttctaatttaatcttactttggccagacaagcatattttgcatgcttttaaaatttgagacttatggcccagaatgtgtatcttggtgaatgcactgttttcacttgagaaaaaaatatgtatatatattctagacttcctgagtatagagctttataactgctgattaggtcaattgctagttaccagtgttcttcagattatctgatgcttgtttctcagatgttgagagaatggtgtttgctatggcctacctgtttgtgtcccccaaaattcatatgttggagcttaatctctggtgcagtggtgttgggaattggggcatcagggaagtattggctcatgagggcagagtcatcgtgaatgggattagtcccttctgccatgtggggacacagcaggaaaaggacatctctgaagcagggagctagctctcaccagacactgagcaccctgattttggacttcccagcctctagaactgtgagcactacaatctgtttataaattacccagcctaaggcattttgttttaacatcctgaatgaactgaggtggtgttaaaatctccaactatgcatccaggcgcagtggctcacacctgtaatcccagcacttcaggaggccaaggcgggtggatcacctgaggtcaggagtttgagaccagcctggacaacatggtgaaaccttgtctctactaaaaatacaaaaattagctgggcgtggtggcaggctcctgtaatcccagctactcgggaggctgaggcaggagaatcgcttgaacccaggaggtggaggttgcagtgagccgagattgcaccattgtactccagcctgggcaacaagagtgaaactccgtctcaaaaaaaaaaaaaaagagtctccacctatgattgtggaattgcccatttctccctttaattctttcaggttttatatcatgtattttgaagctcctttggttaggtgcatacacatttatgattataatggtgtctcgatgaactgatcatttaaccatgatgaatgtattcctttatctcgtaataattttatcttggactcaactttattgatatttatgtagcctctccagccttcttaaacatgctgtttgggatgcataagaaggctggagaggcttatggagaaacttatgatggtttgacttacagtttttcaactttaccatggtgcgaacgtggtatgtatacagtagaaactgtactttaagtatgtgtgaaaccattgtgtttctcactttcagtacagtattcaataacttacatgagatagtcaacactttattataaaataggctttgtgtttgttgattttgctcaactgtaggctgaagtaagtgttctaatcatgttaaggtaggctaggctaagctagaatgttcggtaagttagatgtattaagtgcatttttgagatgatatttattttccacttatgatgggtttgtcaagacataactccatcatcattcaagcagcatcagtatgtctttttccaaacagaaaatttcaacctgtgtttatactgaaacagcatcttttgtagatagtatatagttgagtcttgctattttattcattctgacagcctccgccttttaattggaatattcaggctatttctgtttaacatagttatagatatgactgggtttagagctactaccttgctctttgatatttatttctttcatcttgctttcttggcttcttttatgttaattaagtattttttagaattctattttaatttatgttttttttttttttttttttttaagacagagtctcactctgttgcccaggctggagtgcaatagcatgatcttggctcactgcaacctctgcctcctgggttcaagtgattctcctgcctcagcttccctagtatactgggattacagacgcctgccaccacggccggctaatttttgtatttttagtaaagacggggtttcaccatgctggccaggctggcctcgaactcctgacctcaggcgatccgcccaccctggcctcccaaagtgctgggattacaagcgtgagccactgagcccggcctgttttgactttttaattgtatctctttgtattgctattttagtagttactttatagattctattgcacattcttagcttttcacagtctacttagaattaacattgtttttcttcatggaaaaaaagtgtaagaactaggcaatcctatgggttcatttaccactttccatcctgtatgtgatggttgttagatatttactacatccatacacattgtaaactagacaatacaataaggaaatttttgctttaaacagccccatgcattttaaagaaattaaaagtaaaacagaatcttttctatttgcccatgtatttgctatatcctgtgctcttcattccttcctgaagagctgagttcccatctggtctcatttcccatgatcttggagaacttgcttcacggtttttgtagtgcaggtttgcagacagctaattccctttcattttcacttatctgcaaatctttattttgctgtcattctttctttttttatttttatttttatttttgagacagagtctcactctgtctccccacaggctacagtgcaatggtgtgatttcaaaactcctgcccaatctcaactcaccaaccttctcctcccgggctcaaacgattctcctgcctcagcctcccaagtagctgggactacaggcatgtgccatcatacccagctaatttttgtatttttagtagagatgggatttcaccatgatggccaggctggtctcgaactcctgacctcaagtgatctgcctgctttggcctcctaaaatgctgggattataggtgtgagccactgtgcccagcctgctgtcattcttgaaccataatttcactggttatagaattctgagttgtcagttttttctttcaggactttaaaatatagggttccagtgtctttggcctccgttgtttctgtcaaggaatcagcattcatctagctattcccctgtagaccacatgttgtttttccctggatgcttttaagactttttatccaagtttgattgctcagtacctacctctgggcaaaaaagcctccagaaaccagaaacttatctagttttattcccctctgtcaggtgtagactctactccagcttctacctacttgagatattctatactgactccaggctgttgttattttgttctttcaaatattttgtccagagctataatgttttctgcagaattgaccagatagcagctactctctgtgaccaggagccttgatcttccagacttgctgatgggctcacaaagctcctgcccgtggccctcagttggcagtggcctctctgccttgaagttgccatgagtgtgtaaaacctacaggctcaaccttcctcattagtacagtccagaaaagtggaattcctggtctgggtggctatggtgccctagaccactggctagaccagggtggtgactgccagctggccgaatgtggggtctccagcctagcacccttggactctaccccaggagttatggctgtttcagggccaggggcctggcctcagcccctgtcccccttctcttctcctcaagttgcccagcatcaggtcccaaccagcatcttttgcagacagggtgggtcggctcctcactagaggggcagggttgggcgggaagcctgttgagccctccttcctgtgcagcccacagccctggggttagctccagaggggtgcagaaaggagcccccaaaggcagaaactcacccttctctctgttcttgtgcttccagggataaaggagaggtggtcctagctggggggctaccagtggcatgcaggaggcccacatgaccactgtttgctggggcctttccttctctgtgagagagacgagagagaggagagagagtgtgagtcagggtagtgtcttcttccagtaacgcagacttctgcacgtgttctctaggagaaatcccgtcactcgctagagctctagatctggaagaagctctgcctctcttctctcctccagtgcagtgtgtgtgtgtgtgtgtgtgtgtgtgtccccacatgcattacacccttctacagaggaaataattcccgtccaagtgcaaaggttgggattggagcaggcagcatgtgggctaaaggagcagagaggaggaaacgggggcgggggtgagggtgggaacaggaggtgggtagatgccacgaggcatgccttccacaactagaagggctggtggagatgaccagaatgctccagacagaccttttatcaaacttccaaaattcaatcttgtttcatgaagcctgaggaccctgcagagtgaaagacaaggaagggctttcctgcaggggggtgtgtgtgcctgtgtgtgcctgtgtgctgtgtgcccccatgtgtgtgcacgtgtggacctgtgtggtgtgtgcctgcacatgtgtgcacgtgtggacctgtgtggtgtgtgctgagtgtgtatatgtgtgtgcctgtgtgctgtgtatgcacttgcacatgtgtacacagatctcattttccttttttctggcttactaagtgccagaaagaatttccgtgagcctctccacccttcccaaggctgcacatggagggacttgcgcaggcacatgtgcgcgtgcacacaacacacacacacacacacacacacacacacacacacacacacgagtcaggggcgagcactcctgtggattgtacctaggcctggcaggaaaccgggttctgggaaactgtaggccccacctttggcagaaaaccatgtttttgttgctgctcgttgaagggaacattaagtggggctggggacagtttatgttgagaagagcaaattttgcctatggcactggggacattgagtggctcctgtcccgggctctggagggcttgggagacacgtctgcagctctgggcatctctcaaggtcacgggcggccacactcaaggttaggccctcctctgtgtgagctgcggtcagcaggaaggctgacctcagaggcggccccagggcccttggaggccctgcccctgagacatgggccaaggtcagagagccgagaaggctgctgctgaggactctggttggcgcccagcccagcggcccttcaggcgggccctgtgcaggggctgatgaagtcagctgggaaatctgtgaaataaagcacaggtcccccaggcttgcccagagccccggcatcagatgaggtgcagagaagggaactgagctgccaagtgtgaacaggagagaggagccccaggaccacacaggggccccgacatggcaggtgcttggtcagcagcggtgctgcccttactgctggacgtgggaaaatgcactgacacttgctgaccagagccggggtgagcatctgggtgaccctgcagatgagacaaaataagggctgccgtgggggaggggcccttgccgggccaccctgctgaggccctgtgttactgtcctgcggctgtcataacaaaggaccacaaatgaggtgactcaaaacatccgaaatcggccacgtgcggtggctcatgcctgtaatcccagcactttgggaggccgaggcggttggatcacgaggtcaggagatcgagaccatcctggctaacatggtgaaaccccgtctctactaaaaatacaaaaaaaaaaaaaaaattagccgggcgtggtggtgggtgcctgtagtcccagctgctcaggaggctgaggcaggagaatggcatgaaccttggaggtggaggttgcagtgagccgagatcgcgccattgcactccagcctgggtgacagagcaagactccgtctcaaaaacaaaaacaaaaacaaaaacaaaaacatccgaaatgtcttccctaaagtttctggagccagaaatcccagaccgaggtgtctgaaggttcattcctcctgggggttccgagggagactgtcccatgcctttctccgagctctgcggcggccagcaacccctggtattcctcggcttgcagctcggcctaccccccacctggccttcaccctgtgtctcttcttgtgtctctgtccaaactgccctctctgttgtctttttaatttatttttagggacaggttctcattctgtcctccaggctggagtgcagtggcgtgatcatggctcactgcagcctcagcctcccaggctcaagcaatcctcccacctcagccttccaagtagctgggacacaggcgcacgccaccatgcctggctaattttttaatttttttgtagagacgagggcccaggctggtctcaaactcctgcgctcaggcaatgagactttgcctcccaaaacactgggattagagacatgagctgctgtgcccagcctacctctgtcttataaagacacctgtcattggatttagggcccactctgattcaatatgccctcaaataacccaattacatcttcaaagaccctatgtccatataaagtcacattcataggtactggggggtcaggacttgcatatgtcttttgggggaacacaattcaacccacaatgggtctcacccacagaacgaacggcctctccagggtgtgcgcaggtgggtgaggggcccaggagagggacctgcgtggcaagagggcttgtgttcacgtcagagattccagaaggagactggatggggtggctgcatggagcaaggggctacagccactgtctccaagtagttggtgggttgtctggtagaaagggagcatttattttgagttcccccaagatatgaagctagtaccaggtacctggaaggtgctagcgagtagagcttgactctttacagaaagaggtgtttttctcacaatgttcacttgaggacggtggaacaggctatttcacaaggtagtgagttccccatgcctggaagcattcaagcaggggccatgtgggagttgttcaggagtgcatagaagggacctcagaggtccctgccaataccatctttgcttgtcttattttacgacaacttgaatttcagaatgtaatgttattggggatatgtctactagaggggcctccagcatcaggccccacacactatgcatcatttttagggcagggaatgagagcaggctccattctttttggttgtctgtgaggaccaggaggcttgctgctgaggcagcttcctgtggaaacagtgtctcagccccgcaatccattcatcggagctccaacatcttaatgaaacactgtgtcagatgggttctgggcatgtgtgtgcagattgtcacaagtccatgagaatgcacacacgcacattgcatgtgtgtgcacacatgtatgcacacatgcacaagaacacgaagacccgaggcaggtatagtccgtgagacagatccctctaggctgaaagactccccacaagggtccctagaacaaggctccagcctcggcagtccctcccacttctggtgggaggatctccacagagaagaagggtcaagaagcacagctcttgatgctcacggtgtaccaagctctgctttaagcttgtgtcttattttttacttatttagcaaatctgtcgctcttgttttgtgccagatgctgttctcagcactttacaaatattgatgcatgtttgtttcatgacaaccctgtgaagtaggtagtgttaccccgttttatagatgaggaaacaggcgtagagggataaagggacttgcccaaggtctgtctctaccttacacgcacatgaacgctcactcatgcggcaggcgctagtttccctctgatgtgagtcaggccttgagctggttggggtctgggtcccactttggttgtgttttgctgtgggcaccaaggaagcttctagcagcctcatctccctggtatgacctagctccagggactggatttccccaaatgctcctgcccagcctggagcctcctttccagctgggggagggctgaacgacccctcactcttggaggctgccggagcccctcctgcctgcatgcggccgctgccgggtggacaggcctgcttgtgggttgaggctcccagcagctggggtggatcatttctcctcccaagaagctttgggagaagcagctgagggggccagcgtcctcctgaggccaattccctgcctcccccagcgcaggcgcgaagccatctttgcttgtgtgtttgccacagacagtggagggcggtgcaatcgtgacgcctgcttgttgcactttgcgtccttgaggacgttgacccctggccggtgctgggcgcttgctcttcagtcatcttgccctgacctggcgtggcaggcccgagcactgctcttttacaaggaaacaggctcagaggccttgagtcacttgcccgggctcccccagccaataattggctgagccaggatttccatccagctctgtgactccagaagtccaagttcttcccatcacgtcagggccaggaaaggattagaatgcttttctacgtgccgattatttggatgatctgtgcagcttagctcgttgtagttgctcaataaaaatgtggaatgaatgggcctatatgtcccattgtgtgactcagagccaatgactctggctgatcctcctgttttcattccgtggcccagcatctccctttggggtgtgtgaccttggaagcagtgactctctccatcccaccttgaatggtgtctgcgccgcagcaggggagcagctggggattgccagcgcctgttgctggtgggctgtgcgccagatcccgtcttggatgtgtgggtgattgtcagccacatgtgtgtgaagggctgtgcgtgtaggatttgtgcaaatgtgcccctccctgctgccagcccatgggaggctgtcaagattctgcccctgcacattagcccacactctctttgtggcccactgctgtggctgttcccttgtgtcacgtggctgcaggcacagcccccaagtggatggggatcgtgggctgaatgtgcatcagatgctcctgcttcttggtgggtggagaccctcaacccatgcaccgtggctgccgcatctgaaaggccttccatggtgaaggacttggacctgagcaaccctccgcagaggtcttagaagtgctccctggccgggcgcggtggctcacacctgtaatcccagcactttgggaggccgaggtgggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacccaggaggcggagcttgcagtgagccgagatcgcgtcactgcactccagcctgggcgacagagcgagactccgtctcaaaaaaaaaaaaaaaatgaagtgctcccagctcttcctcctgtggtgaggttctgagtttccatcctcagaagaaaacctggctggggagggcatctctagacccggacataaacgccaggagaccagggctgccctctcaggtgaccaatcacagagactcagggaaagtcacgtttggaagaggcgacactgtgtctcagcctcattcatttctccatcctacagacactgcctggtgcccagcccgcaccgcgaggcttcctaagcagctctgggcaccgtgcacctggcatggcctccagccccatctccctgccttgggagacccggtggggactccgggctgagctcctgtggctgtggaaccttggtggtttattgtggtggctgagaacagggacgtggggttggacgggttgagtgtaactcccagtggctccgtgaactgcctgggagccttgggcagctctttctcactctgtgcctccgcttcctgatggaaaaatgggggccaggggggagcgaccttgaaggtattcgtgggaaccaagcgaggtgataaatgtagtgtccttggtagagaactggacacagagtccacccccatgaagggggctgctcctcctccttctatgtttcctcttgttcttatttctcctcttgtatcttctcttcctgctttccctccccctcccctccccccccacatgcaggcacactccatttggtgccccaactgcctttctccattgtccttctgtaagtggttctctaagtgggaactcaggcctggaaagggtgggcaccctgtctggtgggctctggcaggccaggcgctgagcagcctcaggagacacaaccctaggaaaaggctcatgcaggctggctgtcatgacggactgttggtgggagaggggaaggcgccgtggtaggggaagctttggaaacatccactagtggccttatttatgactcaggacacctgccaggtcactagaacacagctgaggaagctgtcggccagacgtccagaagcatcaacctggtggctgggctgtggggggacctctctggacaggcagacaaggtgtcggaggaaggggctgacactcactcagtgtctgtcatgcactgagggcacaaagggcaggatggagagctggcccacgccacctgtggaatcttccaggtgtgggggcagatggggaagcaagggggcttgaagacacatgcgctcattaaatgtccttaaatcccaagaagaagaacaaggacacatccacaggggcagggctgaaagtctgatgcatggtgttttggggtctgctcctgctgcaacagctacagtggctccctcttacctttctcttccctccattctgttgtgaaaatgttcaaaacacatggtcaagttgaaagcattttacagggaacacattcagccatcacctagattctaccactaacaccaagctacacctgctttatcacctcaccgtccatctatccctccttcgcctggccatgaatccattttatttttattttttggtgcatttcaaagtaatttcaggtcatcctgattatctctggaatcactgtcagaaattccctcccttcccctcccctctcctttcctttccttttctgagatgggatcttgctaggtcacctaggctgaagtgcggtggtgcagtcatagcacactgcagcctccaactcccgagctcaagcaatcctcctgcctcagcctcctgagtagctgggaccgcaggcatccaccaccacacccagcttcattttcaaaatttctcaccaactcctcactccttgtattcacccaggaccacttctcacaaagccagggtgctgcaggaggggtcagaaccccaagccctaatcctggctctgtcattaacactgtgcgaccctcagcaaatcattttgcctgtctaggtcctgttttcattcctatgaaacgagggcgttaaactgtatgttataaataatgagggctaccagttaccaagctcctattttaggccaggcacttttcacatgttattatgagtcctttcaatctaggtattgttctcaatggacagcttagtcaacggaagctcagagaggtggtgtaacttgccaaaagtcccactacccagtgaatgtccccacggggtctgcacccaggagtctgacacagagcccaggcctcagcacctggcgatgttttgggggtgtgagcagcccagcctactctgggcacgtgtttacttgctgttccttctgcctcatgtttgtgtttgtcccctctgaagctcagactgttattttccagttccaaataccaaaactggctaggcacggtggctcatgcctgtaatcccagcactttgggagaccaaggcgggtggatcacttgaagtcaggagttcaagaccagcctggccaacatggtaaaaccccatctctacaaaaaatacaaaaattagccagacatggtggcgtgcacctgtagtcccagctactcaaggagaacccagctacccagctactgaggcacgagaatcacttaaacctgggaggtggaggttgcagtgagccgagatcgcaccactcctctctaggctaggcaacaagtgtgagactctgtctcaaaaataataaataaataaaataaaataaaaattaaaaccaaatgccaaaaccaacccacaaaataaaccttggttaaagtagcctgttcattttgctttaactatgtatattgcaccagattctgccaggggctcagcgtataaagatgagacccctgccctgccagacaggtgggatgatggccataccttgagttagtcaaggcaccatctggctgtgtaacaaaagctaaaacatcagaggctgagcagcactcggacccacgtcccagtccaagtgtcagtcgttatgggggcccaggacagcccggacctagttcattcctttggtgcatcctcgacacacagcttccatctcttgagctgagatggttccagctcctgccgtcatgtctgcactccagccagagggaagggaagaagggagaggggaaagggcaagtgtccctctttatttttaagggcatgacctgaaagttaaacacttcagctccttcccactggccagaacccagttgtatggccgctcctgtcatcagggaggctgagcaatgtattcttcagctgggcttccctgtgcacaaccaaaacttcagttactatagaaaaaagggagctcagatattggggaaacaactagcatctgtaccacatgcactgatagctctctttgtatgaacagagctgtggcaggccctatgccagggagaaagtaagattggaaaagagcttaccaaggaggtggcatttgcactgtgcttaaggggcaagaaaaacgtcttccaatcaggagccacaaatgcttggctgaagtgctactgctctttcatcctggagctggaacagacgtcaccagtcaatcatgatggctgctgggtgcactggctaacatctataatcccagcactttgtgaggctgagggtgggaagattgcttggggccaggagtttgagaccagtttgggcaaattgcaagaccctgtctctgcaaaaaaatataaaatgtagctgagtgtggtggcacctgtagacccagccccagctactcgagaggctgagatgggaggatcgcttgggcctaggagttcgaggctgcagtgagctatgattgcaccactgcactccagcctgggtgacagagcaggacctgtctctaaaaacaataaaataaaatcaaagttttaaaatggaaaaaaaatcatgagcacataactccagatgtatcctcaagatagcaaacccgggtgggcgcagtggctcatgcctgtaatcctggcactttgggaggccaaggtgggtggatcacctgaggtcaggagtttgagactagcctggccaacagccccatctgtactacaaatacaaaattagctgggcatggtggtgggcacctgtgatcccagctacttggaaggctgaggcaggagaattgcttgaacccaggaggcggaggttgcagtgagccaagatcacaccattgcactccagcctggagaaaaaaagcaaaactctgtctcaaaaaaaaaaaaaaaaagcaaacccagggccaggtctgtagccacatggccaccttcttccctgagcatggaggcagcctcagaaacctgccccacatcacatcagtgggcagttgattgggtcagcctgccagttgaaccctatttgccacagtcattctccatagtaaggggcattctagacataccccccttcccagggaagaataagccgtagctgcctgagcgttttatccagtggtgtgcatgtcttttcccaactctgtgtttagtgatgtcctgtttgtagcttgaaatttgccacagtgggtgtgtttacaccacaggaattggcaaacactacatatcaggccttacctcctgctccctactagggtaggttgttttttttttgttgtttttgttttttgtttctttttttttttgagacggagtctcgctctgtcgcccaggctggcgtggagtgatgcgatctccgctcactgcaagctccgcctccctggttcacaccattctcctgcctgagcttccagaatagctgggactacaggcgcccgccaccacacccggctaattttttgtatttttagtagagacggggtttcaccgtgttagccaggatggtctcgatctcctgacctcgcaatctgccctcctcggcctcccaaaatgctggcattatgccactgcgcccggcctagggtaggttgttagaaatgtaccagcctgccagtttcagccttgtttgtctttcatcctttttttttttttttttttttttgagacggggtctctctctgttgccccccaggctggagtgcagtggtgtgatcctggctcactgcaacctctgcctcctgggatcaagtgattctcctgcctcagcctcccaagtagctgggattacaggtgcccaccaccacgtccagctaaattttgtatttttagtagagatggggtttcaccacattggccaggctggtatcgaactccttacctaaggtgatccacccgccttggcctcccaaagtgctgggattacaggcgtgagccaccgcactgggcctctttcgttctttcttaatgaaaatcttcctgaaagatttgcctactgatgtctgtgtcaataggtactgcctgcgggacagagcctgccctccttttgaaggtctttctctgtctgggtgaccatctgcatgtcactccctgctgctcagaactaaagatgtagctatgcctggggtaggttgggaaaacctgtgggaatcacagagcttgctgtcatgctgtgttctggatacctgaagcttggcaggcaggtgggatcgagggtgggcattaggaaagtgatgtggctctataggaaggggacataggtcctgagattttaggtccccaattggacaaagctgttttttttttctggataaatgttctagcttattcataatcgagtggtcagttttcttttcttttcttttctttttttttttgagatggagtctcgctctttcgcccaggctggagtgcagtggcgctatctcggctcactgcaagctccgcctcccaggttcacgccattctcccgcctcagcctccggagtagctgggactacaggcgcctgccaccgcgtccggctaattttttgtatttttagtagagacagggtttcaccgtgttagccaggatggtctcgatctcttgacctcgtgatccgcccgcctcggcctcccaaagtgctgggattacaggcgtgagccaccgcgcccggccaagtggtcagttttctcagctgccgggtcttgcacaccttgctggctctggagaccatatgcaccatgtagaccccatttgtttcctaccctcagtgttgggggaggggccaagggcctgtcgatgtgttgacacctggccattcactggccttgaatgtccacattcacctccttgaaatcgatgccccgtatcggaggctccatgtggatttgggggcagaggcctgtactccagatggtggggtggccttcaccaatcaggcagattccctgccctgccctgccctttgggctctgtagctccagatgtgtgctcaagatctgtggccacatggatgggacaagccacagagactcagactccgtggtccctgtgaccagagtagccgtggccctgtctgggaatgttcccaccctgttgctgaaggtgagaaatttctctgtgctggagaacagctgtgctgagaagttggcccatctggcttgcaggactgctggggcaagggaggtctgctgccggtctcttccttcctcctctgactgggtgctccttgtctaggttccttgcagcaaaagaattctctaatttattttgttcccttattgagtctctactccatgaagcccacctcctaatcccagctgactggctcccacctcctcaagaggaaggccaggggcagacgaggctgaaggaggctgactcccctgtgccttcgcagtctgagctgatgctgctgtatgttcacagggctccttcagcttttaaaaaggcttcaacacgttcgtcacacgcttgtggctctcctggatgccacactaactcagtaaggcctgagttagaggctgttcctgaggctgtgaaaatagaagaagggtccagaggagaatcccttcatctgacgatcccaggaaggcttcctagaagaagcagcctctgagctgagacctgaagacagatcaggcctgagtcaggccagggagggtgtgaggggcccaccaggcagagggaacaggatagggcaggcacagaggtctggcacctggcttgtggggaagtgtgagcccctgggcatgaccaaggcggggagaagtggcgtgagaggaggcagatgtggctggcaggagatcggcggccccggccttgctgagctccactctgtatgcaccaggtgacagaggctgcccaggacggtgggcagggaagtgacaggtcacatggtcatcccaccaacagccgggagtccagcttggggggacccaagaccctggggaaggcacgagtcaggggcctgctagagccaggagctagtgggagaaggaaacagtgttgcttatgaattataaacagacactcccgcaactttctctgacgtgatacaatctcaaagtgggccacccagaggtgggaaggtgacttctggctctccaggccttgggcctgtcttttttttttttttttttttttttttgagatggagtctcactctgttgcccaggctggagtgcagtggtgtaatcttggctcactaccacctctgcctcctgcgttcaagcaatcctcctgcctcagcctcctgagtagctgggattacaggcacctgccaccacacccggctaatttttgtatttttagtagagatggtgtttcaccatgttggccaggctggtctcgaattcctgacctcaggtgatccgcccaccttggcctcccaaagtgctgggattacaggcatgagccactgtgcccagccgagcccatcttcaagttctccctggccctcagtgtttctgtattagttcacccttttggctccctgcttttaagagtctcccttaagactgtccccaagtggacaggtccccagaaccaaggagcagccttaggagtccccagttacagacactccagggggtccgtgtggccctcagcctctggcctggttccggcagccttggtcctttgtgctgtctctcacatagcctggccagagctggccaggtcccttggctgggccgagtcatcgtggccagtgactcatgcagggggagaaaagtgaggagggggaacagagtgcgagggggactgtgttaataacaaacccattaggtccctgaggtcacttcacaggagggacaaatggttcatttaggttgatctggctgccggctggcttccagagacactcagggtggggaagatttcattatctggggaaagcaataccagattgtctggaggggcccagccagcgcaccccgcgcttcctgtctgcctcccacgcagagcgttctgttcccaaggcggcaggccaagagcgcgagccgaggctcaggtgcaaagaggggtgcggcatgggggcactgcagggcacggggtgcatgcatttttatttatttttttactgagtgttagggtaatttgttaatggggtatatttggtgacataaaaccttctgtcgattcatggcagtctggaacggagtggaagcgtcccactcctggggaacccccacacacatttggctgtgaacgtcggtgcctttgcactggagcctctttggagtgtgctgggcagagcggagaggttcctcttctctcttctccatcatcctgtggaggtgtcaacatgtagccagagatggtcagtggcagtgaggagaggggggcaggaagagaccagggctgggggcttgccagcccacagttctacccctgaacacccatggcctccctgttcaggtcagcgaggctgggggcagagacgggcaggggtcccccaatgttgggcatctccccgctccctcatactctggatttgccctctggagaaagctctggagcacccagaagtcctggggctgctggctgaggtggggagcagagcccagctgtgcctggaggctccccacttccactcagcttccagggacagtctcagctgtgcaggcccaggccgctgaggctggctccagaaatttcttcacaaccaccactggatggaaaaccagttctctaaagggccccagagccagttttgtttcttcttccacaggttcccatagttagagcatcgggtctttgttagagatgcagaagagacgatgtccccagcccttatgtggttcggtctccactgtggatgttggtgatcttagtctccttctcaaaaccaagagggctgatgccccacattccaggcccccagaaagagccgccacccacccacaccgctacatcttctttccacttttctgttccggaaagagtagagtggatatgcgctcctgtagaaatccatctacagcctgactgcagatgtattttgctcccttattgagtctctgctccatgaagcctgccttgtttgtacctctttctctctctttctctctttcttccctctcttccttcccttccgttcccttcctttttctttccttcctgtcttattctttcctctttctttctttcctctctctctctttccccctttctctgtctttcctatcttttctttctctctctttcctcttttttgaacagccaaagatagaatgaatggcataggtaggtactgagctccctgtaactggaggtgttcaagtgtagggtggatgggcatttatagggcaggcattgaggaaggatctccctgggattgtggatggcaggacaggccctgtggagccttctgagcgggtgcagaagagggagggcatgttcctgctccctgcccttcccgggttgccaggccgccactcccaacctccaccctctttccttccacctgctgggccttacgggatgggcagaggcattgttagaacatggagccgcggtccacagagggccagcagggaggagagctccctggggaccacgtcgcctcagtcactgtggtgactttgaaaataaatgctttcttctctgcttgagtccctgttgttcctgctgacgtggaactagggcaggctggtgactcagccctcatccctgcactgcatcggtggcaagttgcctccagcctcagaccccacagagcagggtgccttcttcagaaaaacagtagggaggccaggacaccaagggccccagggacagcctgtttctcctggctggcatgagttctagccaagcctcctggtaccctgggggtgaggaggtaccagctgtgtgctttagtcactggctgctttgaggctgggtcggtgccaggctggccactccttcttgtcccctagtgtgactttgcagagctcccggaagggtcagagggtttttttccatcactggtgtccatgggatactgtgtccccatctcatttttgtactccagtctcagacgggtgctaggaagttggagactttagccatttcacgactgtgtcttgcggggctggagtaggaacaggagtaggaggaacgctctggtcatgggactgtgtgaagagagaaggatcaggaagaaaacatgagctatcatgtctgggttatacctcagcagagccgctggtggcctcccaggcatctgaatttactaatcacaaagctcaccaggtgtgcaaataaacaaatgctgttcaggaggcacagccagggttctgctggagagggatcatcttggaggggtcatactttccacccagtccttcagtccttctgtcctgtgtgtgtgcagcccctgaccaccaccatccctgcccctgccacttgctcccagggttccatcaggttggatgttattgcaataaaatgtagcaacagaaggtccaggcagtgctgcagtccctggtggtatcatcagagccagcaggcagcagggctggggaactccaagctgattcagtcccaagtgccggagcggggagctcggatgaggtgggggtggggaaccggggagccatggagcagagcatttgctgtgctgaaggccaggagcctccttgggagatcatgaatttagaacactaatactttgtttaaaaagtcccctgccttggagataagagctcaggccgctgtggtcaggttttgctgtaaatgttctgcacaaagcaggctggggggatcactgggaagtctggggaacagattggtcatgtgcttctttgagtgaaaccttatggttgcattgaagcggccaggcagagggtgtgatggggtgtggtagctgcacaccggctcagtcaggctgaatggggaaatgcaaactcaggtggcctgaaagagacttagtggtccacagcctggtggctgctcccagtacaggtgatgtaaagagagaaggggttccgggggcttggcccaggtggaaaccatgcactgtctgtgatcctgggcatgtcgaggctggagcaggtctgcttggtggctggcagaacgcacatgaagaatccatgtgtgttctgaacgtcccctctgcccctttgggctcatgccccatcaggagtctcccgactctgccattctgcaaaggaaactgcgctttgtcattgcacaggatcgaacaggtgtgtgtggagtccctaaagccactgtctcaaggggtctcatgggacaatgggagagttgctgtgatgtttaagactaaagtgatggctgggcgcagtggctcacgtctgtaatcccagcactttgggaggctgaggaggatggatcacttgaggccaggagttcgagactaccctggccaacacggtgaaaccccatctctactaaaaaaacaaaaattagccgggcatggtagcgggtgcctgtaatcccagctactcgggaggctgaggcaggagaattgctccgatctgggaggcggaggttgcagtgagccgagatcacgccactacactacagcccgggcgacagagtgagactgtctaaaataataataatgctaataataaataaaataataataataaaataataaaagcaaggacttgaacaaatatttgcacacccatgtttgtagcagctttactctcaattgctcaaatgtggaaggaatggatatacaaagtgtgtgtacacacagtggaatatcattcagccttcaaaaggaacggaattctgtcactacatgtgaaccttgaataatgaaccttgaagacctcatgctacgtaagcctgtctcacaaggacaaatattgtatgatttcacttatgtgaagtcaaattcatagagaaattggaatgacggttgccagcagctaggggaaggaaggatggggagttattgtttaatgaggacagagtttcagtttgggaagttggaagaagtttcggaggtggatggtgttgatgggtgtacaatgtgaatgtacttaatgtcactaacatggaaacttggttaaaatggtaaatttgtcttttttgtttttgttttttttttttttgagacggagtctcgctctgtcgcccaggctggagtgcactggcgtgatcttggctcactgtaacctccgcctcccaggttcaggcgattctcgtgcctcagcctcccagagagctgggattataggcgtttgccaccacgcccggctgatttttgtatttttagtagagacagggtttcaccatgttggccaggctggtcttgaactcctgacctcaggtgatccacccaccttggccttccaaagtgctgggattacaggcgtgagccatggtggctggccaaaaatggtaaattttatattacatatattttatcacagtaaaaatgcattgctctattagaaaaatgatagatttttacaatatgaattaaattacaagttatgaaggaaaaattaagcaaaacattaaaaaattacttataagtaattatatttaaaacaaaagataataaatacacaactttcatcacctcttaggttttttgcaacatttaactattgtctgtcctgttgcggttatgttcttgaggttgtatttgtatgatagaaacactatattcgtggtgactaaacatctcttctcagtctcacctccaatgatgtcatacagataacttgaaattggccggctgggcacgatggctcatgcctgtaatcccagcactttgggaggccaaggcaggcagatcatctgagttcaaaaccagcctggccagcagggtgaatcctcatctctagtaaaaatacaaaaattagccaggagtggtggcgggtgcctgtaatccgagctacttgggaggctgaggcaggagaatcacttgaacctgggaggtggagtttgcagtgagccaggattgccccactgcactccagaccgggtgacagagtgagaccctgtcaaaaaagaaaagaaaagaaagaaattggccaaggcaggaatattgacaccacaggaataggcaagcgctacaaatcgggaaactgagtgttgttgcttttgctggccccaggtggccggttgttgaccgttaactggcacactactggaggagggaggttcagactgattcgcagagagactagaggtagaaacgcaccatggtttggatgctgagggtgagggaaagagaggagtcaacagtggtgcccggagacttggcttgagcaactaggtggatggtagcaccgtttcctaagatgaggggctgtgggaacttgaggggctgtggaaggctctgccactgacggacccagggctcggcagctctgggaggcctactttgtgtcaggccacgcagagataagaccatctgggccctgcccttgggaagtctctgtctatgaggacacagcctgccacctaatggggtgtcccgtctggagcctcagtgttgctgggagaaagcccctcaccttccttcgctctccgagcctcttttgcttccctgccagctgagcctctccatggaggctgtgcctggaggggggtcatggatatggatgtgtgcgccaaacgctgcttcctcgtggatttcctccccactccgttcccacgctttgtaagcttcatttccccggggcctgacctgtggggtttctctccagacctgctccttcccatttccagaaaggcgtgcaggggtttcctatggctctcttccctgtccccatcccccttcccttgggacagtgatctgctggacgggtgggctacccacagggtttgtgattgcttagacatctttgctgtatgaagctttgacctcaaggcatgatgcagatgggaataaggcacgagtttctcctggctgctgtaacaactgtcgaaactgggtggcttatagcaaggggaatgtgtcctctcacagttctggaggccagaagtctgaaatcaaggtgccagcagggccagcttcctctgaagactccaggggaaaacctttctttgcctcttccagcttctggtggccccaggtgttccttggcctgtggctgcatcactccggtctctgcctctgtcttcacaaggcctttttctgtgtctctgtactttcttttctgtctcttagaaggacacagcattgaatttagggcccaccttatcttgagatccttgcctaaattctttctgcagagacccttaaacagaatcaggtcacatttgaggttccaagtgggcatatctttgttttgggggggatcaccggcccactgtaggtctcgttgtgcactgaagacgcaggcggtccctttggccaggcctgcagtcggtcttgccttcttttgtgaccgtggaagaatgcaccttgctggatgcacaggcctttatagttcttttgttcttgccaaatttcagctcagtttcctctctgctgccggcgtgcatcttctctgcccagtgccccttctgggactgtgtgtccaggccctgaggccctagaaaaggggggtggagggcctcctcactatcctgtagcaatgaggcctcattaaaatcctggagccccagactggacccagcccttagctatgatcaaaggacagctcgggatatgattaaagggctagagaaagatgatttaggctgagaaagaggaggccaaggagcaactggattgtccttgaatgtggaaaaggtaattatgacttgaagggtggtgcccagctgtttcccatctcctctgaggacaggaaaaaaaaggaaataaatgatgtacaattagagcagttggttagatacgagggtgaacttcctggctgggagtatggccaagccctgatttgggtttcctgaaagagctcggggaacctccttacctggaggtttctaggcctggtcatgtggctctgagtgattacattgaaggggcagtggctggggctggagccggtgggctctgagcacagtcacgaaggcatgcgcactttctggctgctctcctgccattgtcccttgggttcccattttggtgaggcgtgcaccctggcggcgctccccagggaactaaatatgtttgctgcactgtgcgtggagatggagaatgtacaattggctgaccctgtgctaatctggtggaactccatgccagccctgggaaagaacaattgcatgggtgtgtccacactcaccaggtgctttttagaaaaacactcgagaataatgctgtggcttaggatggctgttgtgccggacccggcatcttcccaggggggctgtgttgttgggctgagtttcttaggtactggacccccaaatccccaaatacggcgtggacaggtggcccagtaggggctggactatccgataggcccaggtgctggagttcagacaagacataccctggcctggcgtggaagatacggggtgctattaatggcagcaatggctgcatttctgaaacccgggctcccaggccgacgagggtgtgcacgcatctgaaatgtctgtggttttgcagttcccatgtccacaaactcacttggttgaaaatagttcaaaatatccaaagcatgagggagggagtgcctgcttttcttaaaaaggaaggacttgatttcatctacttaaaaagccacccaaacctagaacattttccgcaagagaccccctgccccccgcctctccagaatggctggagagtctcagcactcctgcacatttgggatatttcagagggggtggggaggggcaagtgggcagcgagcgacctcagacccaggatgagctgtcaggcgctccccggccacacattcaagggaccggagtgcagttgtagcgttgcggcctgctgcttcgggggtgggggtgttgttccatgctgtgaattctcacatggcccctgactctgggcagaggccgagggtctaagggacggggtgacagggagagcatgcaggagtgggtttctggctttccagggcgagtggaagaagcgcctctctctcttgtaggtgacagacctggggggcccttcttgaggatgagagcctgttgcttctcaagttctgtgtctaacccaggtccccaggtctaccccagcccctcggccctgcctgccttgtggatgatatagtttaagggtagagaccgctggcctggagggaaggctaggcctcaggttagggcccagaagggagggagaagcccttggggcagctccctttctgctcactcactgcctagctccttccttcacaccttccttcggaaacgtctgctcctgacaaggtctacttcctgctctcaggaggcccttattgtggaggaagggaggcgtcgcccgtccctggcttctctgacagccgtgttccatccccgccctgtgccccttctcccggacagtgccttctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgaggggagacgggagtgcgctgaggggagacgggacccctaatccaggcgccctcccgctgagagcgccgcgcgcccccggccccgtgcccgcgccgcctacgtgggggaccctgttaggggcacccgcgtagaccctgcgcgccctcacaggaccctgtgctcgttctgcgcactgccgcctgggtttccttccttttattgttgtttgtgtttgccaagcgacagcgacctcctcgagggctcgcgaggctgcctcggaactctccaggacgcacagtttcactctgggaaatccatcggtcccctccctttggctctccccggcggctctcgggccccgcttggacccggcaacgggatagggaggtcgttcctcacctccgactgagtggacagccgcgtcctgctcgggtggacagccctcccctcccccacgccagtttcggggccgccaagttgtgcagcccgtgggccgggagcaccgaacggacacagcccaggtcgtggcagggtctagagtgggatgtcccatggcccccatccaggcctggggatatcctcatccgcctcccagaatcgggccgtgggggacagaaggggcctgcgtgcgggcagggagagtattttggctctctcctgtcttcggggtttacaaagtgtgttgggacttgcggggctgctctgtccaagcctgggtctggcgtccgcgtctctgagcctgtgagtgcgtgcgctttcctgcgtcctcttgactgccggtgctggggctctgcgtcctgcgtccgcgggagtaaatacagcaggcgaaggggaagctcacacaatggtctccagcgctctggggcagggcttctgaggggcgggcctgcctctgccgggacctggagcccccgcccctcggagaggctcctaggctgacttgggcagagccctctggtgggccgggagggggaaaggctgtgttgaaatgagcaaactgtccaggtgtcaggccaagctgggaggtgaccagcctgaggtcctccccgctccatggccagaaccagggctgacatctgggtgtcctgagcccagctgcccacacggcccacctggggtcagccctatctgagtgggggaggcggggcctcctgggggaccagaactttggctggacgccaagcagagtgccagtggctgttcttcagggctgggcctgaggagggtgtggggcggcgaagggacgggagggggttgtgatccagtggccactggcgctgtgcagagtgtgagctggaaacatcgtagttactttgtcagcttagtggtgaaagccctttttcaggctctatccctttgcatccctgcttcccagagggaggggaggtctgggtctgcagagctgggagggcttgctgttcccgcccccctcccccacaacacctcctcatctggacatctttgggcacatgctcatactggggtctccctaggtccactgtgttccgttgagcctcctgcagtccccgagtgaatgtgacctccctgcccctgcctctttgcaactcctccctgcgaccgctcctccaggggccttccttgtcccaaatgtccaagtggcacgacttagccggtctgaccactttccagtaagcccttatggagagaggccctgtgttgtgcagagctctcctcctgcctgcgggatcgaggtctctgctctcagttcctaacagaaagtgtcgggcccccagtgggatttctggggaagaactctcgtgtctcaacgggagccctgtggcgggaggggaggccagggtttggggttgtgttcgttgtacagctgtcaccatttgcactatgaaagttgttagtgccccttccttgggtctctgggtgtaactccacccttgcccccatgtgcctccatctggagctgcttctgcggctgtctcccaagccagttttgtgaccctgtaatttagtccaagacaatgggctcattgagaccatcctggtgcagcagttggcaatcctttggctctgggggaaggtttctcagtctcggggagtggggcctcaatctgctggttccctgtgtttatcagtctcccccttgtgtgtcctgaatggttttgctgggaattctggtcttagagccatcaggtggcccgagtcgataggcgtgagagagtgtgtgtgtgcatgagtgcgcatgtgcatgggggctgacctggggtatggaaaggtggccctccctggtgcccaaggagcctggagtatagttggagggtgtgggggtgtgtatatgggagttggacaaccttgggtggacagacagacgtggggaagggatgattgaaggaggtggaggagagagtgtgattcagcccagccaggggtgatgtggacaggcagcttccgaatcagggtagagaaaagtcaccactagctagcaggggagaagtcagtatggaggaggcggaccttgagggagagtaggaattggattgcaagaggaaggagagccttctggccagcagcagccagcagcagtgggggaggctggaatgagctggctggagagggggctggggcataaggaggggcctgcctgtgaagatcatatgggccaggctgcggagggccaggcatgcccgccgggagtgcagctggtccacgggaagcatctggagtggctgggaatgggcgcaggagcagcgccgtgggagcacaggtctctttcccggggcggctcacctggtgtcttggttcctgcaaggtaggccgaaagggtggggaggaaactgccagctccttacagcgctgggatggtggccccagggttcctgaggccagcggatgtgggtgcctgtcaccatgtgggttgctgaggggcggagactccaggggccaccccaaagcaggacgagctctgagccacggcatctctgggggcagttttccaatcgagcagacgtctaggcctggaatcctgtaacagaggccacagggccctgatcagggtgttctgggaggcttagaactagtggcagtatacagggtagacggcaagtgacctggcatggggaaagaggcaggtgcccaggccggcacagcacacccgtaaggaacaggtagacgggaagccgtccgtgggcctgtgtgtgtgctcggagttaaaattctgccaatgtcccatgtcctgggcacatctaccccctccctggggagcacctttctcttcaccttttccttccccgcctgtccccttcacccagggccttccccatccctcccgtcttggggaccgagggcaccatggctttatgttccatcaccgatgagttgcacagggattcagtccttccgctgttcaggccgggtccttcaggctcagggttcccaggaatggagagggtatcagtgtcttccatggactcaaacttcccgcatcccgcctttgctcccccttcaagataggtctccgagcttcaaggttttagggctctgtggaggccgccacgtagcagcaaggagaatgttttgtatttggctgatgagatttttagagtctcattttctacttttccactgtacaaacgggcctccaggcgactgcagcacccgccactgcccgtaatagggtgacaagagggatgaccctttcctctttctcccttctggttggtggaggcacggggctggcggacggcatgtgctttcgtgaattcaggccaaatctgttatcgcaaacacgattacaactcgggtctttgtgtaacaaaagcctttccaagtaccagctgttggcctgctttgctcagcggtgtttgctgtaaccagatttgcacaccgagaaagaatccaaaagtccttgatgtttgttgaaacaatctggcccaggacccacgtgctcagatcccagagctgtgtggcatctgagcttctcccgagcccccactgtcgcccgaggaggacccccagatctgtgttctggaggcagagcaggctgtgggacgggcttctgggtgggaaggaccatgtggatatgccttcttgtctgagagtcccaacacctccgggacgtgggagctggcgcgctggcaggattcaggtgcctctttcctctctagagaaaaaggccccgttgcttggtaataggtgcagacctgtccctaattaatgccagtaggcctcttgcgtgatgaaccctgcctttcagccaagactcaaggcatcctgtgaatactgcctctctgcagtttgagcttttgtggtgggaggcaggagccatggggagtgggggcaggcctcttacacgggtcccacagccactggcagcactgacttgatgctctttgagttcagagcccagggccagacagacccactgtcccgactacgagttggttcatttagaggggggcggacacagcacccaggcagcagatgcactgtgatcagccttgcagcggggctgtgggttctctgggctggatgtccgggaagaggcaggtggaggtaaacgccaggacacccctgcagtgactgggtgactgcaggctggaaatgctttctgtgggctgtggctgtccaggaaggttttgaatggggctagtggacagagtttgcatccagaggggcagtgctttggaggagtgaggggtatggcagtgtagggatgcccaggccgccctcactctgccattggaaagctgggcggcttcggtttcttcagtttcttcgcctgtttccctgcctgcaaagtggggttagaaacagctctctttgagggttgctgggggactctgagatgcagcccatggcgctgagcacgggtcctgcctcctacgggtgtggtgggtgtcgcggctggtgtggcatctgggcgggaaaagggggcatttgcaaaggacaggtaggtttggatgcttaaatatgcagatctggggatgggaggtctcaggcaagggcctgtgtgatgccactgtatgaatgaggccggacagcatggtcaccactaattatggaaagcacggcagacactagtgccagtagcgcccgcctgggggtccctctgagcccgacaggtactcaggctcccagtgcagccatgggaccccccttttcctgcctggctgacattctggaggctggcgtcatgttggctgcaggttcctcttactgggaggttgtcctggtcttccctgccaccatctacccccacccccaccctggagtgtcacagatgggtggaccatatgcccatctgcagggccaagcgctgacaatgaggtgagcacttgctggatgaccggaccatgaggacagcgggggcgctggcagcctgcgttcggctctgcaggctggcctttccctgaaaagcggttgtggcagagtgtgcatcccagggagtggtgcctgctgccctgaacattctcatccagcaggcctctgcaagggcccagtcaagtgtggtgcagagctgggctggcagctggaacagtctcatcttgtctagtggtgagaccaagggctgatgggccaaggctgcgtgctgcttgcccagcccgtggacccatccactgagcacccccatacccctacactgggcccggggtgtcaggaggtggaggggggactgggtgcctggaaaaacaagcccaccgagagcctgagcccccaggggtcagtatcaggcagtcaccacggtgcccggtacacagtggccacctggtctcgtcggctgtcttggtggtggagagcgtgcatggtggccgtacgtgatgggcatcacccagggtaatacagatatgcagactgtgcatttgtctgtaggagccagggacttctcagcctggcaacctgtgacctctgcctacccgttgggagagaggtgctgttccctgatagcctggtgccgggagagcagaactagggtctcctcctcctttctccacctcccatttcttacatgcccaggcatcaggggaggtcacactcagggatgagtcttggccactgggttcagggcctcactgttgccatctcttccctttgccagccagccaaatgcccgtccatcatcgtgccggggatggggctggcctgctcctctgaagtctccttggtgtatagcctaggctggagccccggacgattccgccaccccctcccccgactttttctttttattttgattcatcccagaaacccagccaaaaaccaagttcctgtgctctcccttgacaaagccactgaggaaaaatggtcaaacactgcctttctttccaaagccctcttggtttttcccaaatttggaggctctgagttgcttatgagaccaaagggtccggaactctctggaacacagtcccagaagtgggaggatttgtcatctctccagccaaacagacccaccagttggcccctagacacccccaggcgcctggggcatttctgggctcaggctgtttaatttggtctgcagagccccgaggctccgtttagactgggccagcagacagttctagagacttcaagtttgttgtcgtttttaaaagtcctgccaatgcccagaaacttagagggacaagaagatgacctcgatgtcagccgggaccataaacagtgaggcccgcccccccccccacccatgcctgcctccactgctcccgtagctgggtctccaggggattgcccgtggccatgggggaggccgggaatgcggggctcagactctactgggcttctcgtatttttttgtttttccttgtccatcttctttctcggaaatttctgaatatccccctacagcctttggcattctgtcactcctggcatctctgggccaactgggaaagccatcatttgtccaatatccagaaaatcaaggggcctggccttaaatacattgcagtgccctcctccccacatggcatcgaatttcctgtgtcctcaaagccaggagcctgtgccttggatgtgggcgatggagccttgcagacacctggagcggctttcctgggagagtctccctcgccttcccatccacccgcttcccctcccctgccccaagctctggtcacagcctcggaggggtcatctgagtgtaggttgcctccaggtgtacagttggaggggggcagttaccccacatccccctgtctgctaggggcacccccagggactcaggtcttgagggacagcggaagggtggggtggggagtaggccgttgtctcgtgccacctgggtgttatgtagactctgaatgggcagttcctgggagctggtttttccttctcaccccttctacagtgctgcccctctgaggggctggagctctctggagccctttgcagcctgtggcaggtctttctgattctgtgcctggtttcgcagcctccaacccatagccagtggcatgaagaacattcctggctgtctctacctgtggcctttgcaggcagcagttccctggggcagggcctgggggtcctggcacctccttgtgggaccccttgggtatgagggagggagccacctgggccacagatagacccccttcctgtatccaggaggttcaggatggacctgtctcatctttctttctggtgggaagagagcattcctggccatggggaatgtggcctggacagagccacctagcctctcccctcccccaggcagggccctgaaagatggagatggctctgctcctgccaggtcaacagccagcagtctggtggatttccatgcagtccaggcaggatctccttctgtccccaccccccaccccatgtgcaggaagctggttccaagcagggacccttggccccgctttccacgtgggtgggcagtttccctgcgaggggcaggccaggcccctgccctatgtcccccagagaccgatgttatctacagtaagagcatacaagtctttttggctccaaaccaggcctggaggggtggtcttctcctctgtcctctgcctcttgccccccattaaaggtcagggaatggagtgctctgtatgtttgctggggttgggttttttcctttggtttaaaatgaagggctggaatccctggtgcagactgcacggtgagaggtgctccttgggatccactcgaggagcattactgctgaatgccctgccaggccaggagcatcgctgggggtgggagaggcagttggcttatttgtttatccaacagccatccatgggtaccccaagggccagctctgttctaggcactgggggtctaggcatgggctcaggagaaggggtagaacgggagggcttcctggaggaaggcttcctaaccagagaccggggtaggagtttgccaggcaggtgatgctggccagcttctcttgccattttccttttctttttttctttttctttctttctttttttttgagacagagtttcgctcttgttgcccaggctgcagtgcagtggcgtgatctcggctcactgcatcctccgcctcctgggttcaagcgattctcctgcctcagcctcctgagtagctgagactccaggcacgcaccaccacgcccagctaattttttgtatttttagtagagacaaggtttcatcctgttggccaggctggtctcaaactccttacctcaggtgatccgcccaccttggcttcccaaagtgctgggattacaggtgtgagccactgcgctcggccttctcttgccatttctgcagactcatagtgtgtgtggaagactgtatgtctgtgcctggcacagctgccctcggcactcaggtgggaggtgggggagagggctgttggtgccagcacaggtcatggcatgagacaggctcccgcagccaagcggggtgcaccgcagcattggaggggccctgctgcgcacgagatccaggctctgcatctgtcctcctccccaggaggcctggagggctgggagggaccagggtggtgaaataacccaggtgggagagaggcactgttggagaggcagagggagctgcaggtttgtagcagcgagctttaaaccctgggcctccaccagaaaacctcagaaagggctgctttgcttttttttctaaactacaaaagaaacccttggccgcctgggccccttggggtcgggtgggggaggagatccttcattcgcacctttgcaggcccagtactgtgcagagggaggagggtggaggcaaaggcgagggaggagggtggaagcaaaggcggggtccctccctagccccgctgccctgcctggttgctgctctcagacccctactcctggcccggaaacatggaatcttgggacagctggggtagggggcacagaacggagaccctggtgagggaggaactctttctccagccctggctgtggccacagcaaggccaggctgggaggacctcactcaaatatttacatctctcctaatatttaaatgatgaagcaggctcctgcacacagctgccctggagccagctgttgcctgccctaccctccctctctccctccctctttctttccctccctctttctctccctccctccttctctccctccctccctcttgcattctttgtctctgacccaagtccaggcccttccagctgttctctccttacccacaggcacctcctgtgactgagcttctccttgttatttttcataaccatttcctttaattgagcacctcctaggtgccaggccctgggctggtactttgtatacaaggtgtcttttaatccccacgagagcccaacaaggtagattgggctgctgaggctccagcgctggaaggccggcccgggtcctcccagtccgcacctgcatccatccatcactcccccactgtggagacctgttccctggcccctggctgagcacgatggaaatctctgtctactagtccttggagagtggggatggctgagggtcccgaccctggggtctgacgggggctgcctctgccccacttcagcctggctgctcttccactcaatgactgagtttgcaaaaccagaataacagtgctacctggctggtactttgggtggctgggaggcgtgggagagggtgcacggaggggctgagcgaggtgtcagcatcgtggggatctccgagggtagccttcccaggcccagggcggagtgtaggcagagggcgcgatggcccagcgtgccggctcacatctggccttgcccttgcccacacggcaatgtgggggagtcatcagcctctcagtgcctcagtttcccatctgtgcaatggggacaagagtaaatcactgtcttcaggtatggtaagcactcatacacattgactattgcagaatgaacacagtgagcccttcttaggcttctactacatgccaggcagggtgccaggccctagtggagaggggacaatgatgggcaagctggctcctgccctcaagggctgtcgagcagggaggaaggcggcggctgccctgactgtgacccggagtggggtgattcgcaaagaggctggcgggaggctggctgggggctggctgggggctgctccctctcctgcctgtgttccgtggcagggtattaaactggcttttttcatggatttccgaggccctgactgtgggacctcgggcaggttttgggaccttgtgactttgttcccgcttgtcattcaggcctttgtcctcagcagtgcccagcacacggcgacttctgcatgtccttcagtgtgtgactgaccctggagctgagacttggcagctgaggctggacattgtccttggataactcccggggaggtgggggcagggtggggctgtgagctggcaactccgagtccctagcagcctccgaatggaggctttcctcttgtaggattctcggggaggaaggaggggatgggggagatgaggcttgtgagtcttcaggagggcagaggttcacacctgcagcgccccagaaacactccggggtgcccaggcttacccagccctcctgagccagaaccaccaagagttggggaccagcagtccattttttagcaagatccagaaatgattctcctgaacagtccgagccaagaatgacatatctggaatcagaacatcagaactacagaggaatcgagagaacgggcccaaaatgtgtagggacctcagccacatggcgccacatggaggaaagcacccaacatcatcactgtatgaacctgtttaaacacacacacacacacacacacacacacacacacacacacacacactccccagtaaagagtggaaagacatttgtcagaatattgatggaagttacctgggttgtgggtttatagattttttccctttgtttttgtgcattttgcaaattttcggctttgtgcctaaattccttttacagtcaggaacaaagcaatagatgttattttttaaagttcatgggctcgtgcccgtaatcccaacactctgggaggctgaggcaggaggattccttaagcccaggagtttgagaccagcctgggcaacatagggagacccccacctttttttttttttttttttgacagagtttcactgtgtcccaggctgaagtggcggtggcacgttcttggttcactgcaacctctgcctcccaggttcaggtgattctcatgcctcagcctcctgagtagctggattacagacactcatatttgtaggatttgagaatcctacaagaggaaagcctccattcggaggctgctggggacttggagttgccagctcacatattttttagtagagacagggtttcaccatgttgaccaggctggtctcaaactcctgtcctcaagtgatccatccatctcggcctcccaaggttccaggattacaggcgtgagccactgcgcccggccatgggagaccccctcttaaaacaagaataaaaataaaaataaataaaagtttactgtcaaaaagaaaaacacatcacccaacctaatctccccctaggattgagagatgaggaagcagaggccggaaagtgtcacattccctggtcgctggcagtcaggggacctgaggcctgggctggttttctcgtgctccaggcctggggtgtcaggtggagcccctgctttgcccaaaggtctaggtgcctctgccagcactgcttgcttctgcatttttggccacaaggaatgtgggccaaaggcagggtccttgacctctgcccaggagggtgaagtgggctggtcctccttgtccctgctccaaggcccctgcggctgtgcctttggaaactgctggcccgagctagtgtgcggagctgggacagacctcaccgtggccctcgtggggtcattccatgtccgggctggaagggatctttcggtccagcccttcctgttcctcatcaggaaactgagaccagagaggtcatctgcctggcccggggtggggtgtagatggcgcttgtgactcctgcatgccacgtgcagacagtccctcagctgtgggcttcccacgcaagcagccatgctggggataacttggctgaaacctgcgatttaatgaagagaagaatgactcctcctgcagccctgtgccccacaggctccctcctgcccccacccctcctgcagaggggcctcatgctggtgggtgggtccctgttgctgcaatgggcccaggcagtttctgggcagtggaggcttggctgtcttcctgcccaatgtcccctgtagcccacgctgtccgggaagggcggggaagcactcagccactggggacttcacaagatgggtatctgggagatgctgattggcaggccaggctcccgtggcccacaggcaggtcagaggtcacagtgctgagctgggctgagttggcagctcagggcagtgggggtgggggtaccttgctcagccatgggcctctctggcacaagggtttggagtttactgtaaacaactccttcagtttttccttctctcataggccaccagcagaattgaggggccctctgttgatgaggtgtggcctgggaggggctagttgtctgtccacctgatccttgcggacaggtgaccacaggcttcctgccccagggggctgggggaaagatcggggaggcctctctggcttccccacttggaaggaaaatacgggcataggggagacactttacagggacacatttcagccagtaccctctggctgtgctgggggcacagtgcctgccctgcccacaagaggggtcagttctctccaggatttaacttcagccttcagtgcagggcagatgagcactcagaggcccagaggactcatatcacgagagagaagctgtgaccacacaggcactgaaggttaagcagaagagtgggacacacgggtgacctgaaagtcccagggtcagtgtggttagccccagatagctggggagctttgggtaccaggcttagcaggggaggagggcccccgtgacagtttgctggggctgctgcaacaaagccccacgaactttgggggctgaagatggttctagaggccagaagtccaaaatcaaggtgtcgaccaggctgatcctttggggcctctgcgggaggctccggcccaggcctctctcccagcttctggtggctcccgggtgctcctgggcatgtagatgcgtcacgccactccctgctccgtcttcacatggccttttctctgtgtctctgtgtctcgtaaggatgcttgtcattgcatttagagcccaccctaaatccaggatactctcctcttgagatcctttattgcatctgcaaagaccctattccaactcctgtcacattcacaggtccgagggctagggctctggcatgtcttttgggggtcactattcagtccactgcggcagctgatcttaggggaagcagaatgttctaagcttggggtgagcggagggaacgctgctgggtggggagtgggagaccaggctcggagacaccgcggatctcctctgtctgatgagggcgtgatgaggttctcatctcaggtcctctgaatggcggctgcttctgaggagaccctttcccctggatctgcccctccagaaacctccacttaggtccaggtcccaaggtggatggtaagaggcggctgtccctgccacacttgatgggtgagtgtgtgaacggggctgggagcaggacacttgtcacttctgtggacagattccagaggctcatgaatctgctgctggggaaggtgcctgatctagcctgaccctccacccccacctcccccttcccgccccccttcaccagccctgttcccagagcttcacttccccaaaggcaggcgccgtttcctggacttctcagcagctaccccctaccccagacccctctcttgtaggcccctctggtctcagcgcctactcctccctgggcttctgcccctctaccgtgaggcttctgggcagaagtgtggggccccctcgctgtgtctggctctcgcggtataccaggggtcctcccaggggcccgccctgcccgctaggtttccagggagcttttcaagttcttagatgggcttgatggagtttcccaatgcgttgtctcagagcaggaggggccccggctgagtccgagagtcccctcagtcacaccctgggctgtttggggcagccaggcagcccgtcttctggaggtgctgcctctctctggttaccccttctggaatcttctgcgtccagttgcggcccctcctacacagcacacccaccacccccttttacctgtgactcttctttgtcaacctcttcatgtctttgagaatggagaccaggtcctcctcaccctggagttcagcagaacctaaaccaggcagatccgtgtaggttcacgtgggggctctgtggccactgtggctctgccgtcacctccagcccagcttggcgcgctttggatcatgtcattcagtgccggtcctccaaacctctcccctggctctgcaggtctgggaagcagctggctcctgggtgcagctgtgaccggagcctgaactctgctccctggggtcaccgtcccctgtaattaggctgcagctcatattggctcgggcagaggccatcggctgcccgccttggggccacaacacagagagccccgtgattaatggaggctccacctgggccaagtggcccctggtgttaggcgcttttttttttttttttttttttttgcattttttaagtgcttgtaacatttcccctaatggacaatgagacgaggagggagggaggggtggcttctctgcccaggcagatcaggaatggtcaccgcctgtgtgtgcagtgacaggtctgggaacagacaagggagagcttgtccgggaggctggaccctcacaccgatgctgcctgtgcctggcagctctgtcccgggcctcagaacagacactgaccaacacgctcctcagggtctccaggtccgggtcctggtccccggcagagcttcccatccatgggaagaagcaccgagcagccttgctggctcctcgcagggagctgggatgcatttctaagagcagcatgcgtgaagcccggggtctgggcaaaggagtgtttggggaagagtctgctgttgttggagggtcggaagtagaggggaaggaggggcacgcggtaggctgaggaggtggctggcgaccctgtggtggggacgagggggctatgagcagaccaggagccagcatcacgtttctctgtctccagaatcgaggacggagagctgccagagaggccctggcggggtgtctggggccacctaaagggcgtgggtggattaaagctgaggaaagcctcattttgggggactccgtacttaacctttgaggccctcagagctgcagcctgtggtttttcgaagtcaatcacctcccagggcctcgctcctgccttcagcgacagccatttatcagggagtctttgacccaaggagacctgaaaggtcatctggtccctctcctacccccaggcaggccacacctagaccctcccacacagatccgtcccacccttctgctgccttccaccagggacggagggtgggcggccctcccacccaggccctggcggccccaccccagccaggaaattcttcctctttatctgcctcacatctcttcccctgcggcttccgcccatttcccctcaatctgctcctagtggagcagccagcagctggtttagaacccgggggtggggggagcgctagaccagtgcagcacatctgagagtgtgccagaggtgctcccattcccatagctgatttagtaaagaaaagaggaagtccagcaacttagcgccactttaaagtccgcctggaatgaccctgtggctgccggaaccaggggcacgcggtagatgacgggagcaggcacagagaggccttcgtcccggatcagtcgctgttgccctcttggaggctgggctgcctttcaagaagaggacccaaggccctgtgagcggtggcctcctctggagcctttactgtggtcctggttctgctctgcgtaaagagagatggcttgaagcagaagctgctacgtggctgtcccaggcaggcgcccgtagtcccagctactcgggaggcggaggcaggagaatggcatgaacccgggaggcggagcttgcagtgagcagagatggcaccactgcaccgcagcctgggcgacagagcaagactccgtcttaaaaaaaaaaaaaaaaaaaaggagtagagaaatctttcccagaaggcctgcagtcacctccccttcatgtttcagaggtaaaaaaaaaaaaaactgcacatttcgctttttttttttttttttgagacggagtctcgctctgtcgcccaggctggagtgcagtggcgcgatctcggctcgctgcaagctccgcctcccgggttcacgccattctcctgcctcagcctcccgagtagctgggactacaggcgcccgccaccacgcccggctaattttttgtgtttttagtagagacggggtttcactgtgttagccaggatggtctcgatctcctgacctcgtgatctgcccgcctctgcctcccaaagtgctgggattacaggcgtgagccgccgcgcccggccacacgtttctgttcttgaacaggtggctccctgaccctgggtgtggttactccaagaccttgctctggtggggcacaattctggccccaggtagggcgaccgtataacttactgtcccttgggggacacgttagtgaaagggacccttgaatgactacggtgggacaacagatgtgagctgggtttgtcccaggaaggctggatgtatgggcctcttgagccagaggagacaacagcagaaagctctgcggctgatgggaccgagcaggagaagggccggcggaggctggggcaacaacgcacttgcccactgtgaagggcctgtgtgagctgatggctgatgagagggcagtggggcgaggctgcctcctgccaggctagaccagctccaggacacccatatctccttttcagaaccggtgactcagtggctagaaggggcttcagaattgacgggacactgagggagtcgaatggaatggctggagtggccacagcaggctctaggcctcctcccgtttcttttctgtgttctgttcctggggtctatatcctggggttgctgtaacagagtgccacaacctgggggcttacaaacatagcttccggcggctcctggagattcctggcgttccttggcctgcagacgcatcaccatcatctctgatctctggcccctgtctccacgtggctttctccccctgtctgtgtgtctttctccttttctgtcttttataaagatgctcaccattggatttagggcccactaaattcagaatgatctcaccttgagacccttaccttaattacatctgcaaagatccgttttccaaatgtgatcatgttcgcaggttccaggagttaggacttaagacatatcgttttgggggacactgttgaacccactacatttaataaacccagagttggtgccaatgtcccctgcggacaccatagcagattctggaggttccttgtaaaggaatccgtaggacttcttttcccttctggagggatgagactgtagctgggctggggaaagctgctggttcaagctggggctggttcagctggtgctggcttgccaggttgttagagagctttatccagggagaaattaacatcacaaagttgggggataagagaaggtttggaatcccaagggctggctgttgaggtcagctgcccacccctttgtgttccatcttacagggacccaggcctgccagtgctccgtttctggaaggaatgctgtgggctgctgtgccccataggcagggtggagggtccccttgcagccagcgagctgctcttcctgtagcgtgcagagggaaggaggaggcttgtttatttctcttggcctcagccgaaaatccaaccacaggctctggcactaggcagacctgctcattctcacatcatcattgcagagtgagccaggcctcttgggtggggctgtgatgagcaggaaggacctccggagtgcctgggacttcttgggcccagggttgccagaggcagagagaaagaagcctcctcctaacacttgagcaaagatagtcatcagaatccatcagagtggcctcctgtggctcttccctgggtgctgacccccctggtgcatttgaagttttcagggatactattgacgctccctgcacctccatccaggggttagtggaaatggttcttttcctccttgtccagaggtactgtggatgatgaccccaggtcccagacctcagtcattgggccacgtgtgcagataagcctgggcagtcagtaacctttggccaccaagctggcctcctgcggactgggccggcactggaggcgggtcttagctgctagcactgtggcccagccaggcctggccttgggaaggcagagggggaggggactgggaaagggattgagctgggggtggggtggtaccctggttcttccctcccagacctttggcaggtttgaactatctggctgcggctctctaaggagggagcgcctcctccgccttgatgtggactttgccttctgttcacgttgtccctgtccctaaacaaatgtggctctctgtggggagcctgggggccgccctccactgacactgctgtttcctggcttccctttgcaggctccgctcagcttcactgcgcctatttttaagcctttccttttggacggttttgcttcctgagaacacacccctccccatcaccccaactgtgtcctcctccctatccggagcctgctccacctgccccaggagccacctccctcctccaccaagcagcccaggccaattctggagggctaatttgtgtccctccagaagcaggtcctgagacagggatttcagtgggaggggacaccaggggatgcctgagtgtgggaatgggccaggcagggaatccagccaataaagggtgcctcaccagctcattgtgaccacaggtggctgcccagcccccataccgggcagcatggggagactgcagaccgtgcccccagccttgtcccacctggggttgggtaagggagctggggtttttatacttcagttcttggccaaggactgcactgctcactccttccagccttccgagggcttgggcactaggaaaggctctgggtggagacacggaaataggccatgtgaagtcagtgggcgtgattggtagcagtaaggccaggacagccttggtcaccagcaaggtgaccacacatttcagcatgcacagcccccacagacacacacccaggagatggtaattacaccagcaacagtcacccctgccgcgtgccatgcctgcacccagggaatcttattttttatttatttatttatttttatttgagatggagttgcgctcttgttgcccaggatagagtgcaatggcacaatctcggctcaccacaacctccgcctcctgggttcaagctattctgcctcagcctcccgagtagctgggattacaggcatgcaccaccacgcctgactatttttgtatttttagtagagatggggtttctccattttggtcaggctggtctcgaactcctgacctcaggtgatccacccacctcagcctcccaaagtgttaggattacaggcatgagccaccgcgcctggcctcaggggcaccttattaccccatcacctcctacagcaggtgacactgaggacactgaggctcagagtagactgtggttatgtcactctcctgtttggttctcctgctctcagccctgaaataaagagcacggtccctgtgcaggcccatacgtcctgtctccagccctggagcagtccttaagctccttgaaggcacaccaggcctttgggcctcgtcccccaagtcctggataaataggaggtgaaggagcctttgcaactggaccccactctgccagcgccaaggccctgcctgactacccaccccaccctacacagatcagggacctgtgccaaggtccagtgtcacaggagagtgaagacaaggaggtgcccatggcgtacatgctgctggactcactctgtagatcctaagggttatggggagttatctgccaggtgaggttttcccgtggctttttcctgcaggctcagggtagcatacagggaggtgcttccctactccttggcaccatctgtccggcttccctgagccctgaccctggctcctagatagccagtgtttcttcagggacagaacctgctttgctgctgctcagaggagacccagtttgaccagggctagcgttcctggaacctgagcctggaattccaccctgccctgggcagaggccacgttgctccctcctacgagagctgagctgcgcatgagattattctgaccttgggctctaccatttctttgcatgacatttgtcccaggctggagcagggctctgtggctcgcttggtgttccctccccagactgaggcctgatatgtacaccaggaagtgcttgatctggtttcaggagctgggagcggtttgccaggcagcctgtggtcagagcaggggccttaacaatggtcccttgtgcggcacattcctctctaaataggcccaggtccaggctgctcctgtttcgaccccgccatgggcctggaggggaaagtttgcatctggagggtggcccactgtggcctctttttgtgtagcagctgagaccgtaggtgcttgagaataggagaagccctgtgcccatcctgggctgtgagatgtttttccagaggtggggatggggatgggccagcatgcagttacccacaccctccagcttgttggcatcaaggtctgtgtatgtgtgtgtttttttttttttaattttgtttttccaacatggagtcttgccatttgcccaggctggtctcggactcctggctcaagcgatcctctagcctcaggttcccaaagtgctgggattataggtgtgagccaccatgcccagccagtaccaaggtgtgttttttaagagcaatattggccgggtgcagtggctcacgcctgtaatcgcagcactttgggaggccgaggcaggcggatcatgaggtcagcagattgagaccatcctggctaacacggtgaaatcgtgtctctactaaaaatacaaaaaaattagccagacgtggtggccgggcacctgtagtcccagctactcgggaggctgaggcaggagaatggcgtgaacctgggaggtggagcttgcggtgagccgagattgcgccactgcactccagtctgggcgacagagcgagactgtctcaaaaaaaaaaaaaaaaaagaacaatatcgatggttttattccctgaacatgctaagtgatccccatgtagtataagcatctcagaaggcaggaaaatgtaatgaacaacacccaccgccattcattccatccagagatcgttattttctgcccgggtgtgagtgtgtgtgtgcgtgcaaactgcacatgtgtgtatgaaatggaattaggatctttgtatacatcttgtgtcctgctatttttacttaatattctcggcatttctcatcttcaaaaatgtgattttaatgatggtgcaggcctttgacatatgggtttagaaaatctgcggaaacccggactgtttccaggttttgtcagtttaatgctgatgcaaatgtcctcgtacgtaaatctttctgtacttctgattatttccttgggataaattcccagaagtgggccaaagcacatgaacggtcttcaggcttttggagcaagttgagatcggtggggattggagaagggacccagggaggcttttgggagcttgcgagattggagtctggctttaggggacttgaattcacagatgaaggagatggctggcaaaggtgggaacctcctgctctatgggtgggggggtgacactgctttaccttccagtgacagcatggggatcctcccaacatgacctggctccgcatctttctgacactgtgcacggtccacagttgtgatgctcagctgggagcctcttctgtgtccttcagttgcattaactccttgcagacagaggaggaagctgtccggtgctcctccctgctgcgtgggtcctttgaatctgcccagttgggcctgtggatctgtgcagtcacgtacggggttctaaaatctgcaaaatgacaagctcacgaacactctcgcttctgtgggtgaatgtggataccccttggctgcgtctccctccacagggaagatggagacgtgtaaagtgacaaggacctgctacccctgggcaggttatgccggttccactgtgaggatggtggcagggggcttcccaggaggcctgcacattgggaagagaggggcgaccgtgtgtgactgcaggacccagggcgcagtcttaggactctgatgggggaggagatgctggggagccctgttctgccagcctggtgacagacatctcctaatgtttcccggctgggtacaactcacaatgtcctccgtggggaggcaattgcccatgaggcatccctggcagggatgatcttgtttcattgccacatatcccagcaatgaaacaagaatctagagtgatgtgattcctccgatgacttctccaaccatctggggtttttgtgcgactccaagaagggggaaggaggcagctctcgctcctctgggctcctgatgtggcagctctggaatggccacgtgtccgttggcccacagtgggccatttgtcgaatgtggttgtggtgggattggggctgggctggagagtgggtgaccacaccagctagcctcaccctgggccactgtgcagccaggggtttcatcttcccaggggtctcgttgtgagtgtcctggggctgctggaacaaattactggaaaccaagtggcccaacaaagattgattcgctcatggttctggaggccacaagtttgacatcaaggtattggcaggaccacactccctccgacagctcgaggggaggacccttccttgcctcctccagcttgcgttggcccaggcgctccttggctctggcagcatctgcagtctctgctctcatcacgtagccctccccaccgtgtctctttgtgtcccaagtccccttctgcctttctcctataaggacaccgagcactggatttagagcccatcccaaatccaggatagtctcatcccgggatccctaatcacatctgcaaagaccctttttccaaataaggtcacattcgtgggttcttggggttaggtattagacatgtctttttgggggtcactagtcaaccctctacagaacctcagacgaaagtgaatcttcacaggctgaaatgggggtgaaggtctagtgcgtccctcctccttgggagctccctcagggcttgtgcctatcctgtgatcctgtgatccagccttttttttgagatgaagtcttgctttgtcgcccaggctggagtactgtggcacgatctgggctcactgcaacctctgcctcccgaatttaagtgattcttctgcctcagccttccaagtagctgggattacaggcgcccacccccatgcctagctaattttttgtgtttttagtagagacagggttttaccatgttggccaggctggtttcgaactcctgacctcaggtgatccgcctgccttgggcctgccttggcctcccaaagtgctgggattacaggcatgagccaccacgcctggcatttagtaggttttggttgttttttttttttgagacagagtctcactctgtcatccaggctggagtgtagtggtgtgatcatggctcactgcagccttgatctcctggcctcaagtgatcctctcacctcagcctctcgagtagctgggattacaggcatatgccaccacccctggccaatttttgtattgtttagtggagtcggggctttgccatgttgcccaggtttgtcttgaactcctgggctcaagcgatctgtccaccttggcttcccaaagtgttggggttacaggcgtgagccaccacgcctggcttagtaggttttctagaagcgcctgaggcctggtgaaggcatggtgtcatggagtagagaacattcaactctgttcccggggagccggaacacacccctcgtagccaatctcaacagtcatgacgtggccaggatgacatggggagggggtggtgtggactgtgtgggaggccagctccccgggaagggggctggagtgggcttggctttgaggaggattcccaagaggaggaggaggcggtggcatgctcgtttggggggatggcgtgagccagggtgggcacctcttcatttaggtgtcaccttcttgacattccagccgggacatggtttccttggggaagatggacacccccagagtggggcatctcctggggaagatggacacctccggaatggggcgcctcctgttctcactgttcttctagcacacagttgtattctcttgcagttctggaggctgtgagatctcctggctgttatctagaacaaactcgcctttgagcagcgccgtcctgatggtggggtggcccctgcgggtggaacagcccctgctgtctcagagcttactgagagctagtgggcatgggagtggtgctggaccgaaacacccagagggatcatagagccaggcagtaagcacagaggccagctagtggggagggagggacccatccatgaaaagacaccaagcattgaaagagaggagaggatggttggggaccggcacacatgtgcattttgcgcagatggccaaggtggtgaggcgccagccacgcagacaactggaggaaggaggagtgccctaggggaggggccagctccggttctagaatgatccgcttgtgcacgtgggcctggctggaataaatcattgcatccgcaccgtagactcaatcgtaagctcacaccagggcagcctctgctttggtgcagtgtcttcgatcatgagttggccatggtgggggtgactccaaggggactcccaaggagggggttcaccggatctcccagggaaggtcatttgttttcttgggttggacctgggacaaggccttctcctgtctagtttctgttctccaacttgaccgcacggaaggatgctgaggacacctggaagccggcccctgctctacagcacccataggacagaggcacaccatgtggggacagtttggacagtgctcaggaggcagggagcagatcagaggaccgcgggaggccctgggaaccgcacgaggacccaggcattgagctctgcactttctggcatcagcccgatgtacagtctggctctgtgtctaccccgtacttcactttccccatctgtacgggggcggtaataatattctttacagcccaggtttaagcgggtgtagatgtgatgagcttggtaagcccatctcattacattcagttctgggcattgaaccctggactttctggctggtagaagtggacattcaacctttccttggggccctggggcttctgcagaatcagaacacagccagcagtttgcatgcagggtgcagagggacagagggacaccatgtcgggagcccacacctggcacacccctgactctggggctcagtgtcctgctgccctgcggccacgtgatcagctagaggtcatggctggacccataggcgaatacagcctgtggatttgattttgtttggccctgcggtgttttattttatttttagttttagtttgtggagacagagtctcgctctgtcagtcaggctgagtgcagtgacacgatctcagctctgcaacctctgcctcccgggttcaagcgattctcctgcctcagcctcctgagtagctgggactataggcgagtgtcaccatgcccagctaattttttatttttagtaaagatggggtttcaccacatcagccaggctgctcagtgttttaaaaagggcttgttttgctttgtgccagcatttaaagatcaggagatatcatataaagatccagatttctactctcttgagaagtgaacagctctggccacgccgggcccatatcctctagggcagtgacggagctgagacagggcctgtgacaactgagagttctctggagtccacacggctccttgcccagcttctggtggaggttgagcttagtgacccaggatttcgtctgtgtccaccaagaaggagaggtgcctgtggcttagagagggcgcccacaggagtgccttgcccaggaagctggcagctgaggcggccagggttagggggttgggcttcctcttcccctccccagtgcctgagtgcatttggaggaagagagacgggtgaggggaaggcactgaaattggtcctggagcgctattattgggggctggggaccagctgtcatcccttttcctgtgggcaggggaggcagtggtgggatcccatgagacccggactctgtggcctggtgaggcagggagcggctggggagacactgtgggtctccacaggggtgcgctgtgggtctggcctggggaaggagctggtgaatgtgcctgccatgtgggtccctccctgctctggccctgataaccaggagcggctggctctcatttggagtgcggttgtggggactgtggaggtggcagcttcccaggtaccatccccactgcctccgagggagcagaccctggtggagaggcaggatggctgcagggcgggagctggtggttggcatcactgcacgggcttgtagtagtggatgggaagatgcaggagaggctgatgactgagaaagttggttcctgtggactaagctgggggagccggacaaccaagtggttagaaccttgggctctggtatcagcctgatgtacagtctggctctgtgtctaccccgtgccccactttccccatctgtactgggggtactggtattctttacatcccagggttaagcggctgcagatgtgatgagctcggtaggcccggcgcctcgccggcactgaaagctccagtgtccgcccttagtgtcattgatggggttttgttcctgctgcggttctgattggttacagttgcggtcacttattattggaggcatgtcccccgctgtggctgatggtagaggtgtgtttgctggtggtgtcccagtgtgtgccttggctggaggtgaggagggataaaaacagccgcgacaagaaggaaatcaaggccgggcacggtggcgcacgcctgtaatcccagcactttgggaggccgaggcgggtggatcgcttgaggtcaggagtccgagaccagactgaccaacatggtgaaaccccatctctactaaaaatacaaaaattagccaggcatggtggcccgtgcctataatcccagctactggggaggctgaggtaggagaatcgcttgaacccgggaggtgccgctgcactccagccagggcaacagagcaagactccatctcaaaaaaaaaaagaaggaaataaaagtcttctctggaactagaacgttcctatgtagacgtagctggagggggaggctgtgtggtttgcgccgtggccatggcaagacacgacgggcagcatcttcccactccagcctgcatctctgccccagaactcatgatggttctcctaggatggggctgtcccttccgcttgctgagacatgaaggacgggaagagacccccggccctcaccgccgcatcgcctgccttcctctgctgctccttagcaggaaacatgccggagtgttccctagccatccattcaccaattgcatcccctctctttatttttcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggagggtgagtcgcagagcgctaggtcttggatgctgtggtaatggggggcctggttgctggctttgccacagaatcttggaggaagaagctggatatggggtggagggtgctaccctggagacccagaaagaccggaatgcatgggggtgggggtctgcaagctcaggagaggtggctctctctgtctgatgggaacatgccaagatgccccaagcgggacttgaatgagagtttggaaagattttctgggtttcaaggagcctcctttatgggtcaccgtgggccttgctgggacctctgtctgctgtgtgtccctggagggcctgggaggcttagagaatgaggagccacgcaggaaccagggcaggctcatgcaggggtgtaggacagggtggagttgagacccctagaagggctgtcacattctggtggctcctgcttgaggaattgcaggctgcctggatatgcccagcagaggccgagggcttggggaagggaggagggacgtatgcctcctgaggcttgcattggagcccatggtctggtcctcctcccccaggagggatggttgtggcagagggaggggaacatgaggagcaccttagcctgcaggacaaaattctcagggcactgggaaggggtgcctggaccagggggctgtgtgatagctgcacacggttttatttgggggtgcccttctggcgagaggagagaggccatggggctccagcagcgtcctgggagggctcaagcccacagccgtgctgacatggagcttacaggcaggggattggtgccagtcctgtgggacacagggcctgtttggaaatgccaggctgtgggacatggttgggtcccttctcagaagcgtgccccctggccccagcagggatcgtggctccatggggctatagtaaggtgccagctgggttagaagcccctcaagagccaggtctgattctgggcacaggatcagaactcagtaatgctcagtaagccttctttaggttggacaaacagcacagtctgggtttttgatttagctgctgcttcttatttctaaccgtggtgaaatacacaacatacaatgtgcaattttagccactttgcagtgtacgtttcagcggcattcagtacattcacggtgttgcgcagctgccaccgctgtccatctccggtacccttttcatcctcccaaactgagctccgtccccgttagaccaagctccccatgcccctcccccagctgctggcagccaccattctattttctgtctttattatgaatttatttgaccactctaggaaccttgtgtgtgtggaaaaatacaataactgcccattttgtgtctggctcatttcactcagcatgacgtcctaaaggttcatccgtcgtgctgtagcatggggcagaatttccttcctttcagaggctgaataatattctgttgtgcgatgcacttgtgttgtgtagctgttcctccatcggtggacccttgggttgcttccacatctctctaagtccctctttccatcttctttgacttttctttgacttttttgagacagggtcttgctctgtcctccaggctggcgtgcagtggtgtgatcactgcttactgcaacctctgccccctgggctcaagtgattccccagcctcagcctcccaagtacctaggaccacaggttgcgcgccaccatgcctggctaatttttaaattttttttgtagagacaggttctcactaggttgcccaggctggtctcaaactcctgggttcaaatgagcctcctgcctcggcctcccaaagtgttgggattataggcatgagccacccaacccctttttggtttttctttttgaatgagagttctccagtggtcagtgggcttgggggctgggaggatgtggggcctggagagggtgtgggtttggggggagaccagtgctcctcatgctttcatgggcatgtggagtgcacatttgtcttggcgggtctggggcctgggactctgcatttcctacagagggggcatcggaacacactgagtagccagaggctagtgggccttggaaggtcctttccggccctcagtgtgcgagtcccgtgttccctctcccatctctctaagcttgactctgaagagccaccctgccccagccacccagactcagtgacagtggttgctggtggcatggtgtcaggccaaaggcatgggcagtttgcagagtggcaggaggctgtttcctcccctgccttctgttggtgcaggacctttgtttgacgtgccggatacacccccatcctgggttgatgtgttcacactcagctgagtcaaacaggatgtggctggggaggcggttgtcaccgagccatctaaatctcggtgatggctggtgctggatgcacagggacgtggtcctggctctgggggacaggtagggggatgtccatggggatgtacaagaacattctcctccaggggcagacacagtttagcccctaaattgtgccagagactgtgccgggagccaggcccagggacacaacctgcgggctctgctttctggagctcaccgagccgtgagcaggatggctgggacacaaggagtgtccagggagcttccccagcagtggaagtacaatttcatcaggccaggaaggggagagaaaggcaggccacgtggaggcagcagcgttcagagctgccaggaacctggcgctctggggggacggtggctttctccatggaataggatgtacacgttggagccggggcatgggagaaaaccatcagcatcccagacccggccacccacggacagggacctgtgcaggtgggagtccagctcacgtggagaggtccgtgggctgggctgacagtcctgagggcctaagcaagtccaggtggaggaaatgcagggacagacgagggcagggccttcccaatggaggagtgctcttgaaatccgatgggagtggcttctcggggggcccaggcctgagccccactagttcttcctccgaggcaccacctgcttgcttctccgtcctccctctctgtgtcacgaccgttctggacacggatccagttctctccaactcagcttcctgcccatctttccttcaggcccatccccttctgcccctccatgtggggctgggctgggagttccctgagccccgacatgcacagctctgaccaatctctgcggcccctctgtcccccgagcaccagggatccagctggcaccatggggaaaggaatcatggagggagttccgtgccctctgagcagacgcccagccccttggcttctgcctgcgggagggcatctgtgctgtggtttgtctccaccccagagctgtgggtgcagggcagggtctcctggggccccagctgaattgctcccagactgacttccccaaagcacagcactgctgagatctcttcccgtgctgagccttctctgctcactcaccataggcccctccacggttgattcactctcctgctcagctcacacctctctccttcccagcttctcctgctttggtcttcccttggtctctcacacctttcctcacaacccctttgccctgacctcctgaaccctgacctctgcttctctttacatcactgccttggtgaactcctatgcatccctcaaaacctggtccaaatacctcgtgtttggcttgggatataaatgatttgtgtataaactttctttcctctgctagacttttttttttaaatgtgaaagtagtttttcagatcataaaaagtaatcgagtaccctttctttaaaatgcaggaagtacagaaatgagaaagaacctaaaattcacctgtaagccagcgatatccatgcttgaggttttgctgtatagtcttcaaaattcctttcatgcccccactagattctgagggtagggctgttgtctttgtttttttttgtgttttttttttgttttttgttttttgagatggagtctctctctatcacccaggctggagtgcagtggcatgatctcagcttactgcaacctctgcctcccaggttcaagcgattcttctgcctcagcctcccgagtagctgggactataggcgtgggctaccacgcctggctaacttttgtatttttagtagagacggggtttcaccatataggccaggctggtctcgaactcctgacctcgtgacccacccacctcagcttccctgacctcccaaagtgctgggatcatgccaccgtgcccagcctgtcttggtttttataaagaatcccataaggggccaggtgcagtggctcatgcctgtaaatccagcactttggaggccgaagcaggcagattgcttgagcccaggagtttgggactagcctgggcaacatagagaaaccctatctttacaaaaaatacaaaaaattagccaggcatgatagcatgcgcttgtagtcccagctactggggaggttgaggtgggaggaccacctaagcatgggaggttgaggctgcggtgagctgagattgtgccactgcactccagcctaggagacagagtgagaccctgtctcaaaaaaaaaaaaaaaaaaaaaaaaaatcccataagataccaagtaagtgacttggacataataggtgtgccatgaaattatgctgaaggagtgagccactggtggtgagttgggatggcttttttgtggttcttgtaggcagatgtagtgacccccatgggtcgtccctagagaccaagcagaaactttcctggtcaactttacccccaggacacctggtctctcctctggaggttgtgctggagggctcagtgggtgggtgttggcttcagtgtgggggttctggaaggagtcagcatttcaggagggagtgtgggcacctagatggttgaaggggagggagaggaagagaggcgctgcagagggcagaggcatccctgcctgctcctccgccccagggcctggtgaggtctgagctttatgctggtggggtggattctcggtttccgaggctctggccctgcccctggacttggcaccctccttgctgtcctcccacagaagggcgctcatcctttggggtcatccctggtcctctcaggctctgggtggggacggccttgcctcctctcctggatccctgctcttttcctgccccccaacatgggtgcctctgggtggagtggggtggggctgggctgcagcacccagtactgagcctgcaagggctggctgctggctcagagccccccccaccagagttacccccctccggctcctcagccacaccagccaagtttctccagagctgccttataaggcgggtgctcagcgctcgttcatgggtctggttctctgccttcttgggatgctcactgggggcaagagggaggccaggcccagtgcccagctcagttctgggcatgtcccagctctgccccatgagtcaactggttctgaactatcattccacccctcccagcctcaatttcttgatctgtcaaagaggcatctgcagaggtggctgggggctgagctctcatgtatccacccaccccaagaaccaagaagggagtccacagtggttctggggccacttgtgaacatggatgtgaaattggggcggggtagacatggcagcatgtctcagtagttttcctgtgacccagagggtctggaaatctttgtcatgtgggtggagcgttgagggagcagggggtcaggcccccccgagctgatgatggtgggcgtggctcttcgcatacttggtccgcaccgggccgtgtgttccaggggcagaacagggaggaatctcagcacagacagcagggctgccagtacagcgttgagtatagggttaatcaaagcacagggctccctggaaccacccaacacagagcagtgaagaggtggctttggggaaagtggggtcagagctgagcctgagtggggggtggggagggcgggcatcagcctgcaagggagggacacctactgggccccagaagttcctggtggggatcagggactgtgaagttggggagagggtgaccactgtgatttagggaggaagggccccatagacagcccagcttctggccccgtgtttacaggacaccccacataggctctgagcctatccctggactgtggactccctgaggcagggtgtgcaggttcgtccagtaccaggtgtaaggcagggggccttggtaagcgtcgagggactcactggtgtctgatgaagcagtgagtttggatcgtgtcatgcctcgggtcctgagcctgcaggatttttctgtggggctgtgtgcttctgcttctggaggtgtccagaaggcactgacgttcctgccgggatgccttactcggaaggtcccgctgctcccacctcctcccattttcctgagctgcttgcagagggcacccaggtccccttttactttgggattgggtctctttctctttccccttctaagaacaagtaccctccttctccgaactgtccctggagcctctcagacctaggtctagagtgggaagtcccgcatgtgctgggggaacaggaatcaatgcgggaggattggccaggcccggtgtgtctccttcgtggtgggacggggtggggccagagaacagagcctggctccagagcccaggaagagaacccctcccctcgccggcctgccaagcaccgtgcagtggtgagaggaaaggagggctggtccgggaatgcagcgggtgccgagcagctgtggaataccttaaatagagcgcagctgcggggaagggtggggccaggaggcaggcgctgggggcggtttctctgctccgccccctgcagctctgtggccctgaccacccagcctggccccaggatggagccccggcccccagacacatggcactgggtgaggccgcctctcagcacttgtcccaggaagtcagagcagctgccagaagagagaggagctgtgtctgtacccgccgcctcccaggcccgggacagctgccgggattgagggtctgcacaatggcgagcctgtccggaggggcgcgccgcggccagacagccatgctctgtgcggtgtggacagagggcacattcagccctggaggagcgcactcagactccccgcctcggggcccaaagtgtgggcagcccctaaccagaccctggattccagcagacagcctgggaggatgccatgtggtccaccctgacacactgtctcacctgtgacctcatttctgagagctgcagggaggcgcttcctcagttggactccacttcctctccggggttttctgtgggtgttataagtgactctgtctccttcagtccaaggggggctcctggggtatgggctgtaactgacaggctagagtagcccatggccagggctgagcttccttcccgttctctctgaacactgggcccaggaaggggttaaagtggagatgctctgattaaagttgagggaggcatggagctcccctgaccctgtccccccatcccactgctgctactgggtgtactctgtggagccccaggactcttaaagaacccagagtggagattcccggtctcatccagtgcaggtgagggggaaagtgatttgtccacagttacatggctaccatcagcacacctgggtcaagctcgattccactccacggcccctgtctgaaacctggaactggaaatggccctggaaatcactgattccatctgccgccttccaaaatggcccgcagaggttaagatatagactcctgtaatgccttgcccactcgtgtgtggggaaatggcagaggagcaccggctttgccctcacactgcctgggctgccgcccctgccctgcctagtggctttcctctctggtccgttttctcattgtggaagtgggcacaattcttcctgtgcagcgtggttagagtggacagtgatgattcgtgaagcagggtggagcgcctgggggattcgtgttaaacaagcacataaacaaaagccaacacaacccttacttaatcagcaagcaggccttgtctgaagcccctgggcagcacctcatgccatccctaggttccaggccggtggtgtcgccccgtgtctctctcacccgcaagctggtgtttagaagccctgctctgtgttctggctcccattctccctgtgacctttccctttcttcatcctaaaaagcaatgcacgacggggcgtggtggcgggcacctgtagtcccagctgcttgggaggctgaggcaggagaatcacttgaacccaggaggcggaggttgcagtgagctgagattgtgccagtgcagtccagcctgggcaacagaacaagactcccatctgggaaaaaaaaaaaaaagcgatgcccagtcattcttagatagaaaatgaagatcacatgaaatttggaaagaagtttttctctcccattccccaactctctcccaaggggtggccatgttgacagctgggtgtggcattctcctgaattttattcctgcagagtcattcagggcttgtgtaaaaaaagtcaatgtgtaaatatagacttttcaagaacacaaaggaaatcagacttctgctaccagcttttattttttccatttaacaacactgttgccacttgtagatgtagcacgttcctttttctttttctttttttttttttttgacagagcgtggcccaggctggagtgcagtggtgcgatctcagctcactgtggctcactgtaacctccacctttcgccttccgctttcaagcgattctcctgcctcagcctcccaagtagctgaaatcacaggtgcttgccaccacacctggctaatttttgtatttttagtagagacggggtttcaccatgttggccaggctgctcttgaactcctgaccttgagatccgcccacctcggcctcccaaagtagcacgttccttttaatggttgtgtcatcagctgtcccatggccctgccaggcttgtccagcttcccactgtgattgagaggctgcaacagatgttctcgcacttgtacatgtgcacacatgactgaaggatgagctcttagtgaatttctgtgtcaaggatgtgtgcatttaagttttgatctgctgggcacagtggctcacacctgtaatcccagcactttgggaggccaaggcgggctgatcacttgaggtcaggagttcaagaccagcctggccaacatggtgaaaccccatctctactaaaaatacaaaaattagctgggcatggtggcttgtgcctgtagtcccagttactcaggaggctaaggcaggagacttgcttgaacccagcaggcagaggttgcagtgagccaagatcgtgccattgcactccagcctgggtgacagagcgagactccctatcaaaaaaaaaaaaaaaaaaaaaaaattgatccttgttcctgaattggcctctaaagtggttactagaattttttaggacccctcccctcgtcgacctgctcagctgtctgctgggccctgtgcagtgatggtccagcagggaggtcctatgccccttacccctggctgagggccaaatgctctccaattggtgttttattttgtgcatctcggtcaagcgagagggattatctcttcgtatgttataggccagggccctgtgttctcttttcatttggaaggtgtatccttttcttgttgaaattttttaaaaagagttctttgtaagccaggcgtgatggctaacacctataatcccagcactttgggaggctgaagtgggcggattgcttgagcttaggagttcgagaccagcctaggcaacatggcaaaaccgcatctctgcaaaaattagctgggtgaggtggtgcgcctgtagtcccggctactcgggaggctgatgtgggaggatcatttgagtctgggagtttgaggctgctgtgagctgtggtcataccactgcactccagcctgggtgacagagtgagatcctgtctaaaaaaaaaaaagagttatttgtacatctttatcacagcaggtacgagtatcttgtccccagctgcctacttttgattttgtttctgggatgttcttctacacagaacattttaatcctgatattgtcaagtctctgctttcccttttagcttttggaattcacatcctgtttagaggtctcctgcgttctgaaattataggaaagaatttcacccacgttttcttctagtacttctgtggtttcatttttacatgttgaaatcatgaatccattggaatgtattttggtttcagcagcgaggtaggggtagatggtattgcttggatacacagcagcgagcttggtctggagcgggtggggcgtgtgtgtgtgtgtgtgtgtgtgtgtgtgtgtgtgctatttttatcagttttggtgtctgcattgtgctggcttagcaaaaacaatttggatgcatttcttttaccctctgccttctggaacattttaagcagcaacataataatctctctgttaaaacttttcaagaattcactcgtgaaaccatctgagcctgatacttttgggggagtctagcactttaaaaacttaaactttttccatgggtctgtgagtttgggagtttttctttcttcttaaaattcattactatttttttcctagaaaagtgtcttttagcttatttaaaatccgtcagcttattccgagggggttgctttagctcgcttagtgaggacagtgtgcagcgcggtgattgacatgattgatcagcagagcacgatcgatcagtcggtgtgcaaacatgactgactgtggccagcgtcctgggatgctccatgttgaggcacatgtgtgcagtgcagggtgatgtgtattctgagaggggatgaagccacaggacccctgcacccttaggagagagcccccctccccaaggctgcagtcttgagtaggtagtgacgggactgggtctagggggctgagtggtcccagcaggccaagggcttcaggaattatgagaagtttggagttgcccagagagcagctttcaaaaccagtctggactgcagcctccagaaagacatgcgattgacaccacgaaccaggacacacctatatatggggtgggggtggggatgggatgtattaatgaaaccaaatttccgtgatggaattcttacctttaccatgcgtgtgctacactcagtattttctttttttttttttttttcccctctctctttttttctttttgtttgtttgttttggagagagggaaggctttttttcatttttttttaaacagctttattgagatccaagtaagctactatacaatccaccaatttatttatttatttatttttttgagacggagtttcactcttgtcgcctaggctggagtgcagtggcgccatctcggctgactgcaacctccgcctcctgggttcaaccaattctcctgcctcagcctcccgagtagctgagattacagacatgtaccactacgcccggctaattttgtatttttagtagagacggggtttctccatgttgaggctggtctcgaactcctgacctcaggtgatccacccgcctcagcctcccaaagtgctgggattacaggcatgagtcaccgcgtggcccaatccacccatttaaagtgcataattccatggttttcagtctattcagagagtagtgcaaccatcgtcaccacaaccaattttagaaaattgaaaatttgagaaatttagaaaatttttttcttaagaagaaaccccgtagcctttagctatcaatcctgccctcctcctccatatttccttcctatctgtgtggattctttttttttttttttttttttttgagatagggtctcactctgtcacccaggctggggtgcaatggctcaatctctgctcactgcaacctccacctcccaggctcaagccatcctcccaccatggcctcccgagtagctgagactacaggcctgtgccaccatgcccggctaatttttgtattttttgtagagatggggtttcaccatgttgcccaggctggtcttgaactcctgggctcaaatgatcctcctgccttggcctcccaaagttctggaattacaggcgtgagctactgcgcctggccgattctagacatttcttgtacagagaattgcacgtttggcctttgtgtctggcttctccacttggtgtcatgtttccaaggtccatccacattgtggcaggtgccagtgcgtccctgagtaatattccaccatggcatggaccattccattgtggacagacatgttgccttcatcagctgagggacattgggttgctgccaccgctggtgagtgtattcttttcaaattaaaaaaaaaatgctggtcaccacccactagatcgttttcttggcccacagggtgggacaagccggcctgggtgagggccaggaggtggccaggtggaggcggctggagcggccctgggttgcctctgggcgcagcaggcagaggtgcaatggcagagtctgagcaggttccctgggcggatctccatgccggtaatgtttgtttattcaagaagtctcggccaggcgtggtgcctcacacctgtaatcccagcactttgggaagttgaggcaggcagatcacctgaggtcaggagttcgagaccagcctggccaacatggcaaaaccccgtctctactaaaaatataaaaattagctgggtgtggtggcgtgtacctgtagtcccagctactcggtaggctgaggcaggagaatctgcttgattccaggaggcagagcttgaacctaggaggtggaggttgcagtgagccaaaattgcgccactgcactccagcctgggtgacagagtgagactatgtctcaaaaaaaaaaaaaaaaagaaaaaaaaagaaatctccagtgctgccctgtgcccggcaccgaagccgagggaaggcagcattagtatgagctcccagcccaccgggctcctgtctggagctgacgtgcgaccaaggcacacgagggaagcatggcgaggtggacggtgcggaggcataaggagcaaaataaggcagatgcagtggctcagtggctcctggtggctgcgaggagcgtgggcaggacagccccaggagggcacctggagagcagggccggctggggcaaggtgtgtcaggcacttgtcaggagcaaaatgtaaggggacaccaaagagctcaggaatcaacacagatagtatttaatgcagtatttttcaatatcgaaatgatgcatagtaatctctatgatgaacaaatgttggaattttaaattaagacaggcccagccctgcacgtgcacagccctgtcagagtttgttcagcgtggaatttgatttgtttaaaatgttgcttcaaaatattgtttgattcctggattttttggcactgccttaacttttgcacctggacgaaggcctcaccctaatcccagctggagagggtcaagggctggtgaatttggctttggacctgcagagcttgtggtacctgagaggtggggccaggaacaggaaggagctggtgagaacggcacccggtatgggatggggccagatcagagcagcactgtggctctttccaacccgtggttttgctgctggatgcttggcgttggtgctgagcccccggccctctgaacggagtgtgatgaataacggggccggggagctcttgggcccctccctgaagcagcagtgaagccagggacatgccggcagcaggcagggagagggacgtctggtctgtgcctggagccagctgccccatggaggagctgggtgaggatgcggtgggaggaagaccttcccagtcctgcatcctccgaagcataactgagtgcttgtgtggcttgggggtcactctggtccgaggacagtcttgctttgcttagccaggctttgaagagccaccgggatacggacagcagccctgctgggtggcaggttgtccaccctcgcccactcaacgctggaactggatgcagagcacctggatggccagtcccagagtgtctctgacactcccagtcacctcatcccttagaccaggataagatgcgggatcccaacctcgagcctcccatgggctccattccatgtgctcccataagccactgggcccacctcctggctccagggctgtctggccatttggcatcttggtttcctcatctgtacaatgaaaataatagtcccagccttctcgaggagttacaagatgcctttcgtgtgaaaaactgggatttggtaccagactatctggatttgaattttggccctacccctcctaacctgtggctttgggccaatctggcctccctgtcctcagtttccccatttatagagccatctcattgagttgctgggaggatgaacataaggaagtgtactcatgtgcccagagcattgtgattttacttattattaccaaacgaggcacacaataagtgcctaatagatgctcagtgtcatttcacggattctgtgtgccttgtgtgtctccagcagccaagctctggaggtggggaagctgttgacgagttgcacgaggtaattagaaagaggaggccacaggtgcaagggtttgggtgacacctgtggacagagagaggccgatggaccctggcagaggggaagggggcccttgcacatagaaaatgtttcctgcatccaagatccttgtgactctggaacagaggcagcagaggtctgcaaattccaaatcataaacccagaaagcatagaacattcgtagagaggaccagaaacatcatatatcttagtgtgtatagaattttccacatagccaaacaaaagcacgtttctaactgaagctgttggagagttcctgaggactttataccagacaagggccggtaagtggaagttcaatacgcaggagccattccttttgttcacaaatgtttgccgtcttttctgtctatatccgcattcatgtgagggcactcataggtccaccgtccagccccatgctttgtttgctaccaaaaaatttcttaagaattcctcagctgcaaatcctcctaccggagggggggttccaggaacccagccttgctcggggttggggcacctcagcacctgctgcacaggcgttggtcattaaaggtcatgtgccgtatccgtgggccctcggggtctggtggcacctgggcacacagtccagtggcggcctcctacctgccagacactgggagtggggggctcctcattcctgttccctggcggtggggggagtgccccgagctgtcacacatcagaacccaccgactcacacgttgcggcaccttacagccccttgacagcctctcagcctgagagaccatcaaactgagttcctggagagggtggctgttgaggcctggacacaggtgtggacaggatagccctgcctcatctcggagtcccgctccggttcagcctcttgtgggtctgaagctcaggctgggccagtccctgcccctcagatggccggaaaggcagcccagccccacggcctccttgtcaggctctgagagccgcctggcctccagctctgctctttttttttcttaagatggagttttactctgttgcccaggctggagtgcagtggtgccatcttggctcactgcaatctccacctcctgggttcaagcaattctcctgcctcagcctcctgagtagctgggactacaggcgcgtgtcaccatggcaggctagtttttgtatttttagcagggaccggttttcaccatgttggccaggctggtcttgaactcctgacctcaagtgatctgcccacctcggcttcccaaagtgctgggattacaggtgtgagccgccacgcccagcctccagctctgccttgattttctcttaaggccgtgaggatgtccacgcctcctcctttcctcacggcccattgatgtctccagatgctctgcaaagccaccctcccctcgggagctccccagctggtgacgggggaccttttggggatcactgcccaggtagtcatgtaggtctgtgggccgtgcttccaggctggaccgagacccggtgcatggggtgcttctggtctgagctgaggcccctggaagccacagccaggaggcagcaagggacggctgtcatgtcccctctcccctgtctcccagggtccctgcgggacagatttccctgcctgagcctcctggttgcccataccctggcctcccaaagcccagcctgaagccttaggcaccctacaacctgcttcctctagcagcctgccctgtctcttctctgccgatgttcctgaaactttcctgcctctccttacctcttggccagagagagactggagaccctgtgggaacccccgaggggagggagaaggccgctgtttgaacggaggtggtctttccctctgcccctccccaggcgggtcacacttgcaggcccagcctcctgctgtggcagcgcttggggtgtcggctgcctcctgggcacgagttgggagctgagggaggcgctttcaggaccggagtggcaacccagctggaggaggagtaacaggcccgtggtcagcagcagccgccgcagggaccccggcgctgtacctgtgccccagctgacccctcccgcttccctagggtgggccggggatggtggtctgttgcccagcccaggaagaagaggggccgtaatcagcagcagccacctcaggggaccccagcgctgtacctgcgacccagctgacccctcccccttccccagggctggctgggaatggtggtctgttgcccagcctaggaggaagaggggctgtggcttccactctagaggtctctctcccggtccctcccccggtgctggtctaactgcaggcctgccttaggccgtgccggcacctgctgactgacgcttagcggatgctgataggagagggctgggatggggaagcagcaagtcccggtcactgtgggctcgggttacagatggttgaggcacctcctggccatccccaggaagcaaggccccacgcagcctccgactcacccactgcccgtgtgtatttcaggaggctgcatcccccaaggcccccaccaggtaacttcattgggctgggtgtcgctgcaaaaccacccattgggtgcggtggtcttctggtggggggcatggctggggaggatgcggtggaggagaagccagctccgtggttggggggagggcggactatccgtttcctgtctgtcccctgaactggagctcatggtccctcccccaggtgcctgggccatggaagaggtcacagccctgccttattcctgtggcagcctaggggagccctggccagtcccgtgtctcctgggagggcgacagcctggtcaggctgcagggcaggactggaatgcagacccctgcttggccatgctgttgcctggctgctctgtctggggaccttctgttcaggaagagagaagcgggccggacagcccggctcagtgattggaagctcagctccccatgttcagtccagcaggaagtttgcctcctcggaacacttgcgtgcttctgcatgtgtcttcttggctggtggttctgcgaggcccctactgggctgcgtcatgtcctctggccaccctggccttggtgcctggcccctgtgaaacagagatacctgggcagtcccccacttgtgcttgcaagcctgtgtggcttcagtgatggctgattctgctccacccagaggacctgggaatcctcagcccaactgtccagaggagtctttctcagtggggagagcctgagctgtcctcctggtggacagtcctttagatctcaggcggacttccctgccggccgttcctcctgctgcccctgctcctctgtcccccatctgtctcccaccctctcccctgcagcagccagctggcacggggacctccccttccctctgggattgtgaatgagacgactttcctggtccttctgggtctagatctttctggcaacagtcagtgaaacccttgtctcaggtgggaggagaaggctcagtatgtggtcacaacaacggtcctaaccacatcactctcaaacgctggctttcacttaccccttgccctgcccaacagttactttcatcatcccattttccagattaggaaatcaaggcgcagagagcttcagccacttgcctgaggcccccacagttaagtgtctggatttgaaccctggagcagcctggctgctgagctgtcctggagacggggtactgtgcagtggtcggggtaggggtggagctctgccgtcgctgactcccgggctacctggagtgataacacagcccagtgtctgggcccctgcctgagactttggctggatgccaggagcccgagaccttccagctctttcctgtgtaaggcgccatggggtgaaatgaaagaaaaccccagttagaaggtgtccccctcttccttcagtccctcagctgccctggattttgaaataagacaccgcccgtctgtggggtgagcaggaacagattggaaccgcatttctctccccccagtcacagctgccaggagctcatctttctctgtctcctccccctgccgcctctccccacaagactgggctggatgctgctgggaaagtcaacaggaagtcttttggctgcggtggaggtgggggtctgtgcttccctggggaccgagatgagggctccaggttggctccggcaagagcagggaggctcacgtctctgcctgctggttttgcttcctgtcctgggagaaggtatccacatgtcccagaatgcaccctctgcgtgtacagggatggcttttgggccattcacctgaggtttattgatctttctctttggaactggagtggctcctccacggtggattgggctgagctctctgcctcggccgacgtctttccccaggcacttcctctcaccgtgccagggtgcaggttgctagtggatgggtcttcaccctcggggattggcagctgccacgctcatttcacagtcgagacaccctggccgaaggttctgctaagctccatggagtgtagggattttttttgagacggtctctctctgtcgcccaggctggagttcaatggcccaatgtcccgctcactgtgatctcgacctcctaggctcagcagtcctcccatctcagcctaccaagtagctgggactacaggtgtgtgccaccatgcctggttaattttttaattttaatttttttttgtagaaatggagtcttactatatttcccaggctgaactccaactcctgggcttaaatgatcctcctgccttggcctgccaaagtgctgggattccaggcatgagccattgtgctcagctggggttttcctttaacccttcctggcccttcccaggtgcaggacccgggcctcagccttatgtgttcttgaacagctctgggctctgtcctgtacctcctgggcgcgtggtcaggcctctcgtgacatcagcaggagactcaggtgaagaagcaggcagaacggaatgcttgctcacccagcctcggggccaggcggggcggccaggacagtagcagtggctggtgtggcttcctgggaggtcagcccattggcgtggccagcgaatggggaggggagcttctccccttgtctcccctcatttctggtctctgggcctccagggccaggtctccagagttctaggtggaggatggaggtcagggaagctggggtaagagcgggctgggggtgggtggtcaggcggatcctggaaaaccatcctctgcaggtcccgctttccccagggagcactcagggctggtcccggggagccgggctaatggtcacctcggatggtgcaggggtccatccccatgaaaccgggcccatccccatgaaactgggcccacagaagcttttggttccggttctgttctgccccctggctcttgcttccaaagtaggactcaggatagctctgaattccctgccgaaatgcagcttcctgggccctaacccagccctccagaaccagagtctctggggtgggccctctgcttgtctagcagcctccaggggacacttgtgcctgccagagcaagtctaataagcactgctgtaaacccctcgtccccacagccttctggttcgtctcccttttcctgctgggatctgcatcaggattaaatgccaacatcagggatcaggttatacttgtgaaccctgagacaatacctgcatctttttttttcttgaggctgtcttgctcgctctgtcatccaggctgaagtacaatggtgtgatatccactcatggcaacctccacctccagggttcaagcaattctcctgtctcagcctcctgagtagctgggactacaggctcacaccaccacacctggctaatttttgtatttttagtagagatggagtttcaccatgttggccaggctggtctcgaactcctggcctcaagcgatccgcccgcctcagcctcccaaagtgctgggactacaggcgtgagccactgcgcccggcctgatacctatatcttgaccaagctgctgtggaaacattgagttccccttgatagttttgtccacagagtgaatgtttaggaaccggcgaggcatctctcacccccacccagatggcggcctggaggcagcgtttctgaccctgtgatgggatttgtctctcttgtccaagagactttagagatgtggcccctgaatgtgggggcccctgttggggtgggaacgggagctggccctggccattgtccagtgaccccatctcagtgcctcgatcctagcaccctcgatctcagcgcctccccttccccggctccgcgcggagatcacgtggcttgcgctgagcaatcctccactgcccccgtcgcgttcctgctgcagggaagcctttccagggagccagctgacacatttggcctccattatttgtttttgaacaggaatgaaaggagagagtgagtaagaaagtggcaggaggtgggggttgcagagtaggggaaggtcagagagaggggaggaaagatctggaaagtccaggcatgtgctctggaagcaggtgccagcgatgagctcatctggagggtggccgcccgccctgagccctgcctggggccagcagggaacactctgccagggcatgtcgctgggagcctgtccttggctcactttctgctgctttgagcgctgagcagatttgtttccattttagggacaacgcaaggaggctgtcattccacccctcaccttattaatatttcatgaatcataagtgaccacttactgcgtcctgacgtactccaggcgctgggctcgaagctttatgcgcttcatgggatgtatctgcactatcgccgtagaaaacggttcctgttactactgcagagaaggcaccgaggcacagagaggttgaggaactggcctcaggccacacagctagaagcggctgaccctggctgtgaacacagggctgcttgactccaaagcctgagctggtttgcagcgaggctcatggtttctgtgccactgtttgagcctctggtcgagccccttggctcagtggggggcccagtgacctaccagctgttccattatatgttgtggacacctccacggcccacctgggtgggagggaaggggcttcaggaggtgggaggggtacagggaacacagtccagcctgcttgggcccaataccttgaccttcaaggtaccccttgagggtagcatgaggctaagctcttgttctcctccaggactctgttcctgtgagggcctcggggtcccttgcttttttctgggggccttgctggtcaggatcacagagaagctctttgctgttgatctttctgcctctgtatcttttggcaagccattttatgactcagttgctttgtctgtaaaatgggttgaataacattgtcctgcctcggagggtttttgggaggatcaaatgagacctgttgcacagaagccctttgtaagccatgctgactggcggtcgccgggcccccaagtgaatgggcatccgggcactgagtgtgtggactcagtactcggaaggaggggctggggggtacctagaactcctgggaggcttggacccctgctctgctcagattctgagcttctccttggccagtttaattcccatcagtagggtgagggtaaccaggacttacgcatagttgggcgaagtcgagtgaccacatgtggaagtctagcgtccttcatgcaaagtgggcaggcggccaaagtgagctctgctccagtccccccacccccggggctgttcctggcgccctgccctcccccagagccccactgacctgcaccatgtgacccgggcctgggaagatgggcccagctgtgggaggtcgtgcgggctggggactgagagtgccggaggagggcctcccaggaaaacccagctgcacaggaagccgggccagcggcctccggaagcctctgggctttgcaagctggactccccagatctgtggctgtggggccctctcctgcctgcagctgagagcccttgacccgcacctgagggcttcagaggtccgggagggggatgtgaccgtgtccccagggtgaagcccacccgagtgtcactctggatacagccctcacctcttcctggccccctctctggtcatggggacgctgcctggggggggttcccttacatggaaggagctgcagctgagctggcgggcctcgcacacccccaaggccgcctgacttccagcctccaagtggggttgcattcaccactcaggacctggagcctcagccagagagggaccctccactgcctctttctctgtctcttgggaaaggtagggtctttgtgccccctcccacccagggacctggcatgttgggaggctaagaggaagctgccccccgctcatctaccccccaaccctcccagccagcagagttttacctgtgtgcttagaatctgtgcgtggagccagaagtcacaaggttggcccagctgtgtctgaccctggttgtgcggtcttggacagtcccagccctcctggagctgagcatcctgatctgtagaggagaggctgctgtgccggccccgcagggccctgtgcagaggggagtgtgtgcggctgtgagttcaggccatgccctcagactggaggataggatcggaacagtgggtcaggatggccagagggtcccagcctcaggaggaggcctccacacctcccagcacctccacaccaggaaatgcagccaggcccccaggcctcccatgtcaggaagcagcaccccgccccccacctctggttgcctgggcctgagaagttgagcactcctcccgaatccgagtgccctctgacccctgcttgggtagttgtccctcctgaactgaccgcctgtcctacacagtcccctgtggtttgcccgacagggtggccagcgagtcccctgcacagcacacctcccccaggagtgctgcctgtgatgatggtgtaaagggtgcccccccgagcccccggaggcatgcagtggcgcaacagcgtgagcccaggagccccggtgagctcctggatggagaatctgttcagatcactccccagcctaaaccttccctgggtgtctgctgtgcttggggcgctgactcatcgtggggcggcctgtgagaccctacgtcacctggccactcccctcagcccctgttcactgcaccggtcccctggcctggctgctcctggaacatgagggctcatcctcacggaagaatattcacttgttccctcctggaaagtccctccctagacctcctggccgcctcattcaggtcttgctgaagcgctgccatcttggagaggcctccctgtcacccgcagttaaaacagccctcccatgcctgtgggtggctttctatggggcatggatgagtattggagagtcttgccgtttatttgttcatatgccctctgggagggcaggggacactgacttgtgttgtgggtgccttgcatgtcacgggtgctcagtgaatgcctgttaagcattaggggagcacaaaggagggaagcctctgtccaactggagcagtcagggaagacttcctggaggaagtggtatctggtctgcttagaatgtggcgatttgtctgtatgcagacattagattagagggcaaaggccattatcataacttagcagacagctacaagcagctaaggaattgctatgacatggactgctcgtgattggagctaagaaggagtcagagacagaggtccctgtgctctggcgtgagtccttgggggaggctgagctcccagaatgtggggccgcctgtgcagaggccggaggtgggagacacacctgtgagtgccggtgagtgtggggtgagccactggggctggatcagaagatgggaatccctaaacccaccaaccagccttggtgccctgggagtgacaggagacggggcttctgggggactaacccagcacaagtggacgagatgggatgcaggggaaaggacaaagctctctgaggctttgggaagctgagttagggtagagccatgacagggtgagttccagaagcaacacaagaaaaaatagctagactgggttttcccttcactgtgggagatgccccacctcacttcccccgtcctccgggctctggcaatgggctgggcacagtgaatgggttccatctgcaggagtggtcacaccccttgggcacagctgcctcatacactgtattgagatgggatccgaggccgggaagaacagcttcttctgtaggttgacattgtcagccttcggggagggaaggacggcagggggcctggagcatctccttttgccatccacactctgtgcctgcctgcagggtcttgagccctgtctgttctgcctcagtcctggtcaggaacttgttggagcccataggggcagtcaggctggaacaggaggagaccaggccggcaggggagccgagagggggccctggacagcacccagggctgagtcatcctgggcctgcccgacttgctatttggagctgttcccgcttgctcatcatgtgcaaggtcctgatccactcgggtctgtttaaccagcgcccctccccaggcccagttagcctggttttcgttcgattcatttattgtcatcagtgccatccttgcaccacgtaactagcctttgcagcatgccagccaccaagctcagggccctctgtgcatctcctgtaaccctcacagcaacccgggaggcacagagaggctgagtcgctggcccatagtcacacagcaggtatggggcattgccaggatttagccggatctctgactccagggcctttccagggccttgggtgggacactggcaaggaagcaaggtatgaacactggccctgccttggacagagctcggggacggtggcctggcaggcccagctgacacagtgaccctggtgcaggttcaaccattggcaaagtgttcaagtacacacagaatctcaactggggagacaggcgaagcggtcaagggagggctgtgagtgacaggtggacactgtacctactggcagatcagctgaccttggtgccttctggagcctttcaacttccttatccagaaaaagaggaactaacagttccacccccaaactgggtgggagtaccacattcgaaattgaagcaaagctggtcgtgtcacaggctcggcagatgttagctgtgcaggcaacttagtgaccatttgaagtaggctgtgcggcggcatcctcatcttgcagatgtagtccagagaggttagggcactaaccctgggtcacacagcgacagctcaggctacagagagcagtgctggatgggagggtgttggcagcttcaggcacaggctgggagggctgtggggtcagcagagggagggcacacttcccagctggtggggttcccttgtgcctcagtactcatgtgggcccaaaggagctggaaggagggaggttagagccacccatgggttcagaagctgataagcaggttattgactctgaatttgcctcatcgtatgtaaattggggacaaatttggggatttaatgatataatgtaagaagcagacatgtcacagccctggttatacagtcagtgtataataagtggtaagccgtcagaggaggcagccggtgagaatgggagcatctcagcagccctccgccccctgctcctggttgcagatgtacctgttcttggctatttgtgccccagctccgtgtcctccggtgtgtgtgaggccaagctcctggggtggggacttgggggtgtgtctgcagctcctgaggccaagaccaaggctgaggccgaggctgaggctgaggccaccttggtgaggaggaaattgcaggtggagaagctcgttgaccgtgaccttgatctgaccgtaattttgatggtgccgatgccgtcagcacgcaggcctcctgccctcgccacgactggctcctgcagcccacctggctgagaggtgtgctggctctcgcaggttgcaaaatggggacatcaccgtccgcctgggctacagcgtgctcgccgattgcatttggggagggactgagggctgattgtgttgtggggatgttggcagagaatcagagagggcatccaaaaaggccaacagttcggtggggagaggaggcgcaaggctggttcctgttttctgggctttgatcgaaagggaacaggggacacatctggggacagtctccttcctggaggaagaagggcttagggtgctggtgtggagtttgcacagatggggataatgagctggagggtgctgggcaggagctggccagtaataggctgacgagggaggccctgctggctgggcctggttttcaagtgagcatcctgagctgcggggacccagggggtcttagagacctcagagctgagactcgggaccacagaggggtgggctgtgctcagggcaacacagcggatggggcagatgttgcgaaacctgtctctctgcctctctttctcctgctacagaactggatcctcccagctcatggctgtcaaatcctttagatgcttctgggttccatgggcgccttacactggcttccctgtaggacagcagaccctgggggttggctctgatggtattcaccatggggtaccccatgcaagcacagtgctttcacgcccagcctcccagcctgtggagtaggcctgtgtctggccagcctcactttgtggccagaggagggagacagtggttctggagacaggagctggcctggggctgccctcccagcccctgttctcccagctcatctccttgccttgcgggtgctggccaccctccccccgccagctccatccccagctttctctgcccgagccgtgacctgtcagtagggggcagtggaggccttgaaagtccttggagaggactttgaagcagtttttacaaatctgtccctggaaagtctctcctgtcacacccccagcggctccctccctcctaacatttttcctggggttgtcatgcagcggggggtggaggaacccactaggccgtggatagagcagagccatgttgacacaaaccctggctgaacccacatgctccctacagccagcggccgatcactggaaccagggaagtgacctcatagcaagggcccgcagagcagccatcacgcattcccgatcttggtttctggacccagctctggaaaagaagccagatcctagccacttggagctgcctagggaagaccccagcctggtgccggctgacagctcactggaacttttcatctgcttggccaggtgatgccaaggggcagaggttagaagtgctaagaagcaggccgagggtggtggctcacgcatgtaatcccaacactttgggaggccaaggcgggtgaatcccttaaggtcaggagttcaagaccaggctggtcaacatggcgaaaccccatctctactgaaaatacaaaaattagccaggtatggtggtgcacgcttgtaatcccagctactctggaggctgaggcaggagaatctcttgaacccgggaggcagaggttgcagtgagccgagactgtgctactgcactccagcctgggcaacagagcaatactccgtatcaaaaaaaaaaaaaagaagaagaacaagaagtgctaagaagcatctgtcttcctgattgaaaagcaatctttgctgggcgtggtggctcacgcctgtaatcccagctttgggaggctgcggtgggagagtcgcttgaggccaggcgttcgagaccagtctgggcaacagaggtgctaggggtagtggcgcttgcctgtagtcccagctcctcaggaggctcaggtaggaggattgcttgagttaggagtttgaggctgcagtgagctatgaccacaccactgtactccagctcctgggtgacaggatgagaccctgtctcaaaaaacaaaacacaaacaaaaaaccaacgtttatcttttgtgattttaaaaatcacacctacttgtgacaaaataattaaattagaaaatgtaaaggaaatgatcaataataattgcgtcctccagacaaacactgttaacatgttcacgtttccttctagtctttttctacatagacactcaatacttattaatttgttttgaactaaagatggttttctctgctttgtatgagaaccacctcagccaggcacggtggttcacgtctataatcccagaaagctgaggcaggcagattgcttgagcccacgagtttgagaccagcctgggcaacatggcgaaactccatctctacaaaaaaacacaaaaattagcctggtgtggtggcacatgcctgtgctcccagctcctcaggaggctgaggcaggagaatagcttgagcccgggaggtagaggttgcagtgagccaagatcgtgccactgcattccagcctaggcaacgggagtgaaatgctgtctcaaaaaaaaaaaaaaaaaaaaaaaagttgccacgttgtcacctctctcagggattttcatcctttctacttttcgcccaagacttgccctgtaaaaggatgaggccaaatagccatgggagggtggtactggatgttcaaaaaaatgtttcgtggctggcgggacttagaaacaggttggggaggtttcagcagagggtggaccccagctgggggtggggggcagcaggggggcccctcacatgctctctctgcgtgtttcatggggctgcctgtgaggccgtgtgaaccagagcccggctgggaagccacatgctacctggactctgacctttcctggcagcatgaccttagccaatacgctcaactatgttcccctctgtaaaatgggctaatagaaatgtccactcgagacatgatgagaaacaaaggtgttcatagagcaaagtgcttagaacggtcctggcatgacaggagcccacatgtcagtgctgccgttggcatcgtcatcatcacggcggcattggctgctttgtttctcccttgtccctgtcaccttcttccctcagcaggctctcattcacttgttcatttattcatggccgaggccccgtctgtgtcaggcctggtgctgagaacgggggtagagagatgggggctgtgccctgctccctgacccaagggttccctttgcaatgtgaagttcttggagactggaccctcaggctgttccaccagcccctcctcaggccagcttaacccttccgtgctcgttttctgagctgttagaggaagagagcgggaggaaggatggagtggggtttttgtggggactgagcggggggtgtgtgaggccctggaaatggtgcctgcggcactcacgcagcattagcttttgctgcagttgctgtttggagaatattcttggatttcaggacactgatgacagaaggtggaacgctttttctggaagccatcaagaggggaccaccgcggcggctgagcagagttgctgacttgtgagctgtggcctgaccacagtcactgttctcatgagcgaggccccctgtggtccccctcccaggaatttctggccccttggcaggggacagttcagggctgggggtgggtagtggtgtctgcaggccctcttggagtcagagaatcccctgtcgccgtggcggggctgttccctcctgcccctcccctcccgctgtgctctcagctgctccgacaggatgcttttggcctgagagacagaaaccccaactctgaatggcttcagccctcaagagaatttggagcttttttgtgcaaaatgagatgttctgagcatcgaggatgctgtgggggatcctccatcccaccatctccagccgtggtgtccctctcggtcacaggatgctgcagccacgttgcagggaaggagagcctcccttcctgtgagcctagggagcccctccatgcagccccttcactggccattgcctgagacccgacctggtggctcctgccccaaggagcagaaagggggttcgctaggtcagggtggggctgggtgcgaggaccccccccggccaacagggtctgcttaggtgtccgtcctgttggggcagcagggaagggacccacatgtggcactgggacacggagaggcttttgtgcctgtgacggccaaaagggatggcgccccagccacgttcccacccaccccgaggcccagcatggccatgccggaaatagcagcatcgtccccctcactgtcctggcttgctttcaataggccagaggggtggggctggagcgggcgtctgacctgtggctggatctagctgcccgtggacaggctgtgagtgaatctgcagaggaagggagatgggaatgccgggaccttctcctgcacctcccgaacccccgttccctgtgagttagatggggagtgcacccctgccctcccctcctgggtatcccctgcgccccccgccccaggcacttgatgttgcctgttcattttccctctctgcccctcccgctggcccttcccatatggtcctaattaggaccttccgcccgttggtggatgggcagagaggggagcttgctgtggggcctcccccgatcgggggacttcccagcacagagctttctggcctctgcagggacgctgtgtgtgcctgtgtgagtctggcgtgttagaagcgctaagctgcagctgttctgtgcgtttttcacatttctcacttctcaaaggccctgggtttggtgtctgtgggctggggatctgtgttggggtctccaggaggcccttggtgggagaggcagggccccttcccctttaatctgggcaaccttgctttggcctgctgtctgcggaaagtgccctaggatacggtggcaggactggctggggttctggctccaggcccagccccagcccctgtcagacttaccctccttgtgcctccgttcaccctgtccacccgcagggcctgcaggagcatcctgagagttggtagggtggcctgcccggcgtccgcacagggtctgctggtgggtggctgaggctgcggtgaggtctccatggctccctcgtcctgcacatccttcccttgttgtgttgtctcgctagcatatgagcccgtactgcctctgagtctgcagcctgttttccttaccaggtggctaagcagggtggcagccagggtggcagagtcccattggcctgcaggggaccctctgtgggctgcaggtagtcccctgtggttgaaggtgccctggcaggacctgcaccatgacccccgtcaaagctcacgtccaaggcatttgtgggcacccccgccccagacgtgagggttggcatcttctcttgcacgtgaagcaaaggcctgtttgaaggagcgtgtggaagcctgggtgtgatgaaggcaaggaccggtggctcacccctcttgcacctggaccttgggtggcaggcctggggccttcagtccttaattcaggagggtagccagtcgctggaactaagagtgaacttcagctgttgttgccatagctggagggaagaggggaaaggaggcgctgcaggggagcagagacctcacccttcctctgccgacatcaggctgccggtgctggacggggccctggcaaccgtggcaggagtggtgatgtccgatgatggtaacaagggcttcctgaggaccccgagctgtcttaagggctctttacctggagtaagtatcccctttaatcctcccaacaacactgtgaaattgattctgttgttattcccatttcaccgatgaggaacccacagcccagagatgttaagtaacctgcccaagcctccctctgagcatggcagagggagggtccgaatgcggaaagtctggcttcagtgcccccatccctaaccactgtcatttacctcttcggccagccctctgattgcaaaacctgaggcccagaggagtgcagtgacttggccagcttcgcacggcaggttagtggcagagctgagcagtgtctcccatgccctgattctgtggcttcttgaggtggctcacccctaaacacgccccccatggtggctctgtttcctcctctcctctgaacctgccagcctgtgctcaggcagggggagaagtagagcaaccatgccgggcgggtcgtcgtgccccagtgccgcctgccctacacctgattggcagcagagtggcccctccttggtgtggtctggaggtgccagtggtcactcatcagcacagcccagtctcacacatgtcactcccaaaggatgttgacacagaatgaagcagctaggggaggcggacgctttggcacgagggtggcgtttctggtaatccgtagtgctgttgtctgtggctgcctttggctggcatctcacctcctcctggctgtcctgcagccacctgagggaggtcagcatgtcgccttcatcccaggacagtgtgaatgcagcagcgcaagcttgccagcgccgcactgcgggatctggaggcctttgctcctgagccctgcctctgtgtaatccctaaagcacggacttcttaggggcttccattcctccacctggaaaaaccttacaccgtttagggcttgaggcagggctagagcatggagacgttgctggaggaccaagggagaactgagcgcgtgttctcttggcctcagcctcgtgtgtgtgtttatgcatgggtactttgccatccacactggcttccacggctgggtgggagttgagttgagctcggcggctgcctttccaccctgcgggcctggttggggagtgtgaggatgcctgctggaagccaacgtgcacgaaagagttaatggtggatcccatttcctcagccccctctccagctttcccagggaaagggcaggaacagagaggccttatcttcagaggaaggggtgggcggggacacagcgctgttcggcacagtcccctctgagccaccctgcatgtttcattccaccgacttctgcagcccagctgttcagagcggatccagaaggtggagagagggtttccaataagcagaggatggagtgaatgtgagattcattactgggatttggcaaagcaaagagcctcactttctccccgcagatgggacgggggcggggctggagccagcggggtgggggtatccagcaagagctccttcccatcctcccacttcctttgccatgggccccctcctccacgcagaccctcagcctggaatgatcagtgtccagcttttctcgcccctctcctgccccgctggagggagtgacctggcccctggccccggccacctacacctcctgttttgctgcactagcctcgtggtaggggctgcggcggaggtgggcaaaagccgcttccgggcagccagcccccatcctgggagtgactgaaagtccttgggggttcctgcagggtgagctgcccattctggccctggtaaggacacccaggagagggccagggtgcctgtatttggggcacagcataaagaacagccgtaagtgtttctcaggcaggagggtgccgaagcattgggaagctgggatttagaagcattgtttggggtggtgagtggaagatgcaggacacagattcacgcgattgtgcagatcacctggcctcactccctcggtttacagtggaggaaactagaggccgagagaggtgaagtgagttccctggggtcacacagcctagccaggcccagggcgccgacctcctgctctgccttcccgtgcccattcggttggcatcagcatccctgccttgacacccccgtgtggcagctgctgtgattctgtgactcctcctcaccccaccccagtggggccctgcgagggaaagaagaatgccctatgcagaagtggttggaaagcaagaagcctggagagaagtgaggcctctgtggtttggcctgagtccaggactcatggcctggttcccagggatggagcaccgacccctcccttctacacccccaccccacgcccccaggagctccctatggggaagccggaatggacctgggctcagagattgtaaattcatcttgctggatgtgtggctgcctttatgtaaccaactctctcacggagaagccaggggatggctctcagtactctcgggggtctctcagtgaggtgggaggacctcgagaggtcaggaggctgctcaagaccttctgcccctcagggaccaggtgagggcttgtcgactgctctgacctcctgatgcttctggtggggagacctcagaggggcctgccgtcaccatcgccagtggccctggcctgcccagtcatccttctggggtggccaaactccatgctgcaaaagcccaagtgaaccccagtagtggcctgggagaatcatctgtcacgagccaaggatggagtttctggggaggactttctgctgccccccaacccctttcgggtacattctcctgtagccccactccctgtaagaaagtcaggtgcctcccgaagcttctccctggccccaggccagaggtgacagtgggggccccttgcttgcgctggtgactgtggctggttgttggtgcctggccctgccctgcactgtgcacccattgaaggcggcatcatccgggcctctccggtggccatgcatgggtgagcagcccacgacacatctgcttccagcatcgtgtgggccggggctttcagaggggctgagggcttggatggccctgcaggggggtgctcctggccttgtgaccgaaaggagctgaaggtttggagaagccgttgggccgaggtcagttcttatagatttggcgaggagggaacagatgctcacggagctgctccaggcactgcacacactgcctcactctgcgctgacagccaagaggctggttccccgccgacccccattttacagataatgtgctcccccagttccttagtggtggagccaggattcgaacccacgcaggcagcctcctgggcctgtagtcctacccttcatctccctccaggacctatgtcttggggttggcaggataatgactcccagagttgagcacatcctaatccccagcacctgggactacgttaggtgacatggcagggccagctaaggtcactaatcagctggtcttaaaatagggagatgatcctggatgatccacacgggcccgctgtcatcacaagagtttttaaaagcgcaatagaccatctgaggggtgcagtgggagaggcttggaaggaggaaggaggccacaagccaagaaatgcaggtgaacagaaaatgcaggaaaacgcagtctcccctgcagcctcgggagggtgcgcagccctgtggacaccttccctgtagcctagtgaggtggagtgtgggactaatctgtgttgtttgacatcacaagtgtgtggtcatttgctacagcagtgatgggaattgaatgccattaggcagcagtgcttctatcccggaagaattaggataaattcccctgtggatctcaagctctgggagattctgggctcctctggactgctccagttctgcaatcataggaaaggtctcccatgtctgtttgggagaagaaaaccccgtagcaaatccatttccccttttgacaaatgaaggcgagggtgtgggctggacacatgtttcctttttgtggattttttttgttttaacacttagaattctgtagctgaaggagactttggggggttgtctgcctgatttgcaagtgaagaaatggaggcccagggaagttaagtgactggcccagggtcatgcagagtcatgctggaatatcaagctagatagcccagttcctgctccaaagtgctttcctccctggttggggaggagggttggagggagtggaccccgagcaacagcagcattggcaggggttggaagagtagctactgtatccaggtgctggagcctctggccacttcctgcaggaaccaggtgacccaccatggcacaggcctctccctgtctatctgcagccctgggggccccagggaccagaggacactctggcctgagggctggggcctgagagaagagatggaagtacccctagtctggcctgcccccgtggcgtcctgcaggcatatccggcagcccaggggtcctagagaacttggctggtgggcgtccccaccttgccgcagctgcaccctgtggccagcagcttgcaggacttgggctgttgcctgtggccctgaaacagtcattttctgagctgagtggggatcaggtgagcagatccccacaccttaactgctgtgatctttctgtcctggaggctggtgggcagcctggttggtgcttcatggcactttatgaccggccctgtcaccaggctcgtgagttgctcccctcctttcgggcatcctgaacggcttccctgagagccccgccctgggccttcgcctctgcaggcccccgctgcctggggcgcctccttcccctggaagctgggcctctttggggactcattaagaagggccttgccgagtgctgccaaattgccccatctggtccccatttgttccacttaccaccctattttaacttttatgtctcctccttggctctaagatctgagcaggcagggcctgtgaggcaccccaggtcccctgatgctgccagcacccaggggactgttagtacatatgcagggagggaaggaatgaaggaagagatgacttggggagtcctccagttcccatttgtaactggcacattgcgacaaaacactcatggcattttacctttttcatataccttttttttaaatttatttttatttgagatggagtctcgctccgtcacctaggctggagtgcagtagcacaatcttggctcactgcaacctccacctctcgggttcaagcgagtctcctgcctcagcctcctaagtagctgggattataggcgcccaccaccacgcccggcgaatttttgtatttttagtagagatggggtttcaccaagttggccaggctggtctcgaactcccgacttcaggtgatccgcctgccttcgcctcccaaagtgttgggattacaggcgtgagccactgcacctggctttcgtatatctataaaagagaatttgcccagaaaatctttcagatgcacctttagggttttaaggcacagatacatgaagcttgtcagtgagcagctgctgcttattcctttttctcttccaattcagagcggcctgcgtcccaagcggacagctgctcccttcctcttggctccctgctgcccacgctcccacagaagcagggagaagaggcaggaaggtgacgcgtgatcatccgctgggcgcccgcacagtgccgtctgcacaggtgccatctcctttacttgtcactctcctcgctgagccctttcccctttttgcagatgagagagcattgcctcccagaggttaagaaatgggcccagagtcactcagctgatcagcgtgcagccagatttgaaccacatcctgctgatctccatgcctgcaggcctggcctgatgagatggacagctgggtggtggagaccttgagaccctggatggctcccaaatagggcctgtagctcctggacagggagagtctggcacaaagggtttgtggagtgagctgggggagaaggtggcttagggtccctgtctctgaacaaacagatggaggggctattccagcgttttctcagcctctggtgtgctgggctcctggttctgggaggagagaatggagctggcctccattctgggctgggctggtttgggcccaattcagacaagcttcttagtttgccatgagtgacacttttgcctgccctggtgtctctgccaaaaatatgaagggtttcagaacccccaccccggcctgcttccctcccagacttggagtgggtctggggctgacaacagtctcatgccagatagcctgagcagccaccagtgccatcaggtctgacactgcggcccctgccccggagggaaaaacaaggccctctctgggggattttctgccagcttgtgaaaacaggcctggagtcagccagcgcccccatgcttagacacttcgtgtggttttcaaagtgcttttatgttgctagctcatatgatcttccccaaaaccccataagggagggcaggaagtttgagcaacagcctgtcaagcacccatacagcaggtggtttcattgccctccatttacagacaagtaaactgagcttcagggtggctaccgcttgtctcccaagccacccagccatttagccacggaagaggtcatgactttttacaccccagtgaagctgaagatttttctttccgtttttaaaaatgtttactccccagggcagtgaacacctggtgcctctgtctagcgcaagaggtgaacgtttgccacttccgtttctttcctcctaccagacctgaccctccttttgtgacgggaacatcctgcaggcagtctgtcctgctttcatagactttgagaaacggggtccaaattgccggctgtgggtgggacaggcgacactgcagtgaagaggtggagtatttttgtagcggggaagaaatacatttcctctaccctcttaggttcagtgtttgggggtctgtgaattaaactcactcaagataaattaatgagagaaaagacagatttaatcacatacgtatgggatttcactgaaaaacgtgactcaaaagagcaggtagaaggtggggcccgtgactggtccgaaggtagtgagttatctcagttgattgttcacagtcagttacagattagactccttgttccactgtctcccctcttcccacttgttttgttttttttgagtcagagtcttgcactgttgcctgggctggagtgcaatggcacgatctcggctcactctaacctccgcctcccgggttcaagcgattcccctgcctcagcctcccgagtagctaggattacaggcacccaccaccacgcctggctaattttttgtatttttagtagagacagggtttcactatgttggccaggctggtctcaaactcctgacctcgtgatctgcctacctcggcctcccaaagtggtgggattacaggcatgagccactgcacccagccaactagtcttaaaaaaaaaaaaaaaaaaaaaagaacttagggcccgtatactatcttaataggaaaaaaggaaggggtgaaagcacatattatgggccgggtgcgatggctcacgcctgtaatcccggcacttcgggaggccgaggcaggtggatcacctgaggtcgggaattcaagaccagcctggccaacatggtgaaaccccgtctctactaaaaatacaaaaattagccgggtatggtggtgcacacctgtaatcccagctacttgggaagctgaggcaggagaattgcttgaacccacgaggcggaggttgcagtgagctgagatcataccattgcattccagtctgggcaacagagtgagactgtgtcttaaaaaaacaaataaaaaaaaaaaagcacatattatggcaaaacaaatgagtttttggaaagataaataggcccttaggagctgagatgggagatgtgaagtcttgtgacaatgtcttcttaggtgtggtgtggaaactactcacatcttccagggaagagtcagttgctcccagggagcagatttgggcctgtataccatcttaataggggaaatggaaggggcaaaagcacatattatgggctgggtgcaatgtgcccagtgcaggaggcagacgtggtttatggttgctgttgaaaccagtgcagggcccgattgctttgtattgagtgttgaggatcctggttttgtatcagccatgagtttgcagctctgggacacacttgatgttggctcaaggggaaatgaggttggaggggcagggtggttggattggatgtgggcctggggccattgctgatctacaaagtggtcatcacacgggaataatagagctggctacagaccacaaccagcaatattatttaaaagtaaggtcacacttttaataataagtcacattttaagttattatcaatttataaaacacactgttggtataatgatagcttttcaagaaggatataaaaaggcatgttgggctgggtgcagtgactcacgcctataatcccagcactttgagaggctgaggtcggcggatcacttcaagccaggagtttgagaccagcctggccaacatggtgaaaccctgtctctgctaaaaatacaaaaaaaaattagcttggcgtggcggcgcatgcttgtaatcccagctacgggggaggctgtggcagaagaatcacttaaaacctgggaggtggaggttgcagtgagctgagatcgcgccactacactccagcctgggcaacagagccagactccgtctcaaaaaaaaagaaaaaaaagaaaaaaagtaaaaaggcatgttgaaggtacctgcttgtggaaagttgcaacttgacgggaggtagggcgagcacttcttagaaaggtggaaatgggccctcctgctacagagacccacaaacatagactgaggcctgcagcctaggagactcaaaagaggcaaaggtgaataagagtcaaggtctccaagtcagggtctgactctgggggtgggggtcacatatgatggaggatgtcaggagggcttcctggaggtggtgacatttaccaggggggattttaggtggggtttgcgagacagtaggacctggctgaagagcgtaggctccttagacaggagtgggaattcaggcttgaaaatgagttggccagattgcaggggtcctcgaatgcaagggaagaatttcaactttaacagaggagcctgggaagctgtttgggaaaaggagtgataaagcgggaggggtcctccagcagagccctgcatgggcaggagggagcgagatgggaggtgggtgttggtaagggatgatcccagtggtccaggggagcagtcatagggtggaaactaaccttgtggggtctgggcaggaagggactgatttgagacaccgggaagaaacagccagtaggactttggtgagagggctgggggtcggggaggggggtgtggagagtgggagcttgagtctctgaaaacagacagtgttccaagggggagacctgaggcaagatgtggagaggcagctgagctgggaagctggaacggaggtgtggtcactccaggagactaagtcagggggcgaggggacccttgggagctatctagaccccagcactagggaatacggaggggagaaggaggggagaagaaccagctggtgcgtgtcaggcactgccctcgaggtcagatggggtggggctggatactggccatgaggattttttcaagagctgggttaatagtgagacgggcggacaccagatggctcgggctaagaagtaagtgggcggtgggaagctagaagccgtggtgtagacctactttgagaggttgggctgttcagacagggagaaagttcacagtttgaggaggtagataggtcaaaggaagagggtttgcttgtttttgagattggggcatcctgaacgttctcccaggccaagtgagaagaaaccagaagaggaacatgtcacccaaatgtgctgaaacagcccagcagctgcgctgcctcacagaaaatgtgcagaggcccctctgtcccaccatgcctgcctggggacggccttcactcgggctactcagggtttccccagcctgccaacccaagggtggcaggagctgtgggtgctcccagccccttctcaaggttggtctgtgggtagaaatgtgggctgcctcggggcgtcacagctacaaatgcataccagccctcagaaccacattcctgctccccagccctttcctccgcacccccatgcagaagcgcggccgccagctcacaaaggatagggagggatattgctcttggcatttgatgggaagcatctgctgcatcccattggggtgttgcccaggatggattggaaaagagttggcaggaaggctgagctctgtgctcacaacctggcttggtggtggccgaggagcttggcaggagcagagtgcaggacctgggaactgggggttggtgcatgtgtgcacgcacgtgtgtgtgtgtgtgcgtgcgtgctgggtgggtagggaggaagctgtgaaaccacatcccctcctctctgctgctgtgttgctgtgtgtttcagcagcacgtgggtgtcaccacacttcctagcaggtgtcaacctccaagactgttctgggctcttctcccagttggctgagttggaggtgggagtcccaactgtcccctgtggcttccagagtgggaccttgctgtgggataggctggccaatggtgctccctcccctgtgacccttctgttgggtgggtcacgaggaaggactgtgggtgttgcccacagacaggtggacatgtggcaaggacaccttgggaccttctttctgacgccccttgaagggggcactttctcagctttgagatgagtctctgtggatgtgggaagttcactatctcaagagcagcagccttggaaaatccaacacagaaccccgagtaggggcgggaaggggtcctgtcccgctcactggctgcctggcagagttctgcacaaggaagcgcctgtgttgctgtgggcggaggaatggactgagggctacattcgcttcctgttgccgctgtaactgcttatcacaaactcagtggcttaaagcaacagaggctccttcctttacagtgctaagggtcagaagccgatcagtctcaccggactaaagtcaaggtgttggcagaatccattcctgcctcttccagctttgggtgggaggctctgctggagttccttggcttgcggctgcatccctccagcctctgcctccatcctcctacagcctcctccttctctgcagtcagatctccctctgccttcctcttttttttttttgagacggagtcacccaggctggagtgcagtggcacaatcttggctcactgcagcctccgcctcctgggttcaagcgattctcctgcctcagcttcccgagtagctgggattacaggcatgtgctactacacctggctaatttttgtatttttagtagagacagggttttgccatgttggccaggctggtcttgaactcctgacctcaggtgatctgcctgcctcagcctcccaaagtgctgggattgcagccatgagccatcacacctggcctgcctccctcttaaaggacgcttgtgatttggggcccacctgggtaatctcttcatctcaacatcttcagttacatctacagagtccctgttgccacatgaggtaacacagtttgggaagggagagttattcagcctaccctaggggcctgtggtgtatctcagggcccttctgattttaagatataaagcaagaaaacaaactggctcaaggggaaaaaaggacacgttgaattctgttgctttaaatgtatatttttttattgtgctaaaatgcacagaacataaaatttgccattagtaacactgagtacattcacagtgtcgtgcaaccatcagcactgtctagcgccagaactttttcatcaccccaaagggaaaccccgtatccatgaaggactcactccccattcgccctctccagcccttggcagccaccagaatgctttctgtctccataaattcatttttaataagtgcaattctgtgtgactttaaaataaataaacatgagcacgatgagttgcttattggaaggatatccatgcggggaggccggcgtgtggagtgcgtaggcctccggacgggcaggagttgaaggggcgtggatgtgccgccctctcctccccttgctctttccttggggtcactgcctgagtatccctctttgcaaatggccccaaataatgtctcagcccccacgtctgcatcgcctcctagcttcaggaccctccaccaaaaaacattccaagcttcagactcactcctgggaaaattccaatggcctcactctcccttttgagccagccagatcccatggcctgtggcgggctgcctttgagtcctgagcacctgtgagctagggaagcaggacaggcacacccagggaaggggaagagtcgtcgtcagtcacagtaattgatatctttggaatcgtctaagagatacttagcgtgtgcctaaaacattcatttctttttttgtttgttttttgagacgaagtctcgctctgtcgcccaggctggagtgcagtggcgtgatctcagctcaccgcaacctcctcctcccgggttcaagcgattctcctgcctcaacctcctgagtggctgggactacaggcacacactaccacgcctggcgaatttttgtatttttagtagtgactgggtttcaccatgttggtcaggctggtcttgaactcctgacctcaggcaatgtgctcgccttggcctcccaaagtgctgggatgacaggtgtgagccaacacacctggccacattcatttcttaggagaagctctgcattttctgaaagtgaaatgtccccaggcgggtgacactgatggtgggatctgtggcctcaccagtgtcttatgagagatgccgctgtgtgtttcaccaagctgtatcctattgtcctctaaatgtggcttgtagacatggtgccgagaatgatctgggaggttcaaatcataatatggtccaaatcaacagctctctgatgacctggtattatcctaggatcaaattgagactatccgaggatgggcgtggtggctcacgcgtgtaatctcagcacttcaggaggctgaggcgggcggatcaattgaggtctgtagtttgagaccagcctggccaacatggtgaaaccccatctctactaaaaatacaaaaagtagccgccggacatggtggtgtacgcctgtagtcccagctacttgggaggctgaggcgggagaattgcttgaactcaggagacggaggttgcagtgagccaagatcacgccattgcgctccagcctgggtgacagagcaagactctgttccccggcaaccaaaaaaaaaaaaaaaaattgagactctccgagctgcactgtccagcatgatagccactggctgcacggggccatttgaacacctgaaatgtggtgattccaagtggagaggtgccgtgtgtgtgaagtgcactctgggtttcagagtcctagcaagggggaaagaaaagaatatcaaatatctgtcatttttacattgattacatgttgaattgataatattttgggctctgttaagtgaatgatattaaaattaatatcacctgttcttacattttttaatgatttcctttttcttttcttttctttttttttttaaatatggggtctcacactgttgcccaggctggagtgcagtggcacgatctcggctcactgcaacctttgcctcccaggtttgagcgattctcctgcctcagcctcccaagtagctgggattacaggtggctgctaccatgcctggctaatttttgtatttttagtagagacagggttttgccatgttggccaggctggttttgaactcctgacctcaggtgatctgcccacctcagcctcccaaagtgctggtatgacaggcgtgagccactgtgcctggcttgttcttacattttttattgtaggtgctggaaaatgtaaggttgcgtctgtggcccatgtgccgtttctgctggagggttggaccgagggccagccgagaaggctctggggctgctctacctgaatgctgagtgtgtgctgagcggtagagaactttgagaagtgctgaaggacagaggctttgtgtgggggatgcagccccaggccggagatgccttctctgtgctctggagaccctcatttggtgacagcaagaggaaccactgcaagaggggcggccacctcagcaaagcacccaggatgctggcctcccagctcaggaatccagaggcagaggaggggaggaggctgggcttggaggagagcagggtcttgggccctgggaaaagcctggggggccagaaagctgggggacagattgaggccagaggcaaagagaagaaggttcggagaggagggccaaggaagaagggttctgcccacggggagggagaggcccacggggcaggggcgtggtgggagctgcatcctcgaggctttctgttgaccctgacacctggccagaaaggagttccttctggcatcctttgtcagcggtttctggagctgccctttaggggccagtgatgagggtgccctgggctgggctgcagacagtggaaaagacaggctcttctcactcccagtgctggggaaattagcttcttggaggaagggggagctgtattttctgagtggccgcacttcctggcctagacgtgtgtgtcttgctgtaattttggcgactggtgttggtggtgcccattttatggatggggaaggtcaaattccacagatattgagtgacaggcccagggccttggatttcagtgtttgactcagaacccaggtctctgatctgccaccagcctccctcccattcagatgggaacagggactccgggcatgcagtcttctcccagacactcccccggctctggcctggcgcccggagaccagtagcagcagctccccacggccgttcactgtgagggtggggagggccgtgggaccaggaggccttagggggaaagttggccatgaggagtgggaagcgacgggtcagatgccagtgactgctggctggggagccgctggacgtggctggcctgtttggccagtgtggcgggtgccccggggcttcagtcacccccagccacgtgtgggggtgcgggatgggaaaggtaagagtgtgtggagcccagtcagcactcaacatgaggtcccgtgggggctgcctgagggcgtagcttccagaattcagcccctggccctcagaaggtgtcaccaaaggcttctttccatttgagtgaatccctcccagcccccagcaagccctcggaacgagcccactcccaggcgctctctcctagtgtgggagtggccacgcccctgctgggagtgactcacttgggttcagaggtcgtggcactgagatgggtctggcagatcccagcgtccaggcccagcccctatagtgtcagctccctcctctggggacccccttgcttgtgcccctctgggtcccagcacatcccaggcctgcagggagggggagaggaagagactgactcactggccaggtcccccaggggctggagaggctggagaggcaggagctggatcagatctgaatccagaggctctcggaggaagagctcagggtgagctgcgcccccatcccctgcccctcctctcctgctccttctcccttccatggtcccagccagcaagcacctggggtagaggggacaaacccaggtggctgtgttccagccctggctgcaggtctgaatggctttctggggtggctggccatgctccctgagagcccagctgtggcgatgtctgagcaggtaggtgggggagcacctaggaagcaggggtgtcaggcagagcacaaggagagagggtgtccaggtcagtttcaggacctggctgagaggagggggctcctcacgggcaccgcctctggcaagcacagggacaagggcaaggacggcatggccagaggtccctgggagcctcttcccctctcttcttcctagcagctccccctcactcttcccagggaccctgtcactttcctttagcgtgtggcagctccttggcgtccctcccgtgccttcaggttgcttctgcgccgggcctgccgctgggcgcccctatctctgcctgccccctcctcctgctcccctcgccctgcccccttggagcaattccccaccgagcctcccttcccaggcagtcgaggtccctccctacctctgccccgcgctctgggaggctccttgttccgcgaccacaaagcccctttgatcctctgctcggctctgagccatgtgacccggtgggcgggccgcggctctcggcgcgtccagcgcagcccgacgttccgctgctggggtgagtcctgctcctttgttcttcccagccttgcaccactggctcgggggctctcaggtggcgcggccgcgaggcggaccctgatggccatggtggcggtgccgggagccacgctgtccctgggccccggcccgaggccggcaggaccgagcggggtccccaggagaggggtggcggggagctcgatctccacgcggggaccagattttcggcctcaaaatagaagaatagggctttgtgtggtcacagctatctctttgtaaatatttggccaactaagctgagtggctaagttctcctgctgcccggagcttcttggaacatgtttccttttcgcaaggggtttccctggcttccaggagggccaggaagaaattcgaattggccaccgctttctctaaaatcactccgctcaagttatcacccctctgggctcccgaagaccggctggctggaggctggagatagtctcaatgctcgaaatgccgtaaccgaagctccccgcggcgccggcactgggatccagggagctgctgctacagcgcagctctggattcctggatgtgttggatatgtgcagggcgttcctgggaggagcggggagggagggtgctgctggcggggctggtctgcgtgtgctttgcttctctacaatggcatgctgcgtgtcggccatgcagaggcatgtcagtgagcaggggctgagggatctccctaacggacctgctttcagagggtcttttcatgctgggagaaccccagagactaaatcatgcagccaacggggtggtccccggcctcaaagcagggaggggcgaggagctttgtaggcaatgccatctgctcctgaaacgccgtcccagtgactctggggactgactcagcctccagcctgctgcacttcatccctggcccctctctctttgctttttcatgtgaaatctgctgtgttttggtcagaggtttggggaacagctctctgctcatctaagataagtttgtaattcctttcctggagaaaaatatgccacccggaagcaggttgagcagtggttttctggcaggtctgttcggggctgtggagacagcacctgctggatcaggatggagttggaatttggtttggatcccacatgagaaaacccgttggaagaggaggaagcagaaaaaggccccattccctaataatgctgtgggttttcctcctccattcattgccaccttgccttgaaacttaatggggccacgtgtgtttccatgaatgtcattctctttggccaactcccccggcagccccaggagctccttttcaggaaaaggaagaaggtgtttgcttagcatctagtatacgagtccttgttggaaaggtgggattcttgtttctccttgggtctcttttaggctgagatgtggtcaaggaaggcctgtggtgtggctcgccttttttaatgctcgtctctggagacctgagttgctgctgactcccagcttgccccttctgtcccctggccatttctgtgtcggggtggctgagacactattgcattggccactttgtgttcccactagcccccgcccctgtaggctgtcattgtgatggtgatggggccaattcagctgcggtggggaggacccactgtgtgcgcctggggggtggcgtggggcactctgggatgagaagatgcgacttctgccctgagagccctgctttaatggaaggcgggggcatagttgcaggcagaagccatcaagcactgtggtcagaccagcattccatgtcaaaaatggccttgttggccgggcgcagtggctcatgcctgtaatcccaacacttcaggaggccaaggcaggcagatcacctgaggtcaagagttcgagaccagcctggccaacatggtgaaaccctgtctctactaaaaatactggctaatccgggcatggtggcgcgtgcctgtaatggcagctactcgggaggctgagacaggagaatcacttgaacctgggaggtggaggttgcagtgagctgagattgtgctactgcactccagtctgggcaacaagagtgaaactctgtctcaaaaaaaaaaaaaaaaagccttatctgggcctgggatctgtcctccgaacactgggtccactgtgctccacaaggactttcaccccggaagccctagacccacttgggcaaccagagtctctgggttgaccactccccagccctggccagcctcctgggccaccgtattctcccaacttcctgttgtgccacggctggtccaagctgctcttatcagacaatgcgaggcacttccacaggaggggacaaccccgtccttaggagccccttctccctgcccccaggcctggtgcagtgtgtggcttccctgccggtgtcaaaggtctcaaggcccctttaagaagcctgtcaccaccaccagcagcttccgttatctggttcttctgtacatgtaagcctttcccatacaccccggatgtttagggcttccgccctctctccctggccgggagtgtgggaagagggctttatttcaatgcttgagagtagggtcaatggccagggtaagctgtgggggctcctccccgccggcccctctctgcagccctcaccttaacacagagcatcgataccacctgggctttgggaagacctggaggctgaccaccctggaggctcccagcgtcccacagccactctttggggaagaggcttcctgagggacttgtggcccttggctgggactctagtcccagagttctgccttccggcgccgagctttgatttgtttattgagtgccagcccggttcccggacaggtagggacctgttcccggagctcagcagagccttgggaagctttcccaggagggctcccgagggtggcggccatgcccagtccgctgtacgtgtgagtttgtttgatgaggaattggctgggaaggcgcgggtctaattacaggcccatgagggtccctctcgcccccacccaggaagcagcggagatcctggcacactcagcacctgggcctgtgcctgcccagctgctggtggaatcatgggagccttgctccggggcctgtagagcagcagtgggaaccttccccacctcagcccctcccagagttggctgttcaaactcgccgccgctcagcctcttcctcctctctttcatcaaccctgggaatcgcacactgcccaccccaccgggccccggagcgggtgcaggaagagagagcttaacacccagaggtctgggccttctgcaggcgcctgagctgctgtggcctgagctgggttccctgctggaaccatcacagtagacctaatgatctgcctgcaggagttgcttcatcccagccgactccggggctgcgggaaggggctgggccttggttttgctgggggtggggggtcagtgcaaagggcctgaaaagtggcagaggtgatggcccatctgtcctccccctggccggccggcctaaacgcgattggctctctttcttttttttttttccctcccttttccctataaataacactaaatgcgatttgtcaatgcattcatttgggttcagtagttggaccatgggcagaagcactccagatttgtcactttccctaagctaagggtggggaacaccctctgtgagatcttggctcctgagcgcccaagactgctcttggaaccccaactctgggtcggtctcaggggactgacgttgatggagttgctgacattgacctccggcctctgcatggccttcaggaagggggcccttcgctctctgtcccgtcgagcctggctggcagcactcccttctcaggcctgtgcccccggcagggcctgctgcccccgccctgctctgtgggtgccaggctccaagcaccaggtgactcggtcactgaatggtcactgaacagtcatccttgctggtgtccccagtggaatgtgcatggacgtcctccctcccccagatccttgtcttttatctctcagcctttgttccaggggccaccacaggaccaggaggtacgcagacgtgggtggcacatccactgggcagattcagccctgaacctgcacgccccctccaagggggcccccagcgggcggggttgatggtgccgtctctctctctgtcactagaacggacatgaggattgtgtcttgtcgatccacgtcctgagttcccagacgtcataggtgcttgctcaacgagtgtttgaatgaatggtcagcattgtgtgaccgcagattttcaacttttatccaaatagtttgtggtttctgtgaggctatcccgagacagtctcacaagaatctccattctccctgcacgctccgcacaaggtctccttggggggtttttcagaaaaagggccaaagagcagcatttcctcggggatttgaacacgatctcccccggggcaggggactgccctggaagattcccggcaccgcttcccatgcgccacgtgactaggagggtcttggggcaggatggtgtcttttgtgccttgtgtgctggggccggaggaaacactgcccgtggccggtgtcatctgccagccctgaagactaatgatgggctggacagtggccccattgagtgggagggagaatcgctgctgtctgtagctggggggccgggtgggtgggagccgaggccagggagaacagcgcagacctggcacggagaggcctggaggaggagcagggggtctcagccacccagggtgcagggacgccacacgaggagcaggtgtggtgtgcgtcctcctgcgggttctccacctcttggcttcgttacctgcactaggctttgtggtgagagggcacagagtggaggaaggtgccgtggctagggcaggccacacgctgtgctaatggattgctgttacctgtcgcctctgtggttttgctgtcaggatcctccagcaccaggtccccaccaccaggtatgggccccacaggcactactggctccccgaagccagggacagaccccatagacaatactgagtccctgcagccagggatgggcccccacggccagtaccagatctcagggaccagcaccgggtacccacagccagggacaggcctccatggccagtaccaggtctcagggaccagcaccgggtacccacagccagggacgggcccccatggccagtaccagatctcagggaccagcaccgggtacccacagccagggacgggtccccatggccagtaccaggtctcagggaccagcgctgggtccccacagccaaggacaagtccccacggccaataccagatcccagtgaccagcactagatgtccacagccagagatgggcccctatggccagtaccaggtctcagggaccagcgctgggaccctggatgactgaaggagggcacggttgactaaagctgcaggagccagcctggccatcctgaggcactaagccatcactgcggtctcaggggactcagactcctctacttgtcttcttgaattctggaatcagacacacctgggtccagcctttgcccccggggctgtgtgcctgggatggttgcctcacctccctgaagctcagtgagatggggacggctgcacagggcccggcacagatggcacccgatggcacagggtcacctgcttgcatccatacagcctcggccctcgctctggctgcgtaccgagagtcccatgcccagacctctgctgagtctccaagctcctggtcatgcctcaggcctcccgtgagaagcatcactgcatggaccatgcctcgggacctcaccttgggctgggaagcttgctccatctccccaagtctcccctagaggcgccccatgtcccatcactctcactgcttgaggggtcagataggggaacccagtgtgggaggcccagaggtgccggagcagacgttaagcgagttccgtgtttatgcgctgggccttggcagacaccctgaatgagcctcttccccaggaaggagattggggtcccagtccaagttgtggcctcaaaccctgtgaccaagagtggagaaaaggcaagacccctcctcccagtcttccagaacagccgatagtggtggaaacatggggttcacactgaatttccttgtaacttgttgaagagaatttagcccacattttcaggggtggaggtctggccgatttggcagtgtgcccgtccccctggccacagtttactctggaccgggcaccctggtgccctccctcagtgacgcagtgaagtcactatgacgtgtttagttggtgagaaagtgcctcctgtaatgttttactcttcttagagggtgaataagccttgtttattataaataattatttacagaatacatgaggtttaacctaactctgggccacggcagcgtcccctgggtaaacccacgcgccaccctagctagagcctgtgcccccacaggcttcctggactcaccctgaaggggggctggattttctgcctgtcccgatgagagggctgcaggacagtccccagcgagcccttctgagggctgtaacctcttcccctggtattttcctgctcgccaggaatgtttcaagcttccagcagaagcctacccaccatagtcgctttccaccctgctcaccatccctcctgccctcactcattcagcagaccccgtgcacagcccagtgcaggactcagggtgggaaggtgtcccgggtgggctggagcaaggttcccagccagggcggggtcccaaggtgggtccacagccaggactgtgatttgggaggcccctccctgccttgttccagccccggcaccgccgctgtccttgtgctcagtggagactcactggctccaggctctaaaacctcagcgaggtctgcagacagggaggagccccactcgagggtagagtgactgccgggtccatttgcctgttacgaaccacgtggcctcagacctgccattcctcctctcctagagctatggtcttttgtctgaaaaatggataatgatggttaccatgtcagggaccattttgaggacaaacggggatgaaactgaagaggctcagcacggaacctggacacagaagtgctaattgtgtgttaccagctgcggtggctgccaaggcccaaccacatggcagccacgggctgagtggcgggcgggaagtggggagcaggagcatgcaagatgggcattcctgaagtttctgatccagtgagataagtacacacccagctctaagatggagtgtcccaggaaggtggagactgcaaaggccttgtggcgcaggagtgtgagctgcacctctgggctctctagaatttcaccagagctcagggaggaggtcagctcagatataggggcaacgggagagatgggagtgagaaaatggcttggcgtctggaagtggagcctggaaaggtgggcgtggggacagaggagggccttgggggccatgggcccatgcgtccaggaggtggaggcagtgaacggggccacggtcggccccacacgtggcaccaccagccctgctgagcctgcacctgctcctcaggccccctgagtgccactaccacctggcaccccttggtctgattcctgcttcctgcccgcctgggaagagtgagaccacttgcctaaagtcccttagctgtccttaaccattctggctgcctcctggccctgtccagggttagccgttgacctgaactgcctggtgccacctccccagactcctggggccttgccctggcaccaacagccacctccatcttcatcattcactcgcacattcacccagcagtgctttttgggcatccactcagcaatatcaaggcgctgagatgcggctgtggttaagacccgggcccggtctgtgaggacctcgcagttgccatttccccagagcacagccccagccaggcacactgtggggtccagaaagagaaactaatacattgtgttcgtccattttgagttgctataaggaatagccgaggctggggggttatttgactcacggttctgcaggctgtacaagtggtgccagcatctgcttggcttctggggaggccccaggaagcttttcctcatggtagaaggtgaagggggagctggcacgtcacatggcgagagagagaactcccagactctttttttttttgaaatggagtctcgctgtgtcagccaggctggagtgcagtggcacaatcctcggctcactgcaacctcagcctcctgagtagctgggattacaggcgcatgccaccgcgcccggctaatttttttgtatttttactagagatggggtttcaccatgttggtcgggctggtcccaaactcctaaccttgtgatccacccaccttggcctcccaaagtgctgggattacaggtgtgagccacctcacccagccctcccagactctatagcaatcagatctcccggactttgtgaccgtggggagggcaccaaaccatccatgagggatccacccccatgacccaagccccaccccccccaggccttacctccaacatcagggatcacatttcagcatgagatttggaggggacaacgtccaaaccatatcacacgtgacctctctgtgcgtgcgtcagtttctacatctggttaagcagtagaagctccttctctgttccttgttgagagagcggtgggggagaaatgactcagggatgggaggctggtcccccgaggggccctggtgtttgtggagtgggagtgcgggaaggcccctacgttgtgtgtgccgtgctgggctggctcctcacagctcaccgtggtgctccccgaggactgctggggaggaaagagctaattaacttggggacccagctgctgaagttatcattaaacttgagcagtccaggggcccctctccttctgggtcctatgtcacccagcacagtggggcttaattgaattttttctcatcccccaaggctcctggctggcgtggctggggtttgggatacggggagcgagagggcttgggcctcttccagatttggagtgggttcaccagaaatggcccaggaaaccgcgggggccacccccagcagctgggggctcctgtggtcatttcctcttggtcctgttgagcagccctggcccctggagccctcagcaagggatgtgggggcctgccaggccagggtcctcactgctgccgctatgcacagctgcatcttgcatccggggagtggggtgccgagtggggtgtttgggaggcaggttttcccttgtcccttctgcccagagaccttggggatgagttgagtgagacccttccggcttctgactggctgtgtttctgttgccatcccccactccttttaagtggaggtttatgacttccttctttatttaaaagggtcatttagtgacttagcagatcccagtctgtgttacccagggcccttttaaaaatctgtggggaggctgggcttggtggctcacacctctaatcccagcactttgggaggctgaggcgggtggatcacctgaagtcaggagttcgagaccagcctggccaacatggagaaaccctacctctagtaaaaatacaaaaaattggctgggtgtggtggcacgtgcctgtaatcccagttactcgggaggctgaggcaggagaatcactcaaatccaggaggcggaggttgcagtgagccgagatcacaccactgcactccagcctggacgacagagtgagactctgtctcaaaaaaataaaaataaataaataaaaataaaaatccatggggggacctctgtgtccattggctggtgtgaggagagggtgaggagctgcagagaaggtaccaggctgaggaccgcccccacccttgggctacagaattgaaggaggggacacatgaaagatgttcctagactcgggctggaggctggggacatccgagggcaaggacgacgctgtccctgctcttgtttgcagaggagtgcacagggctcaccagcttcttgttgctgtttaagtgatagctttatggagatagaattcacatactgtgacgttgacctttttaaaatctacagttcaatggttttgctgtattcacaaagtgattgtattagggtcatccagagaaacagaaccaatagaaggtgtgtacgtgtgtttagataaagagatttattattatgaggagttggctcacctcattacagaggttggcaagtgccaagattggcagagtaaatcagcaggctggagacacgggagagcccatgttgcggctctggtgtccacctgaaggcccaagacccaggagagccaatggcgtcgttccagtcccgagacccaggaaaagcgcatgtgtcagtttgagtctgaagcaggaaaaatctgatgttccaggttgaaggcggttaagcgggaagaattctctctcactcaggccttgtgtcctcctattcagaccttcaggcctttgtcacaaaattacaaagacctgatcagaacaaaatctgagaaaaaaccctttccttctatcggttttggattcattggctgggaccctggaaattagactgacagagattaacaggaaacaagcataacaattcaagtaagttttacttgacaccgagccttcataaggaaatgaagacccagagaaaccgttagcctgagcggtttttgttttgttttgagacaaagtctcactctgtcgcacgtccaggctggagagcagtggcccgatcacggctcactgcagccttgacttcctgggctcaagctggggcccagctgccggccccgggagctgctctgaacccactcttaagtcccagctcagactcccaagtagctgggactacaggcatgtgccaccccgcctggctaattttttattttttgtagagacagggtcccactatgttgcccgggctggtctcaaactcctgggctcgagcaatcctcctgccttggcctcccaaagtgctggggttacaggtgtgagccactgtgcccggcctaggcctgaacagtttttatttgttttgcttgttttttaaatttgtttgttgcttgttttgagcagtttttttgtttatttcttttgcttgtcttttgcccaggctggagtgcagtggcatgatctctgctcactgcaacctctgtctcctgggttcaagccattctcatgcctcagcctcccaagtagctgcgactacaggcgtgtgccaccacacccggctgatttttgtatttttagtagggatggggttttaccatgttggccaggctgttcttcaactcctgacctcaagtgatctggccaccttggccttccaaagtgctgggattgtaggtgtgagctgctgtgcctagcctaggcctgagcgtttttatgctgggtttgatgaagagtggaaagtcgtgggaaactgtgacagagcaacaaaagatgagctgaacagtgagcccgtgggggtctcggcaagacctgtgtactggggcccctctcagatcctctgtctctggagatgaggctgttcctttccgctgggtgtagggagggcacctcttacgtgaggggcttatgatctacttcagagaaggggcaggtcagtgagttcttcttggacctgccatttcttaaattccttcagctgaaaatatttactatgccaaggcactgtatcttggagtgtgcgttccaagccctgttgccttcaactgatcgggtgaggcccacccccatcagagcacacagtctgctttacccaggctcctgattgcacccttttcctgtttgccccgagaatactcaccagcagtgcttgtggctgcagcgttcaccccaagataaatttgccgggaagtatcttgcttttattattattttcacatcactctagtatatcgactttggaaacaaaagacatcattctgtttatagcattccatttttagtagtggtatttcctttaaaaaaaaatggtaattctcagctgggtgtggtggctcatgcctgtaatcctagcacttgggaaagctgaggcaggctgatcacctgaggccaggagttggagaccagcctggccaacatggtgaaatcccatctctactaaaaatacaaaaattagccaggcgtggtggtaggcacctgtaatcccagctacttgggaggccgaggccggagaattgcttgaacccgggaggcagaggttgcagtgagccgagatcgcgccattgcattccagcctggacgacagagcaagattccatctcaaaaaataaataaataaataaaatttaaaaaaaaatagtaattctcgatcgctgaaaatgtcaaatcctagagaacacagcattcctacaagtgatgttaacattgttcttgatcagttgttggctgaagattcatttgatgaatctgatttttccagaatagacgactcagatgactctgttgttttgcttagaaataactgcaggaacaatttaaaaaattttttttctttttaatttttttgttttttgagacggactctctctgttgcccaggctggagtgcagtggcacgatctcggcttactgcaacctctgcctcctgggttcaagtgattctccagtcttagcctcctgagtttagctgggattacaaggtgcctgccaccacacgtggctaattttttgtatttttagtagagacggtgtttcaccaggttgaccaggctagtctcgaacccctgacctcaaataattggcccatgtcggcttcccaaagcgctgggattacaggcgtgagccaccacgcctggccagtttttatatttaattttcacacagagcatccagtcagatttgcttcagcctcaaagagcgtgtttatgtaaaattaagtgagtgctggcagtgagctgaactttctaaaaggtaaaagggttaaatattaaactcatccaaaaacaccttcacagacacactcagaataatgtttgaccggttacctaggtgccccatagcccagtccagttgacacagaaatttttttttttttttttgagacggagtctcgctctgtcgcccaggctggagtgcagtggcgcgatcttggctcactgcaagcttcgcctcccaggttcacgccattctcctgcctcagcctcccgagtagctgggactacaggtgcccaccaccacacccggctaatttttttttttgtatttttagtagagatggggtttcaccgtggtctcaatctcctgacctcgtgatccacccgcctcagcctcccaaagtgctgggattacaggcatgagccactgcgcccggctgacacaggaaattaaccatcacagttacacagccatcgccattaatcccagcacatttcatcatccccaaaagagaccctgcccccattagccaatccccattcccaactccgggctctcagcccctagccaccgctcatctgccttcgtctctatgaattcacctgttctagatagtttgtataagtggaatcgtacagtatgtggccttggtgtctggctcctttcacttggtagaatattttcaaggctcatccacattgtagcaggtgctggtgcttcattctttttcatggccgaataatattccatcgtggatagaccacactgtgtatctcttcatctgctgatggacatttgggttgtttctgctttttggcataattctgttgtgaagaattctgcagtgagtgctggtctacaggtttttgtgtgaacatgttttcatttctcttgggtaattgcaagatcatgtggtttagccaaccagcctttaagccatgtgtctgctgagggacccaggcctggtgggggtgcattgctgtgcttggccagccaggtgctgcgagtccgtgtcgcagccatttctctgtgctgtgctctgaggttgtctcgccggcaccgggcactgtgagccccaggaggccaaagccccctttgttttatcttgagtccaggcctcgctccatgaactaggatgaatggacattgaatcaacgcagggatgggtggggctggggtggggacgcagagtgaccccgggggcctgcagctgggtcctggctgctgacttccagtttcctttgcctgttggagcccagaacaagtcagaaaggggaaatgcaaagttcgagtgtcttttctgtggtagactggcaggcctgggtgggtgagccacttgcagctagttgcagcgtgagagaggaagtgggaggggagggagagggtgagtttggtgtaactcacccctggaaggaggctgggctgaggctgggggaagtgacttttatttttctgagaggattcttccctggggccaacttcaaaccaagggagacaagaccttcctgggggaggctggaagtgctggggcccccaggtgggcaggtctcccagggccaacgtcttggggaagctataagttaccatgtttctggactgtcacacacacacacacacacacacacacacacacacacacacacacacacacacgagtaaactgtaacacaaatgtgtgcccatgaaagtgcccactttaaaccaccacacagcctgtaaagcgaaggccctggcccgcatctgggcacccactgcccagccagccggtaggcagtttgcactgtagtctgttaccatccctcagagatgcagccgaggagcccagctggcttggagggcccagtgggcgcagcctcaggaaagtggtcaggcccgggccaggccccttccccctcccagccttgggagaaattaccatatgaatgtagctccttcccggagttcgggctggaagggcctgggaggggacaggctcccaccccaggagcttccaggttccggctgctgcctgtgttagctgcgtgagcgtgagcgagccaggggtcactactgggtggaaggaagaagcgggcatttcttccaggaggtcaccgttggagtcccacagtaggtcaaccccaggccctgggtcctcgggaggaggagaaagaagagaagcaggaggtgtggagggtaggccaggaccagaaggcacacagggtcggggcagtgtgggagaccctgggggctccctcatttaaccagctaacatcacagcgttcataagaacacgctattactgcagttttattactttgctctgatttcagaaggcacaactgatgactttagggaacggagaatctgaggaaggcctcgcaggagagggtcagatgcgatcgagtaaatgtgagccgtctgtaaactgtagagtgcacgcacagcaccggtcagccctggggtcagtgttcccctggtgctcagctcggcctctgcaccttttagtgctcggctgggctctgtgggggtcagggctgggtctggtacattagaggacttctaccaagcccctggcagtgtctcagttactaaatccagtttgccagttactaaatccgctctgccggttcccgaatcactcttccgctggggccggccatgtcacgtcaggcttttcatgcaggacggcagatggatagacgctgggaccaagtcatccttgggccgcgagacgtctgaccttctgctggtgtctcagaagatgctagctctccgtggcatgtcttccacgcggtgcttggggaccagtggcctctaaggggcccccctgcctcagcgtggggagtggcctggccaaggtctcagtgtctggttggagccaggcataggctcaggtgtactggctggaggcctcctgcccatgggctctgcctgtcctgtgtccctggtccttactgtgtcttctgtgttcctgggagagaccccaggggccctgagcccagcactggggttggggagtgggcggggaagagggtggggattagggtccctggctgcagaacagccaggccccaagtccccactccactcccctcccaccgggcgcctcatcccacactgaccatttcctgaagaaaatttcctgaaccggcctcccaccccggctgtcccaggaagcccatccatccttccgccttaatgctttgtggctccagaaggatggtggaagccggaaatcatgagtctcattcacaggcggccacacaccgaagccgcggagacgccgtgggaaaggactctggccagcgcggccggcacagagggagcggtgttaccggggtagacgggaaccgtggctgcccccatgctggtctgggagagacgaggggccggacgaaaggacagcagactggccattcattcatttattcattcactcattcacagcgtcttactgggtgcttcggacgtgtaaggttttgtgggtagtgaatgcgacagaccccagacagcaatcggagggccacgtgtgtaagaactgagggacctaggctgggcgtggtgtctcaagcctgtaatctcagcactttgggaggcagaggcgggcggattacgaggtcaggagatcgagaccatcctggctaacacggtgaaaccccgtttctactaaaaatataaaaaattagccgggcgtggtggcgggcgcctgtaatcccagctactcaggaggctgaggcaggagaatggcgtgaacccgggaggcagagcttgcagtgagcccagatagtgccactgcactccagcctgggcgacagagtgagactccatctcaaaaaaaacaaaacaaaacaaaacaaaacaaaaactgaggaacccagtgtagatgagctatcccgggaaaacaagtgggagttctaggaacagcatggggaagggatggtcccggcagggaggacctctgtgggtagccttgttggaagagctgaaaggcagccagagaggctgtgcgtggatggaagctgaagagtaggttaggggcgtgtgttttgttaacaaagacttcaagcatttactgaccaggcacaacactatgtgcttcataaataaatatctcatttgatccccagcattcttatgagacagatgttattatcccatttcacatgtaagaacattgaggcacagagtggttaagttacttgctcagggtcacacagcacgtcggtggtaggcaggattctggagccacaggaatctggtatatcccaggtgcaatggaaaccagtcacggcttcatagagggaaatcatcagattagtaaattttacacacgccccctggtgctttgaggaggagggattcggacaggggcagctaatggtggtggctgtgagatgtgttgggttaacattgatgagagtttgggatggatgagtggattcggagtaatggaaatggagggcccaggcccggcccctggagatctagctgcaatagctgttggctggagaggctgttcacttagatgggggatggggtgggaggcaggtgagatgagagctccagagttcagcctggggcacggtcattgggttcaagatgccttcagatgttggggcttgacagtgacagtggctgcagatacccaggacccagcagagggcctggcacagcggggcccagggacacgtctgtgagtcaggctggcactcaagtgtgaatctggacaaagaaggtggcattgttggcattgaatgctcaggggctgggtgaagtcagctagggagaggggctctcaaggcaccaggactgactccgtgggtgagggcggaggaggagacggcagaggctgagagaatagccagagacaggaggaaggtcagcagagccatgcacagaagcctggagaagatttgaggaaaggaagggctgggtggtcgtcattccctgcagctaggaggcaagggtgacccctgtgtgtttcattcttcagaggattggtggctccatctggtcagaaccccaagtccagagatgcatctgagcttcatgccatggtgcaggcagcaggagccatggagcaggcctgcggggtcacggcctgcctgctgcttcctggtgtctctaccctgagctcaggggttgcttggatgccctgtgctgcatccccccaggcggtgttccagagaggatgaaagtggctatctcaaggtgtgaccaggtagcggtccatgcacactgctttttcctggggagagtctgggatggaagggtatgtgtgtgtttctgagactccttgaataggctccatgtacctatccacccatcttaccacccacccacccatccactcactcacccatccacgcacccacccatccacccatccactcatccacctgtcaacccatctatccactcattcacccatccactcatccacctatctacagtcattcactcatccacccatccactcatttacccatctatccatccactcatccacctgcccatccactcacccacccatccactcatccacccatccacccatctatctatgcactcatccacccatccactcatccacctatccactcattcactcattcactcatccacccatccactcattcacccatctatccatccactcatccacccatccactcattcactcatctgtccatccactcatctacccatccactcattcacccatttatccatccactcaaccatccactcatccacccatccactcatcatccgtccactcacccatctatccacccatgtatccatccactcatccacccatccactcatctgtccatccacttatccacccatctactcacccacccatccactcacccatccatctacccatcctctcatctatccatccactcatctacccatccacttatccatccatccactcatccgtccatccactcatccacgcatccactcacccatccatctacccatccactcatccacccatccacttgtctactcatccactcacccacccatccactcatccacccattcactcatctactcatccactcatccatctatccactcatccaccaattcactcatccacctatctactcatccacccatccatccagtcattcatccatttgctcattcatccgccaacccatccattcacctgcctgttcatccacctacccatccattcatccatctgtccatccatccacccacccactcacccattcacacacccatacacccatccatttatccaaccatccatccccatccttacttcagaaagcatttgaagttgctggggtgtgcacttggaaaatgcgtcataagctttcataggcctctctttggcttcctcacttctttgattggtctttctttcggacatgcaggattctgagcagctcttctgggaggtgggtgcagtccaggtaggctgcctgcaaagctaggaccgagggagccacatccaaggcactgtgggttcccaaggcgatggcactgtgggcccactgcttccagacctcctcaactcccaggctcctgagcaggaggactcctggggcagggcctggagacgggaagagaaaacaattccagtctctcaactcttgtcagtccaggtgggtgctgcatggattgggggcacctggaacagttggccccttcacccctttcccccacctttccagcccctctggctataatcagacagttgtgtgcgatgtctttctccctcctgaaggggtcatttagtcaggctcctactcatggcccaggaatgtgcccctccctgcctgtcccctacccccaagcaggccgtgcctccagccccctgctgtctctgaagggcctgggcatggggcagcctctgcagcatccccagggcccgagctgatctgcacagcagaagggaattgggggaaagctttttttctacccagcacctggcagggggccaccctgttgcaccccagagacccttgtctaagttttgttatttcagatgatttcataagttgggggaggcggagccccagcccccacagcccctgttgttgcctcactgctgagctctgctgtgtatctgctgacaggtctgctgatagcagaaggggctggagagagggaagctctgggccctgccctccccaacccctgcttaggggacatccctgataagaggaaattccagcctgtgacagatggccagtgtccacccacccacgggggaacttttctttctctttgtaagtttgcagatttgccaggaactaaaggaatctctggttgacaggccactgtggacatggctggagggctggcacgggctggatcttggggttgctttgaggtaggggccgctcctgctggaaggttccttggggtggggaaggcatcagggccattccctgaccctccctctgcagtggatccacttcagagcctgagacaaggcaagggggcagcagaaaacagaatataaaatagccccccccaccacacaccgcaccagaagtcagaggattcatccttggcctgccctccctgcagcctaagttctgagagtggctctttaggaagtgaatggtgatggtttgcaggtcagagcttgctctggcccaagattgatgtctcaataggccgcggagcctgggtgaaaaaactcaggctagggaggtggtgggttgcaaatgaaagaacagaggagggcctcttccagaaagcggcgggtggtgtgaggagcccttggaccttgtccaaatttgactttaccgactggggccaattgaaaccgtgctggcagaaaggcaaaactgcttgagattccttcctccacaatagaggagaggtttgcttgaaagggtttggcgagggaaaagctggaggaaccttggccggcagtaaaagtggggacccccgccccctgcctcgggggcgcctcggcccctgaatgaatgaaagaggaggctggatggagacagactcacaccacctgtcccttccaggtcctgcaaaggagcacacagggttcttgttggctcttccaccttgttagtcaccaagaaggagaaaacaccaacaggggaactgtaaagctgcagttttgtttaagccccatagtggaaaccggaaagagctccagctcggagaaaaatgcagctctttgcctttgcaaatccgtgtctttctctgggaggccagagccattgtgctcgatttctaagcagggtttcagagtgtctcaggaggggaaggcagagtctcagatttccggcatcccaggtcctaaccaggctttgaggagacgcttcctgtcccatacaaagtgtgaagtgtaatttgatttggagttagttaacaaattagatgagctgtgtgcattttaaaaattcagtccttgatcccccacccacacacatttgcacaatttggtcatttatattcagtgtttccatctttagaagagaacaggaagtccccagtgacatttatggagtgtttgtagtagcttgggtaggtcagtaggaacacaatgcagtgaaaagcagagttgagatgggaaaatatcctgttttcagagccccccagggatgacattccttatcgtctctgtccacccgctctggagtccactccgcaaacagcaacttgttctcacttgagagcttcctcctgccggagctcagggatggagagcagctggcctcagtcttctcctcttacctctttgtttctcagactcatcttccaccttgaataattgtttttaacctgctctccctcttctctagctgtagaacccagaactttgtgtgtgtggtcaaaagtttagagagtgctgcaggtaatgctgagataaccctattaaattctgtaagttctcatcacaccaagtttgtttgttttttttaattctcattttattttatttcattttatagggatggggtctcgctacgttgcccaggctggtcttgaactcctgggctcaaacgatcctcccgcctcggcctcccagagtgccaagttatttttttaactgggatccacgggcctagggattctttgatgaaccgttcaaaatacgtgtgtgtctgtctgtctgtcttcaatgtatacttttctagggagagtctttacttttcaccagaggtttgtggcacacacatgtcctgtactactgtatcagattgtgaattccttacatgttaaagactgcttcaaatctgtccggaagtctcggctaataaacatttaaataaatgaacttcaaattcccatgtgccaccactgttttcattctgactactctcaagcctgtagtgtcatctttttgttactgtgaagtagacactcaataaatacttgtcaaatgaatcaatgttatggtcctggtccactaggaccccaggatcatcgtctaccattattgtctatagtttctttaccatcttgttccagagcagttctttctctgaggtctgctcacctctgcacgtgtgtctagtttccagccctgtcgccttaccattctctttcctttacctgcatttcctgaactgttaatagttaacaatagcttctccctccacccactcactcatacctgaagtgagaagtcatcattgaggtctctgtggattttgtcagcccaacctggggcggcctcctggaggtggagttttcagatgagggatggacattttggtgtctgctgggtagatctacctgggagctttggcaggggccccagggcagctctgcctctttattttggctgtgggacccctggtgcactagggtttctcaagtaagcatctgtgtcctgggagagccataggcaggcctgagagggcccctggaatctgggacccccagcccggcccagtagctggtaccatcatctttcttgcaagggaagttatggaaactaagatgctaatgtgctttgataggcctggggtggctctaagccctgggaagagccctggcaactttccctggctggcgggtagaatcttctcctggcagttcagggctctgcctccagctccctgggggagagcaactgagggaggagctggaggccaaggcctcagtgctgagctgcctgcaccgcagctgcaccttctgggtcctggctgcaggaaccccatacttctccagcctttccatggttcccgaagacctggcctggggagggggtcagcagcctggggctcacctacctggcttcaaatcctggctctaccgcttactcgctttgcgaccctcataattgacaaaagccctctcggtctcggtttccttatctgtgaaatgggacaataacagtggctaccttataggattgtgtgatgatccatcagttataatagctcctgagcagcgtttagagtaacacctggggctcggtgcagtggcttatgtctataatcccagcactttgggaggccaaggtgggaggatcgcttgaggccaggagtttgaaaccagcctgaccaacattagtgagacccactctctaaaaaaaaaaattagagtaacgcctggcacagagagcccccagtaaacctcggctgctgtgatgagctttgtttcttcatttgttcattcattcaccagactttttgccggggcttgccgtgagccctacgctgctctgaagaaagccgggctggggtgagcgtgatggatgaggtgtctggcttcacaaaccctgtgtgggggggttgtggtgagaggaaaccgcacacatcattattcagttaccatcgtggggagactgtctggacgcagagagcaggctctgtgtgggagcggggagggcaagccctggttgcgaggcagggcttccccaggattcagcagggatctgaaggactttgcaggcacccagggagataggagaggaggagggagcagccctggccggacactgtcctcctagcattgcctgcatcagggactcactcagctttaagaagcccctttgtgggggacagggagcatctgttagtttataggacctgaagtgcccccatgggctcaagtttctgggaaggcctgcaggtggccgtagggctgccgcaggggtgctggccccagggtctggattcaggggagcctgcagagggagggcagctggaggctgctccagtgtgcattgttacgaggcaaagtaaggagactgctgggcccacgctgggccggggtggatggaggcaaggaagtcttcgccggggcaagggcaccagctgtagatgccggcagctttctcctggacacgggcctggaaggctgacagggtgtggtgagtgccaccggctcccctgccgtggcctggtcagtggcttcacaggcctccgtgggcaggaggaggatgaccttgcattctgcttggccaccattggcagtgacagacaaggtgtgtggggatgtggccatttcggtccgtgctctgagagccaggtgtgggttgggtttggggaagacaggggaatggcattgacttgaccctgagcactttgtcctggggtgcaggcccggctgtcactcccctggagctgggaatggcattgggcggtggctcagggtcccttgccccagcggcaccatctctgcatttggccagcaaggctgatgggacttgtgtggacatttctgggacgtagaccaggcagcatgacacacagggaggggtaggcagagaagggcggcccctgggtcttggtttccaagtcaggctttgcaagcctgctgtgtcaagccctctctcggcaccaggccaggtgggccagggtcagccctggggctgtgatgagtgtgagtgcccctaaagtgtgtcatgtccaatagctgcctcctctctgggcactgcctcccagccagatatcctacagcccccgtcccagccacagacagcaatctgattccctcatcctcggcaggtcctggggttggggtaagaatttgtcactaagtgcagatgttcccagagggtgctggctcagggctgcgtggattacagccctttcatccctgccttagacccacctgcaactctggagaaaagatggcccagtggacgcctgcggggaggagggagctggtccccaggatgagcagatttgggggcagtccccatcacgggaccggtgacctactgccaccagcgccagtgaatggcagaggggccctggcataaggcctgggttcagaatgggaacctgcagagaaactgtcaaggtctcccgccacctgacacctccgcctggctgccaccctagaaacacccttgctgcaagaagatgggggagtttgtctggggcatggtctggcgacaccaacttgagaacctcaggcctaagtgttggcctctgggcctcagctgtcctctgagctgtaaagctggctcctgggcacttgtggaaaacactggactctttattttattttactttacattctgggatacatgtgcagaacgtgcaggtttgttacataggaatacaagtgccatagtggtttgctgcacccattggactcttcaatccagctccactagaaatgactgccttctttcccttcttccgtccctccctcctcccctcccttttttccttccttccctgtttccttccccctccctccttcccttctttcccttcctctcccgtcctcatggggatataatttccatattacaccatccgccgattcagaaagcacagttgagtggcattttttcacaaccttctataagcatcacctctaattccagaacgttttcctcaccccaaaaggaaacgccatcctcggtacacagtcactccccctcccccagcccctggaaatcaccaatctgcgctttgtccctacagatgtacttattctgaacatatgactagaaccctaaaagatgtgactttttgtgcttggtttcttgcagttggaatgttttcagagttcatctgtgttggcgcacgctcgtgcctttttatggctgagaaatagtccgctgtgttgactcagcacgttgggtttctccacgcatctgttggcggatgtgttagttatttctggagccgggtgtgttgtgctactcacgggctgcactaggagctggggatatcactgagtaagccacagcctcgggcacccaggagctcgcagagcaggagctgggagggaggtcaggaggtgcatggcctgtttgccaggctggagagacttgcaaaaagtcactttgagccagaaaccagagcctgaggcctctgactcccagctgcggagccgggagggaagctctgcattttgctttgactgtggggtgacgtgtcagttactgtccaaatcagaacctttctgagagtcgacgtgggtactgctgataattagtctggatacccgaaagaatggaaagcagggacccagacagatccttgcacaaccgtgttcgtagcagggcgaggcctggaggtgcgatggggatctcaacggggcagctgccgtcttgctggagcccacggtctttggggggggtcacaggtgttaaccgcatatcatacaagcaggagtgtgaaatttcagggttgccaaattcagtgagggtcttgtgctggcctggccacttacagtggcatttcaggaaaaaaaatcactctatggacctcagtttccccattagtaaagagtaggttggactggaattctgtaccatccagtatagttgccatttatgaaatgtggctatttaaatttaaataaaaatagaaattccgttcctcagttggactagctcagtgtcaagtgctcagaagtcacttgtgaacacactgtggcaattcctcaaaaaacgaaaactagaaccaccgtagcatcccataattccacttctgggtgtggattcaaaagaatgcacagcatcttaaagagctagagatatttgtacacccacattcatagcggctctgttcacagtagccagcgggtagaaacaacccgaatgcccgcggtcaaatgaatggagaaatcaaaggcgggacaggccgggcgtggtggctcacgcctgtaatctcagcactttgggaggccgaggcgggtggatcatctgaggtcacaagttcaagaccagcctgaccagcatggagaaaccccgtctctactaaaacaaaattagccgggcatggtggcgggtgcctgtaatcccagctacttgagaggctgaggcaggagaattgcttgaacctggggaggcagaggtttcggtgagccgagatcgcgccattgcactccagcctgggcaacaagagcaaaactctgtctaaaaaaaaaaaaaaaaagggtggaacatacaaggaatttgactcagccgtaaagaggaagttaggatacctgcaacagcaagggtgaacctttcgggtattacgctaagtgaaataatttggtcacaaaaggacaatcctgtaggattccacttataccaggtccgtagagtagtcagattcagaaaaacagcagaatggaggttgccagaggcttgggggatggggctggggagttgtttaatgaggacagtttgttttacaagatgaaaaagttctggagatttgttacacaacaatgcgaatgtacttaacaccactggactgcacacttcaaaatagtgaccgtggcaaacgttatgacaattaaaaggaaaagtcacgtggccagtggctaccacgctgagcagcgcaggcctcggacggtgtcgtggtcacagacaatggagtgggtgatctttaccattgtttccagctgtctgagcaccatggtgtcctggggccaggatgaaagtgtctctgggtatgggggtctctgcttttcccacttgggagtcctgaaggcagaccccaaagctcacctggccaggtaggagagcgaggcgggctcttgcattgctctctgcgtgcgtgcctgcctgcgggccagccggggcctgcaaggccgcctctcgagggaggggttgcaggaatggctctcacctgtgcagaaggcaagccactgccctacgtcaatggcaaagatggggctcggctgcgttgtattattatttctcaagcggggcccctggtgggcaggatgtttggtttgatttgagtttctgcagtgagtgctggtgcctgtggagggacccagctgcagctgagccggcccctccctcgctctgggctccaggggcgttgggggcgagaaaggagagttcagggggcagcgcctccccccaggtcctgctggggagggttgagggatgctggggggaggtgggggcgggtaggggctggtcccagtcccaggcaaaatggctctcagacccacaggcagatggaagcgattttcggtcacgtgggtggggactgaactgctgccccgcaaggcaaggccccatgtctggcttcaggaagcggccccaaagccacatggtccatggccagatgcagggctgtgtctttgtttatttaaaggtcctggaagcccaggggagagtatttctgaagggggagcaggagcaggagcaaagccctgaaggcttccaggctgcgtggcctgggtgggggccacgtgggggcacagagagaggagccctggcctccaggtccgcctgtgggtattgctctcagcagtggagatgtgtggacccccccttggcatttcccaacaaggaattatattgttcctttgttcccccaattccataagataggaattcctgtgccctgtggaggctgagaagacggggaggtgcctgtgaggataaaccagcccccagtttctggcttccagagtcttttcctctctcacctctgatgcctcaggcctggggagcctccctccgacaccctctgaccgctccagtgaaataggccgagagggatggcttgaatcggctggggatgcaggctgcagccagggggctcagtgggcatttcctgagttcggttcttgccccgcaagtggaagggcagttgaactgaagtctcccactgcccctcctggcctggaagcctgcctcccaccttctgggcagagtgaggagtgggcgtgggccgggagggctgcctcctgtctgggagggctgctcacttgcctgtcacgggggatgagccccctgcagcctcccgtgctgtggccctggctcccacgccggctccactcccctgtggctgcccctgctgggtgcccaccggtcccagggaaaagccactcccctcccggaggactggcgggaggggccctgcctgggagcgtgccgtgtggtccctgtcttagcgcaggatgcctgaggccagatcctccctgggaggcaggatggggcaaaagtctccccgcaggcagagcagggcctggatgggcccaagcagggacgggggcacagaacagcagccgcccagcctgcgtgggagctgagggccaccaagggcagctccagcctgtggggactagcagaggcaccacctctgtgaccagcgagttgtctgcacctgcatgcgcatgcaccagtgagtgtggcgagtctgaggtgtgctgggacctggcccgtgtaccagccagccctgatgggaaccagccccatcctgggtacccctggaaccccactgtgtgggagcacctgggtcctcagcaggcgtcttccgggcgtccgcccccagccccaggcctctgacccgtgtgtggtgtcttaacagcagccaggagcagggccatcgaagggacctacagacagaagaggctttagtgatttcgggaagttcagctccacgtgccccacatacccaagagtaaaacttggtcttggcctgtgggtgtgcagcccgtgggcgctggccaggcacacaagacggccgcctgggtcagtccagggggaggcagatgtggtgcaggggcccccctcctccatgagcccaggaacagctctgcatccaggcacccgccctgcacccagcacttttccttctcccaggactgctggctcgttctatgggattgaacacacaactccatggggaccgacgctggttctatccccctttcttacaagaccatccatggggatgtgggaggcggggacacacgctggttctatccccgtttcttacaagaccatccctcctgtgtcttggctcgtggatcggcttctaaggcctttgagtggcagcaggcggtacagcttatctgagtagaggtgaaggagagggccaggtccacctgggtggcccgaggcagtgtggagggccaggagaggagagcaccctccacccttgtctgagcagccctccagggtacggagacaggagttcagggtcagccctgccttggagcgcagggggcccccagcttggcacagctcctagaagaggagatgaaaaagcctggccttgggagtctggggatggagctttgctggggaggcagcgtggctgcaggatggcagctttttagaggacaccacggccagggacatccacccgggggaattctcaggggtcgcctgggcaagtcgcttagcctttctgagcctcagtgcctcagtttccccatccaaggatgggtgtgacaaccacctggcaggcgcctgtgtgtgagcccctgttccgctctaactcctctgctgttccttccccagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcggtgagtcctcaccttgcatgccactcaaccaatgccggaaaccagcctcagcccccagggcggcccacaagcctttgggcttggtcttcccttctgtaaaatggggcagcaaccctgacctcaaggacggattgccagtgacattgcgtgtgcatgcatgcgcctgggaggagcccacagcctccagcggctcctcagaggggcctgtcctgcacatccagggcccctgagatgactttggggagcccaggccggcctggagcaggtcctgatgagtggtcgctgcctctgagcaatgacgtcagcttgtgcagagggttctgtggcagctgtcccctcactgttgctccagcctggccctccaggctccccaccgcaccccaccgcaccccggccagaggcttcccagcagctcagcttcagctctgccctggaattggggcctcgtggcttccacaccccctggtggccccggagagctggaggtcaccacgggaggtcgtcgatcagcacgacctgggcagggtgagggggccaggctggagtctacagtgggccgcctgttgtttccaaagccccccaggtcccattcaaacctcacagggaccctgtgaagggggcgtcccgttttccaggcagaagcgaggctcagggaaggctgccaaggttccttagctcacagggcagagaaccgcagccaccgttttgactcccagaactgtgttctgcccactccacggggtccagggaggggtctggggaagtgcccccgccaggtcacaccctaaacaaaggtgagcttgcggggtttctgcaaggtgtctgggcacctctcaggccgggcctgtttctctgacctttgccagccgtgcacgtccttcctgcccagctctgtggacgcaaacccacacctgccagcccgacacctttctttcctcttctgcactgatctgggccctggctcccctggggtcttggtgtcctctctgcttcctgtagcctcatgggacccggctgctcatggccctgctgtgctcacagctgcctggaagctggcagcctgcttcaagggagggcggaggtgtggggtcccctcctacggcccccaccctgttctgcctgttgtgggggacgtgcttgtaccctgaggattcagggctgcctcccgggaagatggctggagagaaagagaggggagaggcccaaaggcagtggccaggctgggactcatctctgtgggctacggaggggctgccctgctccctagccagggacagggtgagaaggacctgggaacctctgcgtcccagccatggcacaggccttcttccggagctttggccccaaggagagggagaggcagcccagcagccctcgccttccgtggctgccactgtgacagccttgccctctgggaatggtgcgcaggaggccacttcacctgtctgggcctcttcgccctttcaaccctgagaagaacagtggtcctgattccccacaaaatcactccctcccagggatgccgagtgaggaacaagacgtggggcagctctgctctcctccctcctccctcccatggcagctgtgcccacctgcagaggtgcaggcaaggtggaggggcacctgtttggaggtccacagaccccggggagaatcccagctttgtcctaactcagcggggtgaggcttgtgtgtcttcccctgggctcctcctctgtgagccttagcttcctcgtccataaaatgggatcatcccataaagtgagatcaagcgagctaggccccgggcagggtccccaacaggttgtggttgttcgagaatttgcagcagtggtgatggtggttgtggtgatgaggatgatgggggtggtaatgacggtgatgatgatggggtgatggtgctagtggagatgatggggatgatggtgatggtggtggtgatagtggtgggatggtagtggtgatgtgggtgatggtgattgtgatggtggtggtggtggtgatggaggtgatggtgatagtgatcatgagggtgatggggatggtggtggtggtgatggtgacagtggtgggatggtagtgatgatgtgggtgatggtgatggtggtgatggtggtggtggtgattgtggtggtggtggtgatgatggtggtgatgatggtgattgtggtgatggtgatggtggtaattgtgatggtggtggtggtgatggtggtgatgatggtgattgtggtgatggtggttatgatggtggtaattgtgatggtggtggtgatggtggtgatggggatgatgatggtgattgtgatgggggtggtggtggtgattgtgatggtggtgatgtgggtggtggtggtgattgtgatggtggtgatgtgggtggtggtggtgattgtgatggtggtggtggtggttgtgatggtggtgatgtgggtggtggtggtgattgtgatggtggtgatgtgggtggtggtggtgattgtgatggtggtggcgatggtggttgtgatggtggtgatgtgggtggtggtgattgtgatggttgtgattgtgatggtggtggtggtgatggtgatgatggtggtgattgtgatggtggtgatgggagtgatgctggtgattgtggtggtgaagggggtgatggtggtgattgtgatggtggtgaagggggtgatggtggtgattgtgatggtggtgaagggggtgatggtggtgattgtggtggtggtaatggtgatggtggtaaaggggtgatggtggtgattgtggtgatgtgggtggtggtggtgatgtgggtggtggtggtgattgtgatgggggtgatgatggtaatgtgggtgatggtgattgtggtggtggtggtgatggtgatgattgtgatggtggtgaagggggtgatggtggtgattgtgatggtggtgattgtgatggtgatgtgggtgatggtggtgttgatgggggtgatgatgttagtagtggtggtgatagtgatggggatgatggtggtgttgatggtgatagtggtgggatggtagtggtgatgtggttgatgatggtgctggtgctgatgattgtgatgacagtggtggtggtgatgagggtgacggaagtggtgatgatggcgggagtgatgggatgatggtaatagcagtgatggtattgtgatgatggtgctgatggggatggtggtgatgataagggtgatgatgatggtgatgataataataaaagtaacaataataaagggatacaccttgcagtatcccagttggcatctcctagatctaaggtgtcgtggctggaacattgacataactcctgacctgaggttggccaggacacagacctggtggacagagagagatggacgaggagtgtccgtccttgggctactaaacagttcaggccagggattcccagcaccagcctctgtcctcccaggagcccacacttttcctagaaaggtgttatcaaagtcagaacatcagtgtaatttagggtgttttttgtgttgtgtttttttgagacagggtctcattgttgcccaggctggagtgcagtggcatggtcttgactcactgcagcctccacatcctgggttcaagtgattctcgtgcctcaggcatgtgccaccatacctggctaatttttgtgttttttggtagagacagggtttcaccatgttggccaagctggtctcgaactcctgacctcaagtaatccaccctcctcagcctcccaaagtgctgggattacaggcgtgagccatctcgcctggccgatttttgtttttttaaaagacagggtctctgtcactctggagtggcaatgatcctagctcactgcagcctcgcactcctgggcttgagcaattctcctacttcagcctcctgcgtagctgggactataggtgctcgccactacacctagccaatgtttacattttgatgtagagacagggtctctctgtgttgcccaggctggtcttgaactcctgggctcaagcaatcctcctgcctcagcctcccaaagtgctgggactacaggcatgagccaccacacctggcctagggtattttttttggtgtgttgctagcgtagcccaaggcagctctgtgcagggtaaagcaatggggctccgagtctggaggggtgtgtgtgtgtgtgtgtgtgtgtgtgtgtgtgtgcgcgcacgcgcgcgcgtgttatatgtgatttgtttgtgtgtgttgtgagagttgtgtgtgaggtatgtgtaagaggtatgtttgaggtgagttgtgtgtgtgttgtgagttgtgcatgtgaagtgtgtgtgttgtgaggtgtgtgtatgaggtgtatgtgagttgtgtgtgttgtgttgcatatgaatgctacttcctcatcctcgtttgtctcagtcacctgtggactggctgtctgcacacacggtcactgtccctcgagtggcaccaccctgcaggccagcgccccctagcacatggccccacagaccccatgggacatgcgtgagcctgcctgatgctcacaccagctccacgggggaaggactgtttatcccattttgcagatcaggaaactgagacacggtgaggtcaggtgacttgcccaggccctggccggtcagggaggagcagtttgaacacctgggctttggttgcaaccaccctggtgaactgcaggaatcccggccacctggtgcaccctgggcagccctgggctcctccgccagcccggcctctgtcctgtccaaaatctgagccaccaggagacctcctgtccagaaagcacaaggggcacaagagatgccgactctcccaggcccggctcacctctcaggagaggactgtggcctgggttgtgctggcatcagagcccggctgtgtgggtttacacagtcactggacacccggctcgagggtgaagtcctcgggggctgcttggcagggatattgccgggaggtagcccaggcactgctgaatctcagactggagagcctcgtgcctgggtgggaggggccccatgtgcagaccctgctggtctctccggagagacccctgaccggcctcccatcctctccccagggcagagcggcttgggtaaatccaccttaatcaacaccctcttcaaatccaaaatcagccggaagtcggtgcagcccacctcagaggagcgcatccccaagaccatcgagatcaagtccatcacgcacggtcagtggccgggagtgggctgggggtgcaggacgcccctgccttcctggagcacaggggttgggggtcaagaccatcacacacagtcagtggccaggggcgggctgggggtgcaggactcctctgccttcctggagcacagagtggggggtcaagaccatcacacacagtcagtggccgggagtgggctggggatgcaggacgcccctgccttcctggagcacaggggttgggggtcaagaccatcacacacggtcagtggctggggatgggctggggatgtgggatacccatgccttcctggagcactggtgcggtgtgagggtgcccgagtcaggcaatcccaggtccccaagacggggactcgctgtgcccaccatccccagcatgttgagcatgttggggctctggctgtgatgggtcagtgtcccggacccctgtgggccccgtcacactgagctccccacagacaactgagttttccaccaaaagtctgacaggcaaggggctcccaggggaaccgtcaccggcctgtgccggagttggctgaggaaggccattaatttcccggtgtctccttggttgtcatcgctgcctacctggggttgccccggggtcagtcaggtgtggggtgtctgtgagggtcttccgtctcccctctgactctgcgtccgtggctctgtgcagatattgaggagaaaggcgtccggatgaagctgacagtgattgacacaccagggttcggggaccacatcaacaacgagaactggtgaggcccctccagggggaggagcactagcgggggcttcagggctccctggaccccacccagagtcagccctagaggtttcccggcccgcgggggtgcagggcccacctcctgggacctgacatgctgccaaagccgcacgtctcaggggcctgaaaattctggaccaaagcagaattacctggggaatcttgctgtccccaactcatcacctgaggccagcccggggaggctggtttgggaggccgagggtaaggctgtggcatctccgctcagcaagccagacctcccagggcatgcatttcattggaaggtggggtgttgggctctgagtcctgggaatgcacgacctgcttggggagggcatctcatgtgcctgctgactcgtccccatcccccacgcagctggcagcccatcatgaagttcatcaatgaccagtacgagaaatacctgcaggaggaggtcaacatcaaccgcaagaagcgcatcccggacacccgcgtccactgctgcctctacttcatccccgccaccggccactcgtacgtccctgcagtgtcggcgtcctcatgccgggtgccctgggttccctctgtcccctgggactgcaagacggtgctgtctgccctgctgctgggtgcagaggggctgagtcaggggccatggccgccagctatgaagttgggggtgtgccatgtctgcacctccaaagcctcacactgacccctatgcaagtgtcctgcccagcccccatccttcagctgcgtcttggggagctgagggtcaggcaggccctgggctgttctggagcctggtggtctgtgtcctgccttctcaggccaggctctggcaggtggagtgggagcccccagccaagcacccgtagcggtgactgaccttctcatccgggccctgcctcatgggaccccttagagggtttggtgcgttcttagacgggaagcacagagatcagtgctggccccttccagggctggacggggctgctgttggtgttggtgagagccctttcctcccgccggctctgtccgcacctgacgtcgcccctagagatcagcaagggcgggaggctgcatgtaccctggcaggtggactcttcatggcctcacggaccctctgtcctcagctccctgtgcaccccctgccagacacctgtggctcaccctgagccagggctgggaggaggaggaccagaggccagcaggagtggctggtggaggcagccgtgggtggcttgtctgcatgggtgggtggagaaggtccttcgcacctgctgtcccagatgtacttccctgggcggaggaagcccaggggtttggggaaaccatactctgtgggcaccaggtgcaggaaggagcctggctggtgggcagcgggcctcacccagagtctgtgggaaaacccaagccggagttttcgagcccaccctctggcatcatcctctgtgggccagcaggagtcaggggcagggggccagcccgctgtccatgggcctctcctgaactgaacatctgccctcccaggcagaacggctcacctgcggtcctgtggcagctgttccagctgctccaagctttgcctcagctgaggctgatggcaggaggcagaagcctctcctgatgccagctgggcaagccgagggcgggcgggcggtctgtggcacttctgccactccccagcactgaccctttggctgggactccagctaggcatgttgcctggtcccgcccaaggcgtccagtcccatggggcaggggcgggccttggccatctctgcttaaacttctgcccggagcgggcttctccccagccatgtgtgtgaccgatttattctcactgtgggaaaagctcggctccagaactggggaagatggtgccccagttccagggccctgccagcccctgccacccacagctttccccacatcagaccccaggctcactggggccaagcaggcaaggggagcagcccgcctggtgcaggggagcagcccgcctggtgcaggggcaccgcacactggtgctagcttctatttctcttgcctctcccctcccagccaaagccccacagcaagacggctgctgagccaacgacagcccttctgtgtggacatgtaggggtgtggttgggaccccagaactcatggacgagggtgcttggagctggccctggcccgcctggcctgtgcagtggtgtcacctgtgtctgggacacacccgtgtccttcctctgccccacactcacagcgtggccgactcggcccggggccctgtccttgccagcagggacccccgtgagccccgagccagcacctgagagtgtcgacacctgcttgggggtgggtgcccccccactgccccgctcccccagatgagcctcacgcacatccctctgcttcagcctcaggcccctggacatcgagtttatgaaacgcctgagcaaggtggtcaacatcgtccctgtcatcgccaaggcggacacactcaccctggaggagagggtccacttcaaacagcgggtagggttccatctctacttgccccagcccttctgtgcaacctggagacgctgcaggcctggcaggggccaccccgtctaaaggagtcacactgtcagggagaccgaaccgctggtcactctccccagcgggtggctggcctggtggtccctggcccaggtggctgctgggggccgtccctgagatggcctctccagctcccccatatctcaaaagcagctttgtgggagtgccaattctccagcagagtctctgaggggggttttggagaagacctggaccaggcagatggtgaatctctcttccagggagtgaggccgagcaggggccgtgcgacatggcccaccttgttttatgccccccctttttttttttgagaaagggtctggctcagttgccaaggttgcaatgtagtggcacaatcatggctcactgcagcctccacctcccaggctcagtccccgagtagctggaattacagacgcacaccaccatgtctggctaatttttgtatttttagtagagacgaggttttgccatgttgcccaggctggtctctaacccttgggctcaagggatcctcctgcctcagcctcccaaagtgctggggttacaggcatgagccacctcacctcgccctgcctggtttttattagatggaagagaagctgggccaggtgtggtggctcacgcctgtaatcccagcactttgggaggccgaggcgggcagatcacttgaggtcaggagtttgaggccaacatgatgaaaccccatctctactaaaaatacaaaaatattagtcgggcatggtggcgggcgcctgtagtcccagctacttgggaggctgaggcaggagaatctcttgaacccgggaggcggaggcttcagtgagccgagattgagccactgcactccagcctgggtgacagagcgagactccatctcaaaaaaaaaaaaaaaaaaaaaagtttcaggagggatggtctctgccaccttcttctccgccaccgtctgaggcccctgctgtgggatagggaggggcatccaagcaagagggcagccctgggctcttcctcctgacagggcagcacatcagagccacatggggtgcctttcaaaatgaaaccgaggtgcctgggctgcggcaccacatctgcctcggtgggtgtgggtggggcctgtaacctactccgtcctggggccaggtgtcagggaccttcccagcatgtgcaggggaagacagtccacacaaagtgggtgtgtctgccggaggctacacacgggctgtggtctgtgcctgggcaggcgagcagccgctcactgggatgtttctgttgcacgtacccatgtcgggctgctggcagggagctgagaggttactgcaggcggggcccctgctggaactggggactgtgacgagggttttttaggaagggtttcaggaggggaggtctcggtaaccctgagtactttcttggggctgtgatgagcaggagaagagaggtgggaggtgctcaggacgatgaccttaagcccctggggagttgcagcgtcgctcaggacagcaggtgcacctgcagctgcccctcttccctccaggaggcacaggagttggaggtgattggtgtcacagccccccagagcctgcccttgaacccgagcctggggcagcacacagtgtggaggtcatgtggcaaacaccagtgggtgggtagagcttgccacagggatgggcccatctctctccctccttatcccagatcaccgcagacctgctgtccaacggcatcgacgtgtacccccagaaggaatttgatgaggactcggaggaccggctggtgaacgagaagttccgggtgagtggatccactaggatgttgttcccaggggacccccagttcctgctgaagggtgggttgggggtttggaggaccttaagccatgaaattatattcttggggccagagggcactgagcccaggtgtctgtacccagtgctgtcaggctgaggctctcgtttttgggggaccccaggctcagggcagctcctcccgggggcccaggggagggaattgccttcccgcacatgtgtaaccaataccgtctgcccgttccccaggagatgatcccatttgctgtggtgggcagtgaccacgagtaccaggtcaacggcaagaggatccttgggaggaagaccaagtggggtaccatcgaaggtactcgccgcaggcgccggggctccagacagatgggaagacagtctcttctgctgacccagagcctgtgggccacgcctgagccagggactcgtggaacctcatccactgccttgccccacccagagggaggggtctccttgtccccattcaacccttgggaaagtgagagggcaagtggcctgtgcagatgcctccaccccagacctccccccgggcagggaaagattcagggagacaggagctgggatgggggccgccaagttctggatcctggtgcaggctctttcataggcacctgtgtggccctggacaaatcgcccaacctctctgggcctagaaaaggggtgggctgtagctctgtgagccagatggaccctcggccccttaccctgctgaagttcctgggaccctcacaccttagtctcttgagtggctgttgtaaccaattagcacaaacgaggggacttaaaacaacacaaacgtattttcacagttccagaggccagaggtccgaaatcaggggctgtttccttctgaggccctgaggaccagcctcatccatgccttcctccttctggtggcgcctggcattcctagttgtattgtaaaggcatcacatgctctaatctctgccccattgtcacagggccttcttccctgtgtctctgtcccgtccctcctcttcctttttttttttttttttttttgtttgagacggagtctcgttctgtcacccaggctggagtgcagtgttgcaatctcagctcactgcaacctctgcctcctgggttcaagtaattctcctgcctcagcctcccgagtatctgggattacagtcacgtaccacccacctgacttaatttttgtatttttagtagagacaggatttcgccatgttggccaggctggtcttaaactcctgacctcaggtgatctgcccaccttgcttggcctcccaaagtgctgggattacaggaatgagccaccgagcctgccctctttccttcttgtctttggacaaggatgcctgtctttggacttagggcctaccctaagtggatgatcccatttggagatccttaatgaatctataaagaaagacgttttccaagtaaggtcacaatcatgggttccaaggcctggaccttgaccatgtctttgaatggatgggagcccctggggggccacagttcaacccactcctggcggtgacaccccgggagggatgggcccgaacgtttccttccccttcctctctctgtcccttcatttctcattagaatggaagaggggaaggtgcagagggaaatgcagcaggaaaagccactttgttctgggagagcacttggctgaaaggcccagtagagcaggaagcacaagtctcttaatcttccagggcctcagttttcatcatccacaaagtgggtgcagtgtgccaagattttagtgagttgagagactgtcccaaagaccacagagctttttgggaagctgttgctctaaaaaaatggtcataatgacaattaccaggaggcatcagacactcctgtgccactggctagacatgggttatctcgtttcatgtccgaagctccccgcacccaccctccttgcagagttgaagaggtgctgtgagcagaaaacctgccaagggacccagaacgggaggcggctctagaatctacagctccagccctgcaccagactccctcgagatgggagttcatgcctggaggagggtgtggagaggcacacgggcctttcccctgtctgcactcctcccctaccaccacccctgccgggcccaccctgcgggagctgcccagctgggtgcagcctgggtgttttccagtatccgcctgtggtgtcaggctggcttgcctccccttggcccctctgcctgcagttcctctcttcctctctgcccaaagagttcttgctgtttaggaaactttttatgaaaggcaggtttgggagagttagggatggatgggcctgggacgggccggcggctttgctatgggcgtgcctctgctgcaccctggtggccaaccttgagtaccgcaggtggccggtgacagaaactgtcaggaaatgcacaagagagaggtccccgcacctctctgacctgtgcgttgttgagcaccactggctccagctgaggaagagtctggaacctgtcaggacagttgtgaggtggtggggcccactttccagcagtcttatatgaggaccctggaaatgtgccttcagcactgctgggtttttatatcaggggccccatgagttcatagctgacctgacacccggactagtaagggctgtgccttgttcttgcctcccacttggtgaacagcatcttgaggtatctttcccatccttagaaaccaccccaagtattgtcaatagaaatgtggggtgtaattgatcacgccatgaactcatttaatcctcatgtccctgagaggcgggtgacgttattatccacattttatggatgaggaaactgagggaatgagagtaacttgcccgagccagggagtggcgatcacacactccaactccagcctgagagccccattcttcctgccggctctcgctgcccgtcagtgttagatgagagtgctgctggtcagtctgcaggaggttctagtgtggacaccgccctacacagggccgtggcaggagggcctaggcaaaggcaaccggcatagcactgagagcacttgagggctgggcaaggtggaggccccggccctgcctgctggcctaccaagtaaaaactagacatttttaacttggggaaaagccatgtggctctgcgatggggcagcctggagccaggtgtatgggttctgcatcccgctccagccttatgcactgtggagctgagacagacacagttcttgcgttctctatgcctcattttcttttcttttctttttctttttctttttttttttttttgagacgaagtttcactcttttgcccaggctggagtgccgtggcgtgatcttggctcaccacaacctccacctcctgggttccagtgattctcctgcctcagcctcctgagtagctgggattacaggcgcctggtaccaggcctggctaatttttgtatttttaacagagacgagatttcatcatgttggccaggctggtctcgaactcctgacctcgtgatccacccacctcagcctcccaaagtgctgggattgcagacgtgagccgtggtgcccagcgtctacgccccattttcgtaagataatggggataacaaaggaatcacaagagacacttgcaggtgtgtgaagacgaagttcatcacatgggagggcaccgggtgtctttatttgccttccctgcccggctccccacctccagtgatgccgttcactgccctccttgttaaaaggccttctgttatataacagttacacatgccaggcaccgcgtgttcatataggagttacgaagcacagcaataaaatgaccactctgagatggccaccagctcgagcccgagggcacttgtgggtgcccgtggtctcctgcccagtctccctgagaagtggccactgtcccgagcttgggcttgtatgtattgtgtgaagtgcacatgtccctgagcaatgtttagcattgctgattcttgagcttgtgaatggtcgtccacagtacgtagcccctgtgtgtgtccctgtgtgtgtgtgctctgagcgcacacaaggtggatggggccgtgggggtaacaccctgtgggccacaggttttctttaaaatcccagctccgattcctgcttcatcccattcccagcagcccagccccctgcctgtcttcaggcccctgctgggacgtcctgctctccctggtcaccccagtggtgcgggggcccactgccctggcttctccactgtggcttccttccatgctcctatttggcctggtcactgtgccatctcccattagccaggaactttctggagagcaggagctgagctgtccaggagcaggagctggtgctggtcactccagtatcccccagactgagggcagtgccaggtgtcctatactcagctgcagagcaggtggttcccctgccctcctgcccatggggctgccctcagactctgcttttggcaccagcatttctgggcagggggagagaggtggggtccgggcagagtttctccactgggacattaaagcccctcctgtctcctctcctagttgaaaacaccacacactgtgagtttgcctacctgcgggaccttctcatcaggtgagagacagggtgcttgggtggggctgacggcttcacccctaagagggccctacagcgggtgggggcagtgggtgtggggccgaagccctgggcagagtgggtgccccctgccacctgcctgccctgccctcgggaagatcttggaagcccatcttctgaaaaagaaaacccactgggaaatgaagcaggcagtgaagatccttttcaacccctgcgaagttggctggatgggaaggctgagctttgatccactgtggtctggcccgttagagctgcccggtggccactaagggcccagtgaggcctcatgtgcaggccctgccggcagcgtggggcgtctccagctccgatcccactggcctctgacccctacccctttcacctggctgaggcttctccttgtttcccttgagtccaggcaaggaggggaagccctgatggagagggtgctgggtgggtggtccctggagtgtgggccctggcctgggcaggttcttcctcagcaagcagctggcatggatgatgggaatgttatcaagaggaggggcctccaggttggcgggggcaggggtggggggattccgggagccgttctgccattgtggggatactgggctttccaacctccctccagattattcctcctgagctgcagaggaatgaaaatccgagcccaggacttttttttcctggggacaagggcaacccagccctttgccccaggccacctgcctgccacaggccatagtcctggaggccggtggtcacccactgcttccaccctgccagcaccctggacaccggcctggagcaacaatgctccagccctgtccctctgagtctatgcactgtccctgggccctggacccagggccatagggtggacccagagggagacacatgcactggaatatgtgtgttctgaccgagtctgggcttaccagggggactgacccttcccccaaaacgtgtaccagatctggtccaacatggtgggcctgggggaccccatggggagccaagcagtcgggatggggagtgggggtgggggcaggcgggcctgagtccgaggcaggccgagcagggcccctgccccgctgcccccaccccgctgcgcccacctcactgacccgcccgccccccacccccacaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccagaa

SEQ ID NO: 1828 - DNA, 127408 bp, Homo sapiens
cccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgaggggagacgggagtgcgctgaggggagacgggacccctaatccaggcgccctcccgctgagagcgccgcgcgcccccggccccgtgcccgcgccgcctacgtgggggaccctgttaggggcacccgcgtagaccctgcgcgccctcacaggaccctgtgctcgttctgcgcactgccgcctgggtttccttccttttattgttgtttgtgtttgccaagcgacagcgacctcctcgagggctcgcgaggctgcctcggaactctccaggacgcacagtttcactctgggaaatccatcggtcccctccctttggctctccccggcggctctcgggccccgcttggacccggcaacgggatagggaggtcgttcctcacctccgactgagtggacagccgcgtcctgctcgggtggacagccctcccctcccccacgccagtttcggggccgccaagttgtgcagcccgtgggccgggagcaccgaacggacacagcccaggtcgtggcagggtctagagtgggatgtcccatggcccccatccaggcctggggatatcctcatccgcctcccagaatcgggccgtgggggacagaaggggcctgcgtgcgggcagggagagtattttggctctctcctgtcttcggggtttacaaagtgtgttgggacttgcggggctgctctgtccaagcctgggtctggcgtccgcgtctctgagcctgtgagtgcgtgcgctttcctgcgtcctcttgactgccggtgctggggctctgcgtcctgcgtccgcgggagtaaatacagcaggcgaaggggaagctcacacaatggtctccagcgctctggggcagggcttctgaggggcgggcctgcctctgccgggacctggagcccccgcccctcggagaggctcctaggctgacttgggcagagccctctggtgggccgggagggggaaaggctgtgttgaaatgagcaaactgtccaggtgtcaggccaagctgggaggtgaccagcctgaggtcctccccgctccatggccagaaccagggctgacatctgggtgtcctgagcccagctgcccacacggcccacctggggtcagccctatctgagtgggggaggcggggcctcctgggggaccagaactttggctggacgccaagcagagtgccagtggctgttcttcagggctgggcctgaggagggtgtggggcggcgaagggacgggagggggttgtgatccagtggccactggcgctgtgcagagtgtgagctggaaacatcgtagttactttgtcagcttagtggtgaaagccctttttcaggctctatccctttgcatccctgcttcccagagggaggggaggtctgggtctgcagagctgggagggcttgctgttcccgcccccctcccccacaacacctcctcatctggacatctttgggcacatgctcatactggggtctccctaggtccactgtgttccgttgagcctcctgcagtccccgagtgaatgtgacctccctgcccctgcctctttgcaactcctccctgcgaccgctcctccaggggccttccttgtcccaaatgtccaagtggcacgacttagccggtctgaccactttccagtaagcccttatggagagaggccctgtgttgtgcagagctctcctcctgcctgcgggatcgaggtctctgctctcagttcctaacagaaagtgtcgggcccccagtgggatttctggggaagaactctcgtgtctcaacgggagccctgtggcgggaggggaggccagggtttggggttgtgttcgttgtacagctgtcaccatttgcactatgaaagttgttagtgccccttccttgggtctctgggtgtaactccacccttgcccccatgtgcctccatctggagctgcttctgcggctgtctcccaagccagttttgtgaccctgtaatttagtccaagacaatgggctcattgagaccatcctggtgcagcagttggcaatcctttggctctgggggaaggtttctcagtctcggggagtggggcctcaatctgctggttccctgtgtttatcagtctcccccttgtgtgtcctgaatggttttgctgggaattctggtcttagagccatcaggtggcccgagtcgataggcgtgagagagtgtgtgtgtgcatgagtgcgcatgtgcatgggggctgacctggggtatggaaaggtggccctccctggtgcccaaggagcctggagtatagttggagggtgtgggggtgtgtatatgggagttggacaaccttgggtggacagacagacgtggggaagggatgattgaaggaggtggaggagagagtgtgattcagcccagccaggggtgatgtggacaggcagcttccgaatcagggtagagaaaagtcaccactagctagcaggggagaagtcagtatggaggaggcggaccttgagggagagtaggaattggattgcaagaggaaggagagccttctggccagcagcagccagcagcagtgggggaggctggaatgagctggctggagagggggctggggcataaggaggggcctgcctgtgaagatcatatgggccaggctgcggagggccaggcatgcccgccgggagtgcagctggtccacgggaagcatctggagtggctgggaatgggcgcaggagcagcgccgtgggagcacaggtctctttcccggggcggctcacctggtgtcttggttcctgcaaggtaggccgaaagggtggggaggaaactgccagctccttacagcgctgggatggtggccccagggttcctgaggccagcggatgtgggtgcctgtcaccatgtgggttgctgaggggcggagactccaggggccaccccaaagcaggacgagctctgagccacggcatctctgggggcagttttccaatcgagcagacgtctaggcctggaatcctgtaacagaggccacagggccctgatcagggtgttctgggaggcttagaactagtggcagtatacagggtagacggcaagtgacctggcatggggaaagaggcaggtgcccaggccggcacagcacacccgtaaggaacaggtagacgggaagccgtccgtgggcctgtgtgtgtgctcggagttaaaattctgccaatgtcccatgtcctgggcacatctaccccctccctggggagcacctttctcttcaccttttccttccccgcctgtccccttcacccagggccttccccatccctcccgtcttggggaccgagggcaccatggctttatgttccatcaccgatgagttgcacagggattcagtccttccgctgttcaggccgggtccttcaggctcagggttcccaggaatggagagggtatcagtgtcttccatggactcaaacttcccgcatcccgcctttgctcccccttcaagataggtctccgagcttcaaggttttagggctctgtggaggccgccacgtagcagcaaggagaatgttttgtatttggctgatgagatttttagagtctcattttctacttttccactgtacaaacgggcctccaggcgactgcagcacccgccactgcccgtaatagggtgacaagagggatgaccctttcctctttctcccttctggttggtggaggcacggggctggcggacggcatgtgctttcgtgaattcaggccaaatctgttatcgcaaacacgattacaactcgggtctttgtgtaacaaaagcctttccaagtaccagctgttggcctgctttgctcagcggtgtttgctgtaaccagatttgcacaccgagaaagaatccaaaagtccttgatgtttgttgaaacaatctggcccaggacccacgtgctcagatcccagagctgtgtggcatctgagcttctcccgagcccccactgtcgcccgaggaggacccccagatctgtgttctggaggcagagcaggctgtgggacgggcttctgggtgggaaggaccatgtggatatgccttcttgtctgagagtcccaacacctccgggacgtgggagctggcgcgctggcaggattcaggtgcctctttcctctctagagaaaaaggccccgttgcttggtaataggtgcagacctgtccctaattaatgccagtaggcctcttgcgtgatgaaccctgcctttcagccaagactcaaggcatcctgtgaatactgcctctctgcagtttgagcttttgtggtgggaggcaggagccatggggagtgggggcaggcctcttacacgggtcccacagccactggcagcactgacttgatgctctttgagttcagagcccagggccagacagacccactgtcccgactacgagttggttcatttagaggggggcggacacagcacccaggcagcagatgcactgtgatcagccttgcagcggggctgtgggttctctgggctggatgtccgggaagaggcaggtggaggtaaacgccaggacacccctgcagtgactgggtgactgcaggctggaaatgctttctgtgggctgtggctgtccaggaaggttttgaatggggctagtggacagagtttgcatccagaggggcagtgctttggaggagtgaggggtatggcagtgtagggatgcccaggccgccctcactctgccattggaaagctgggcggcttcggtttcttcagtttcttcgcctgtttccctgcctgcaaagtggggttagaaacagctctctttgagggttgctgggggactctgagatgcagcccatggcgctgagcacgggtcctgcctcctacgggtgtggtgggtgtcgcggctggtgtggcatctgggcgggaaaagggggcatttgcaaaggacaggtaggtttggatgcttaaatatgcagatctggggatgggaggtctcaggcaagggcctgtgtgatgccactgtatgaatgaggccggacagcatggtcaccactaattatggaaagcacggcagacactagtgccagtagcgcccgcctgggggtccctctgagcccgacaggtactcaggctcccagtgcagccatgggaccccccttttcctgcctggctgacattctggaggctggcgtcatgttggctgcaggttcctcttactgggaggttgtcctggtcttccctgccaccatctacccccacccccaccctggagtgtcacagatgggtggaccatatgcccatctgcagggccaagcgctgacaatgaggtgagcacttgctggatgaccggaccatgaggacagcgggggcgctggcagcctgcgttcggctctgcaggctggcctttccctgaaaagcggttgtggcagagtgtgcatcccagggagtggtgcctgctgccctgaacattctcatccagcaggcctctgcaagggcccagtcaagtgtggtgcagagctgggctggcagctggaacagtctcatcttgtctagtggtgagaccaagggctgatgggccaaggctgcgtgctgcttgcccagcccgtggacccatccactgagcacccccatacccctacactgggcccggggtgtcaggaggtggaggggggactgggtgcctggaaaaacaagcccaccgagagcctgagcccccaggggtcagtatcaggcagtcaccacggtgcccggtacacagtggccacctggtctcgtcggctgtcttggtggtggagagcgtgcatggtggccgtacgtgatgggcatcacccagggtaatacagatatgcagactgtgcatttgtctgtaggagccagggacttctcagcctggcaacctgtgacctctgcctacccgttgggagagaggtgctgttccctgatagcctggtgccgggagagcagaactagggtctcctcctcctttctccacctcccatttcttacatgcccaggcatcaggggaggtcacactcagggatgagtcttggccactgggttcagggcctcactgttgccatctcttccctttgccagccagccaaatgcccgtccatcatcgtgccggggatggggctggcctgctcctctgaagtctccttggtgtatagcctaggctggagccccggacgattccgccaccccctcccccgactttttctttttattttgattcatcccagaaacccagccaaaaaccaagttcctgtgctctcccttgacaaagccactgaggaaaaatggtcaaacactgcctttctttccaaagccctcttggtttttcccaaatttggaggctctgagttgcttatgagaccaaagggtccggaactctctggaacacagtcccagaagtgggaggatttgtcatctctccagccaaacagacccaccagttggcccctagacacccccaggcgcctggggcatttctgggctcaggctgtttaatttggtctgcagagccccgaggctccgtttagactgggccagcagacagttctagagacttcaagtttgttgtcgtttttaaaagtcctgccaatgcccagaaacttagagggacaagaagatgacctcgatgtcagccgggaccataaacagtgaggcccgcccccccccccacccatgcctgcctccactgctcccgtagctgggtctccaggggattgcccgtggccatgggggaggccgggaatgcggggctcagactctactgggcttctcgtatttttttgtttttccttgtccatcttctttctcggaaatttctgaatatccccctacagcctttggcattctgtcactcctggcatctctgggccaactgggaaagccatcatttgtccaatatccagaaaatcaaggggcctggccttaaatacattgcagtgccctcctccccacatggcatcgaatttcctgtgtcctcaaagccaggagcctgtgccttggatgtgggcgatggagccttgcagacacctggagcggctttcctgggagagtctccctcgccttcccatccacccgcttcccctcccctgccccaagctctggtcacagcctcggaggggtcatctgagtgtaggttgcctccaggtgtacagttggaggggggcagttaccccacatccccctgtctgctaggggcacccccagggactcaggtcttgagggacagcggaagggtggggtggggagtaggccgttgtctcgtgccacctgggtgttatgtagactctgaatgggcagttcctgggagctggtttttccttctcaccccttctacagtgctgcccctctgaggggctggagctctctggagccctttgcagcctgtggcaggtctttctgattctgtgcctggtttcgcagcctccaacccatagccagtggcatgaagaacattcctggctgtctctacctgtggcctttgcaggcagcagttccctggggcagggcctgggggtcctggcacctccttgtgggaccccttgggtatgagggagggagccacctgggccacagatagacccccttcctgtatccaggaggttcaggatggacctgtctcatctttctttctggtgggaagagagcattcctggccatggggaatgtggcctggacagagccacctagcctctcccctcccccaggcagggccctgaaagatggagatggctctgctcctgccaggtcaacagccagcagtctggtggatttccatgcagtccaggcaggatctccttctgtccccaccccccaccccatgtgcaggaagctggttccaagcagggacccttggccccgctttccacgtgggtgggcagtttccctgcgaggggcaggccaggcccctgccctatgtcccccagagaccgatgttatctacagtaagagcatacaagtctttttggctccaaaccaggcctggaggggtggtcttctcctctgtcctctgcctcttgccccccattaaaggtcagggaatggagtgctctgtatgtttgctggggttgggttttttcctttggtttaaaatgaagggctggaatccctggtgcagactgcacggtgagaggtgctccttgggatccactcgaggagcattactgctgaatgccctgccaggccaggagcatcgctgggggtgggagaggcagttggcttatttgtttatccaacagccatccatgggtaccccaagggccagctctgttctaggcactgggggtctaggcatgggctcaggagaaggggtagaacgggagggcttcctggaggaaggcttcctaaccagagaccggggtaggagtttgccaggcaggtgatgctggccagcttctcttgccattttccttttctttttttctttttctttctttctttttttttgagacagagtttcgctcttgttgcccaggctgcagtgcagtggcgtgatctcggctcactgcatcctccgcctcctgggttcaagcgattctcctgcctcagcctcctgagtagctgagactccaggcacgcaccaccacgcccagctaattttttgtatttttagtagagacaaggtttcatcctgttggccaggctggtctcaaactccttacctcaggtgatccgcccaccttggcttcccaaagtgctgggattacaggtgtgagccactgcgctcggccttctcttgccatttctgcagactcatagtgtgtgtggaagactgtatgtctgtgcctggcacagctgccctcggcactcaggtgggaggtgggggagagggctgttggtgccagcacaggtcatggcatgagacaggctcccgcagccaagcggggtgcaccgcagcattggaggggccctgctgcgcacgagatccaggctctgcatctgtcctcctccccaggaggcctggagggctgggagggaccagggtggtgaaataacccaggtgggagagaggcactgttggagaggcagagggagctgcaggtttgtagcagcgagctttaaaccctgggcctccaccagaaaacctcagaaagggctgctttgcttttttttctaaactacaaaagaaacccttggccgcctgggccccttggggtcgggtgggggaggagatccttcattcgcacctttgcaggcccagtactgtgcagagggaggagggtggaggcaaaggcgagggaggagggtggaagcaaaggcggggtccctccctagccccgctgccctgcctggttgctgctctcagacccctactcctggcccggaaacatggaatcttgggacagctggggtagggggcacagaacggagaccctggtgagggaggaactctttctccagccctggctgtggccacagcaaggccaggctgggaggacctcactcaaatatttacatctctcctaatatttaaatgatgaagcaggctcctgcacacagctgccctggagccagctgttgcctgccctaccctccctctctccctccctctttctttccctccctctttctctccctccctccttctctccctccctccctcttgcattctttgtctctgacccaagtccaggcccttccagctgttctctccttacccacaggcacctcctgtgactgagcttctccttgttatttttcataaccatttcctttaattgagcacctcctaggtgccaggccctgggctggtactttgtatacaaggtgtcttttaatccccacgagagcccaacaaggtagattgggctgctgaggctccagcgctggaaggccggcccgggtcctcccagtccgcacctgcatccatccatcactcccccactgtggagacctgttccctggcccctggctgagcacgatggaaatctctgtctactagtccttggagagtggggatggctgagggtcccgaccctggggtctgacgggggctgcctctgccccacttcagcctggctgctcttccactcaatgactgagtttgcaaaaccagaataacagtgctacctggctggtactttgggtggctgggaggcgtgggagagggtgcacggaggggctgagcgaggtgtcagcatcgtggggatctccgagggtagccttcccaggcccagggcggagtgtaggcagagggcgcgatggcccagcgtgccggctcacatctggccttgcccttgcccacacggcaatgtgggggagtcatcagcctctcagtgcctcagtttcccatctgtgcaatggggacaagagtaaatcactgtcttcaggtatggtaagcactcatacacattgactattgcagaatgaacacagtgagcccttcttaggcttctactacatgccaggcagggtgccaggccctagtggagaggggacaatgatgggcaagctggctcctgccctcaagggctgtcgagcagggaggaaggcggcggctgccctgactgtgacccggagtggggtgattcgcaaagaggctggcgggaggctggctgggggctggctgggggctgctccctctcctgcctgtgttccgtggcagggtattaaactggcttttttcatggatttccgaggccctgactgtgggacctcgggcaggttttgggaccttgtgactttgttcccgcttgtcattcaggcctttgtcctcagcagtgcccagcacacggcgacttctgcatgtccttcagtgtgtgactgaccctggagctgagacttggcagctgaggctggacattgtccttggataactcccggggaggtgggggcagggtggggctgtgagctggcaactccgagtccctagcagcctccgaatggaggctttcctcttgtaggattctcggggaggaaggaggggatgggggagatgaggcttgtgagtcttcaggagggcagaggttcacacctgcagcgccccagaaacactccggggtgcccaggcttacccagccctcctgagccagaaccaccaagagttggggaccagcagtccattttttagcaagatccagaaatgattctcctgaacagtccgagccaagaatgacatatctggaatcagaacatcagaactacagaggaatcgagagaacgggcccaaaatgtgtagggacctcagccacatggcgccacatggaggaaagcacccaacatcatcactgtatgaacctgtttaaacacacacacacacacacacacacacacacacacacacacacacactccccagtaaagagtggaaagacatttgtcagaatattgatggaagttacctgggttgtgggtttatagattttttccctttgtttttgtgcattttgcaaattttcggctttgtgcctaaattccttttacagtcaggaacaaagcaatagatgttattttttaaagttcatgggctcgtgcccgtaatcccaacactctgggaggctgaggcaggaggattccttaagcccaggagtttgagaccagcctgggcaacatagggagacccccacctttttttttttttttttttgacagagtttcactgtgtcccaggctgaagtggcggtggcacgttcttggttcactgcaacctctgcctcccaggttcaggtgattctcatgcctcagcctcctgagtagctggattacagacactcatatttgtaggatttgagaatcctacaagaggaaagcctccattcggaggctgctggggacttggagttgccagctcacatattttttagtagagacagggtttcaccatgttgaccaggctggtctcaaactcctgtcctcaagtgatccatccatctcggcctcccaaggttccaggattacaggcgtgagccactgcgcccggccatgggagaccccctcttaaaacaagaataaaaataaaaataaataaaagtttactgtcaaaaagaaaaacacatcacccaacctaatctccccctaggattgagagatgaggaagcagaggccggaaagtgtcacattccctggtcgctggcagtcaggggacctgaggcctgggctggttttctcgtgctccaggcctggggtgtcaggtggagcccctgctttgcccaaaggtctaggtgcctctgccagcactgcttgcttctgcatttttggccacaaggaatgtgggccaaaggcagggtccttgacctctgcccaggagggtgaagtgggctggtcctccttgtccctgctccaaggcccctgcggctgtgcctttggaaactgctggcccgagctagtgtgcggagctgggacagacctcaccgtggccctcgtggggtcattccatgtccgggctggaagggatctttcggtccagcccttcctgttcctcatcaggaaactgagaccagagaggtcatctgcctggcccggggtggggtgtagatggcgcttgtgactcctgcatgccacgtgcagacagtccctcagctgtgggcttcccacgcaagcagccatgctggggataacttggctgaaacctgcgatttaatgaagagaagaatgactcctcctgcagccctgtgccccacaggctccctcctgcccccacccctcctgcagaggggcctcatgctggtgggtgggtccctgttgctgcaatgggcccaggcagtttctgggcagtggaggcttggctgtcttcctgcccaatgtcccctgtagcccacgctgtccgggaagggcggggaagcactcagccactggggacttcacaagatgggtatctgggagatgctgattggcaggccaggctcccgtggcccacaggcaggtcagaggtcacagtgctgagctgggctgagttggcagctcagggcagtgggggtgggggtaccttgctcagccatgggcctctctggcacaagggtttggagtttactgtaaacaactccttcagtttttccttctctcataggccaccagcagaattgaggggccctctgttgatgaggtgtggcctgggaggggctagttgtctgtccacctgatccttgcggacaggtgaccacaggcttcctgccccagggggctgggggaaagatcggggaggcctctctggcttccccacttggaaggaaaatacgggcataggggagacactttacagggacacatttcagccagtaccctctggctgtgctgggggcacagtgcctgccctgcccacaagaggggtcagttctctccaggatttaacttcagccttcagtgcagggcagatgagcactcagaggcccagaggactcatatcacgagagagaagctgtgaccacacaggcactgaaggttaagcagaagagtgggacacacgggtgacctgaaagtcccagggtcagtgtggttagccccagatagctggggagctttgggtaccaggcttagcaggggaggagggcccccgtgacagtttgctggggctgctgcaacaaagccccacgaactttgggggctgaagatggttctagaggccagaagtccaaaatcaaggtgtcgaccaggctgatcctttggggcctctgcgggaggctccggcccaggcctctctcccagcttctggtggctcccgggtgctcctgggcatgtagatgcgtcacgccactccctgctccgtcttcacatggccttttctctgtgtctctgtgtctcgtaaggatgcttgtcattgcatttagagcccaccctaaatccaggatactctcctcttgagatcctttattgcatctgcaaagaccctattccaactcctgtcacattcacaggtccgagggctagggctctggcatgtcttttgggggtcactattcagtccactgcggcagctgatcttaggggaagcagaatgttctaagcttggggtgagcggagggaacgctgctgggtggggagtgggagaccaggctcggagacaccgcggatctcctctgtctgatgagggcgtgatgaggttctcatctcaggtcctctgaatggcggctgcttctgaggagaccctttcccctggatctgcccctccagaaacctccacttaggtccaggtcccaaggtggatggtaagaggcggctgtccctgccacacttgatgggtgagtgtgtgaacggggctgggagcaggacacttgtcacttctgtggacagattccagaggctcatgaatctgctgctggggaaggtgcctgatctagcctgaccctccacccccacctcccccttcccgccccccttcaccagccctgttcccagagcttcacttccccaaaggcaggcgccgtttcctggacttctcagcagctaccccctaccccagacccctctcttgtaggcccctctggtctcagcgcctactcctccctgggcttctgcccctctaccgtgaggcttctgggcagaagtgtggggccccctcgctgtgtctggctctcgcggtataccaggggtcctcccaggggcccgccctgcccgctaggtttccagggagcttttcaagttcttagatgggcttgatggagtttcccaatgcgttgtctcagagcaggaggggccccggctgagtccgagagtcccctcagtcacaccctgggctgtttggggcagccaggcagcccgtcttctggaggtgctgcctctctctggttaccccttctggaatcttctgcgtccagttgcggcccctcctacacagcacacccaccacccccttttacctgtgactcttctttgtcaacctcttcatgtctttgagaatggagaccaggtcctcctcaccctggagttcagcagaacctaaaccaggcagatccgtgtaggttcacgtgggggctctgtggccactgtggctctgccgtcacctccagcccagcttggcgcgctttggatcatgtcattcagtgccggtcctccaaacctctcccctggctctgcaggtctgggaagcagctggctcctgggtgcagctgtgaccggagcctgaactctgctccctggggtcaccgtcccctgtaattaggctgcagctcatattggctcgggcagaggccatcggctgcccgccttggggccacaacacagagagccccgtgattaatggaggctccacctgggccaagtggcccctggtgttaggcgcttttttttttttttttttttttttgcattttttaagtgcttgtaacatttcccctaatggacaatgagacgaggagggagggaggggtggcttctctgcccaggcagatcaggaatggtcaccgcctgtgtgtgcagtgacaggtctgggaacagacaagggagagcttgtccgggaggctggaccctcacaccgatgctgcctgtgcctggcagctctgtcccgggcctcagaacagacactgaccaacacgctcctcagggtctccaggtccgggtcctggtccccggcagagcttcccatccatgggaagaagcaccgagcagccttgctggctcctcgcagggagctgggatgcatttctaagagcagcatgcgtgaagcccggggtctgggcaaaggagtgtttggggaagagtctgctgttgttggagggtcggaagtagaggggaaggaggggcacgcggtaggctgaggaggtggctggcgaccctgtggtggggacgagggggctatgagcagaccaggagccagcatcacgtttctctgtctccagaatcgaggacggagagctgccagagaggccctggcggggtgtctggggccacctaaagggcgtgggtggattaaagctgaggaaagcctcattttgggggactccgtacttaacctttgaggccctcagagctgcagcctgtggtttttcgaagtcaatcacctcccagggcctcgctcctgccttcagcgacagccatttatcagggagtctttgacccaaggagacctgaaaggtcatctggtccctctcctacccccaggcaggccacacctagaccctcccacacagatccgtcccacccttctgctgccttccaccagggacggagggtgggcggccctcccacccaggccctggcggccccaccccagccaggaaattcttcctctttatctgcctcacatctcttcccctgcggcttccgcccatttcccctcaatctgctcctagtggagcagccagcagctggtttagaacccgggggtggggggagcgctagaccagtgcagcacatctgagagtgtgccagaggtgctcccattcccatagctgatttagtaaagaaaagaggaagtccagcaacttagcgccactttaaagtccgcctggaatgaccctgtggctgccggaaccaggggcacgcggtagatgacgggagcaggcacagagaggccttcgtcccggatcagtcgctgttgccctcttggaggctgggctgcctttcaagaagaggacccaaggccctgtgagcggtggcctcctctggagcctttactgtggtcctggttctgctctgcgtaaagagagatggcttgaagcagaagctgctacgtggctgtcccaggcaggcgcccgtagtcccagctactcgggaggcggaggcaggagaatggcatgaacccgggaggcggagcttgcagtgagcagagatggcaccactgcaccgcagcctgggcgacagagcaagactccgtcttaaaaaaaaaaaaaaaaaaaaggagtagagaaatctttcccagaaggcctgcagtcacctccccttcatgtttcagaggtaaaaaaaaaaaaaactgcacatttcgctttttttttttttttttgagacggagtctcgctctgtcgcccaggctggagtgcagtggcgcgatctcggctcgctgcaagctccgcctcccgggttcacgccattctcctgcctcagcctcccgagtagctgggactacaggcgcccgccaccacgcccggctaattttttgtgtttttagtagagacggggtttcactgtgttagccaggatggtctcgatctcctgacctcgtgatctgcccgcctctgcctcccaaagtgctgggattacaggcgtgagccgccgcgcccggccacacgtttctgttcttgaacaggtggctccctgaccctgggtgtggttactccaagaccttgctctggtggggcacaattctggccccaggtagggcgaccgtataacttactgtcccttgggggacacgttagtgaaagggacccttgaatgactacggtgggacaacagatgtgagctgggtttgtcccaggaaggctggatgtatgggcctcttgagccagaggagacaacagcagaaagctctgcggctgatgggaccgagcaggagaagggccggcggaggctggggcaacaacgcacttgcccactgtgaagggcctgtgtgagctgatggctgatgagagggcagtggggcgaggctgcctcctgccaggctagaccagctccaggacacccatatctccttttcagaaccggtgactcagtggctagaaggggcttcagaattgacgggacactgagggagtcgaatggaatggctggagtggccacagcaggctctaggcctcctcccgtttcttttctgtgttctgttcctggggtctatatcctggggttgctgtaacagagtgccacaacctgggggcttacaaacatagcttccggcggctcctggagattcctggcgttccttggcctgcagacgcatcaccatcatctctgatctctggcccctgtctccacgtggctttctccccctgtctgtgtgtctttctccttttctgtcttttataaagatgctcaccattggatttagggcccactaaattcagaatgatctcaccttgagacccttaccttaattacatctgcaaagatccgttttccaaatgtgatcatgttcgcaggttccaggagttaggacttaagacatatcgttttgggggacactgttgaacccactacatttaataaacccagagttggtgccaatgtcccctgcggacaccatagcagattctggaggttccttgtaaaggaatccgtaggacttcttttcccttctggagggatgagactgtagctgggctggggaaagctgctggttcaagctggggctggttcagctggtgctggcttgccaggttgttagagagctttatccagggagaaattaacatcacaaagttgggggataagagaaggtttggaatcccaagggctggctgttgaggtcagctgcccacccctttgtgttccatcttacagggacccaggcctgccagtgctccgtttctggaaggaatgctgtgggctgctgtgccccataggcagggtggagggtccccttgcagccagcgagctgctcttcctgtagcgtgcagagggaaggaggaggcttgtttatttctcttggcctcagccgaaaatccaaccacaggctctggcactaggcagacctgctcattctcacatcatcattgcagagtgagccaggcctcttgggtggggctgtgatgagcaggaaggacctccggagtgcctgggacttcttgggcccagggttgccagaggcagagagaaagaagcctcctcctaacacttgagcaaagatagtcatcagaatccatcagagtggcctcctgtggctcttccctgggtgctgacccccctggtgcatttgaagttttcagggatactattgacgctccctgcacctccatccaggggttagtggaaatggttcttttcctccttgtccagaggtactgtggatgatgaccccaggtcccagacctcagtcattgggccacgtgtgcagataagcctgggcagtcagtaacctttggccaccaagctggcctcctgcggactgggccggcactggaggcgggtcttagctgctagcactgtggcccagccaggcctggccttgggaaggcagagggggaggggactgggaaagggattgagctgggggtggggtggtaccctggttcttccctcccagacctttggcaggtttgaactatctggctgcggctctctaaggagggagcgcctcctccgccttgatgtggactttgccttctgttcacgttgtccctgtccctaaacaaatgtggctctctgtggggagcctgggggccgccctccactgacactgctgtttcctggcttccctttgcaggctccgctcagcttcactgcgcctatttttaagcctttccttttggacggttttgcttcctgagaacacacccctccccatcaccccaactgtgtcctcctccctatccggagcctgctccacctgccccaggagccacctccctcctccaccaagcagcccaggccaattctggagggctaatttgtgtccctccagaagcaggtcctgagacagggatttcagtgggaggggacaccaggggatgcctgagtgtgggaatgggccaggcagggaatccagccaataaagggtgcctcaccagctcattgtgaccacaggtggctgcccagcccccataccgggcagcatggggagactgcagaccgtgcccccagccttgtcccacctggggttgggtaagggagctggggtttttatacttcagttcttggccaaggactgcactgctcactccttccagccttccgagggcttgggcactaggaaaggctctgggtggagacacggaaataggccatgtgaagtcagtgggcgtgattggtagcagtaaggccaggacagccttggtcaccagcaaggtgaccacacatttcagcatgcacagcccccacagacacacacccaggagatggtaattacaccagcaacagtcacccctgccgcgtgccatgcctgcacccagggaatcttattttttatttatttatttatttttatttgagatggagttgcgctcttgttgcccaggatagagtgcaatggcacaatctcggctcaccacaacctccgcctcctgggttcaagctattctgcctcagcctcccgagtagctgggattacaggcatgcaccaccacgcctgactatttttgtatttttagtagagatggggtttctccattttggtcaggctggtctcgaactcctgacctcaggtgatccacccacctcagcctcccaaagtgttaggattacaggcatgagccaccgcgcctggcctcaggggcaccttattaccccatcacctcctacagcaggtgacactgaggacactgaggctcagagtagactgtggttatgtcactctcctgtttggttctcctgctctcagccctgaaataaagagcacggtccctgtgcaggcccatacgtcctgtctccagccctggagcagtccttaagctccttgaaggcacaccaggcctttgggcctcgtcccccaagtcctggataaataggaggtgaaggagcctttgcaactggaccccactctgccagcgccaaggccctgcctgactacccaccccaccctacacagatcagggacctgtgccaaggtccagtgtcacaggagagtgaagacaaggaggtgcccatggcgtacatgctgctggactcactctgtagatcctaagggttatggggagttatctgccaggtgaggttttcccgtggctttttcctgcaggctcagggtagcatacagggaggtgcttccctactccttggcaccatctgtccggcttccctgagccctgaccctggctcctagatagccagtgtttcttcagggacagaacctgctttgctgctgctcagaggagacccagtttgaccagggctagcgttcctggaacctgagcctggaattccaccctgccctgggcagaggccacgttgctccctcctacgagagctgagctgcgcatgagattattctgaccttgggctctaccatttctttgcatgacatttgtcccaggctggagcagggctctgtggctcgcttggtgttccctccccagactgaggcctgatatgtacaccaggaagtgcttgatctggtttcaggagctgggagcggtttgccaggcagcctgtggtcagagcaggggccttaacaatggtcccttgtgcggcacattcctctctaaataggcccaggtccaggctgctcctgtttcgaccccgccatgggcctggaggggaaagtttgcatctggagggtggcccactgtggcctctttttgtgtagcagctgagaccgtaggtgcttgagaataggagaagccctgtgcccatcctgggctgtgagatgtttttccagaggtggggatggggatgggccagcatgcagttacccacaccctccagcttgttggcatcaaggtctgtgtatgtgtgtgtttttttttttttaattttgtttttccaacatggagtcttgccatttgcccaggctggtctcggactcctggctcaagcgatcctctagcctcaggttcccaaagtgctgggattataggtgtgagccaccatgcccagccagtaccaaggtgtgttttttaagagcaatattggccgggtgcagtggctcacgcctgtaatcgcagcactttgggaggccgaggcaggcggatcatgaggtcagcagattgagaccatcctggctaacacggtgaaatcgtgtctctactaaaaatacaaaaaaattagccagacgtggtggccgggcacctgtagtcccagctactcgggaggctgaggcaggagaatggcgtgaacctgggaggtggagcttgcggtgagccgagattgcgccactgcactccagtctgggcgacagagcgagactgtctcaaaaaaaaaaaaaaaaaagaacaatatcgatggttttattccctgaacatgctaagtgatccccatgtagtataagcatctcagaaggcaggaaaatgtaatgaacaacacccaccgccattcattccatccagagatcgttattttctgcccgggtgtgagtgtgtgtgtgcgtgcaaactgcacatgtgtgtatgaaatggaattaggatctttgtatacatcttgtgtcctgctatttttacttaatattctcggcatttctcatcttcaaaaatgtgattttaatgatggtgcaggcctttgacatatgggtttagaaaatctgcggaaacccggactgtttccaggttttgtcagtttaatgctgatgcaaatgtcctcgtacgtaaatctttctgtacttctgattatttccttgggataaattcccagaagtgggccaaagcacatgaacggtcttcaggcttttggagcaagttgagatcggtggggattggagaagggacccagggaggcttttgggagcttgcgagattggagtctggctttaggggacttgaattcacagatgaaggagatggctggcaaaggtgggaacctcctgctctatgggtgggggggtgacactgctttaccttccagtgacagcatggggatcctcccaacatgacctggctccgcatctttctgacactgtgcacggtccacagttgtgatgctcagctgggagcctcttctgtgtccttcagttgcattaactccttgcagacagaggaggaagctgtccggtgctcctccctgctgcgtgggtcctttgaatctgcccagttgggcctgtggatctgtgcagtcacgtacggggttctaaaatctgcaaaatgacaagctcacgaacactctcgcttctgtgggtgaatgtggataccccttggctgcgtctccctccacagggaagatggagacgtgtaaagtgacaaggacctgctacccctgggcaggttatgccggttccactgtgaggatggtggcagggggcttcccaggaggcctgcacattgggaagagaggggcgaccgtgtgtgactgcaggacccagggcgcagtcttaggactctgatgggggaggagatgctggggagccctgttctgccagcctggtgacagacatctcctaatgtttcccggctgggtacaactcacaatgtcctccgtggggaggcaattgcccatgaggcatccctggcagggatgatcttgtttcattgccacatatcccagcaatgaaacaagaatctagagtgatgtgattcctccgatgacttctccaaccatctggggtttttgtgcgactccaagaagggggaaggaggcagctctcgctcctctgggctcctgatgtggcagctctggaatggccacgtgtccgttggcccacagtgggccatttgtcgaatgtggttgtggtgggattggggctgggctggagagtgggtgaccacaccagctagcctcaccctgggccactgtgcagccaggggtttcatcttcccaggggtctcgttgtgagtgtcctggggctgctggaacaaattactggaaaccaagtggcccaacaaagattgattcgctcatggttctggaggccacaagtttgacatcaaggtattggcaggaccacactccctccgacagctcgaggggaggacccttccttgcctcctccagcttgcgttggcccaggcgctccttggctctggcagcatctgcagtctctgctctcatcacgtagccctccccaccgtgtctctttgtgtcccaagtccccttctgcctttctcctataaggacaccgagcactggatttagagcccatcccaaatccaggatagtctcatcccgggatccctaatcacatctgcaaagaccctttttccaaataaggtcacattcgtgggttcttggggttaggtattagacatgtctttttgggggtcactagtcaaccctctacagaacctcagacgaaagtgaatcttcacaggctgaaatgggggtgaaggtctagtgcgtccctcctccttgggagctccctcagggcttgtgcctatcctgtgatcctgtgatccagccttttttttgagatgaagtcttgctttgtcgcccaggctggagtactgtggcacgatctgggctcactgcaacctctgcctcccgaatttaagtgattcttctgcctcagccttccaagtagctgggattacaggcgcccacccccatgcctagctaattttttgtgtttttagtagagacagggttttaccatgttggccaggctggtttcgaactcctgacctcaggtgatccgcctgccttgggcctgccttggcctcccaaagtgctgggattacaggcatgagccaccacgcctggcatttagtaggttttggttgttttttttttttgagacagagtctcactctgtcatccaggctggagtgtagtggtgtgatcatggctcactgcagccttgatctcctggcctcaagtgatcctctcacctcagcctctcgagtagctgggattacaggcatatgccaccacccctggccaatttttgtattgtttagtggagtcggggctttgccatgttgcccaggtttgtcttgaactcctgggctcaagcgatctgtccaccttggcttcccaaagtgttggggttacaggcgtgagccaccacgcctggcttagtaggttttctagaagcgcctgaggcctggtgaaggcatggtgtcatggagtagagaacattcaactctgttcccggggagccggaacacacccctcgtagccaatctcaacagtcatgacgtggccaggatgacatggggagggggtggtgtggactgtgtgggaggccagctccccgggaagggggctggagtgggcttggctttgaggaggattcccaagaggaggaggaggcggtggcatgctcgtttggggggatggcgtgagccagggtgggcacctcttcatttaggtgtcaccttcttgacattccagccgggacatggtttccttggggaagatggacacccccagagtggggcatctcctggggaagatggacacctccggaatggggcgcctcctgttctcactgttcttctagcacacagttgtattctcttgcagttctggaggctgtgagatctcctggctgttatctagaacaaactcgcctttgagcagcgccgtcctgatggtggggtggcccctgcgggtggaacagcccctgctgtctcagagcttactgagagctagtgggcatgggagtggtgctggaccgaaacacccagagggatcatagagccaggcagtaagcacagaggccagctagtggggagggagggacccatccatgaaaagacaccaagcattgaaagagaggagaggatggttggggaccggcacacatgtgcattttgcgcagatggccaaggtggtgaggcgccagccacgcagacaactggaggaaggaggagtgccctaggggaggggccagctccggttctagaatgatccgcttgtgcacgtgggcctggctggaataaatcattgcatccgcaccgtagactcaatcgtaagctcacaccagggcagcctctgctttggtgcagtgtcttcgatcatgagttggccatggtgggggtgactccaaggggactcccaaggagggggttcaccggatctcccagggaaggtcatttgttttcttgggttggacctgggacaaggccttctcctgtctagtttctgttctccaacttgaccgcacggaaggatgctgaggacacctggaagccggcccctgctctacagcacccataggacagaggcacaccatgtggggacagtttggacagtgctcaggaggcagggagcagatcagaggaccgcgggaggccctgggaaccgcacgaggacccaggcattgagctctgcactttctggcatcagcccgatgtacagtctggctctgtgtctaccccgtacttcactttccccatctgtacgggggcggtaataatattctttacagcccaggtttaagcgggtgtagatgtgatgagcttggtaagcccatctcattacattcagttctgggcattgaaccctggactttctggctggtagaagtggacattcaacctttccttggggccctggggcttctgcagaatcagaacacagccagcagtttgcatgcagggtgcagagggacagagggacaccatgtcgggagcccacacctggcacacccctgactctggggctcagtgtcctgctgccctgcggccacgtgatcagctagaggtcatggctggacccataggcgaatacagcctgtggatttgattttgtttggccctgcggtgttttattttatttttagttttagtttgtggagacagagtctcgctctgtcagtcaggctgagtgcagtgacacgatctcagctctgcaacctctgcctcccgggttcaagcgattctcctgcctcagcctcctgagtagctgggactataggcgagtgtcaccatgcccagctaattttttatttttagtaaagatggggtttcaccacatcagccaggctgctcagtgttttaaaaagggcttgttttgctttgtgccagcatttaaagatcaggagatatcatataaagatccagatttctactctcttgagaagtgaacagctctggccacgccgggcccatatcctctagggcagtgacggagctgagacagggcctgtgacaactgagagttctctggagtccacacggctccttgcccagcttctggtggaggttgagcttagtgacccaggatttcgtctgtgtccaccaagaaggagaggtgcctgtggcttagagagggcgcccacaggagtgccttgcccaggaagctggcagctgaggcggccagggttagggggttgggcttcctcttcccctccccagtgcctgagtgcatttggaggaagagagacgggtgaggggaaggcactgaaattggtcctggagcgctattattgggggctggggaccagctgtcatcccttttcctgtgggcaggggaggcagtggtgggatcccatgagacccggactctgtggcctggtgaggcagggagcggctggggagacactgtgggtctccacaggggtgcgctgtgggtctggcctggggaaggagctggtgaatgtgcctgccatgtgggtccctccctgctctggccctgataaccaggagcggctggctctcatttggagtgcggttgtggggactgtggaggtggcagcttcccaggtaccatccccactgcctccgagggagcagaccctggtggagaggcaggatggctgcagggcgggagctggtggttggcatcactgcacgggcttgtagtagtggatgggaagatgcaggagaggctgatgactgagaaagttggttcctgtggactaagctgggggagccggacaaccaagtggttagaaccttgggctctggtatcagcctgatgtacagtctggctctgtgtctaccccgtgccccactttccccatctgtactgggggtactggtattctttacatcccagggttaagcggctgcagatgtgatgagctcggtaggcccggcgcctcgccggcactgaaagctccagtgtccgcccttagtgtcattgatggggttttgttcctgctgcggttctgattggttacagttgcggtcacttattattggaggcatgtcccccgctgtggctgatggtagaggtgtgtttgctggtggtgtcccagtgtgtgccttggctggaggtgaggagggataaaaacagccgcgacaagaaggaaatcaaggccgggcacggtggcgcacgcctgtaatcccagcactttgggaggccgaggcgggtggatcgcttgaggtcaggagtccgagaccagactgaccaacatggtgaaaccccatctctactaaaaatacaaaaattagccaggcatggtggcccgtgcctataatcccagctactggggaggctgaggtaggagaatcgcttgaacccgggaggtgccgctgcactccagccagggcaacagagcaagactccatctcaaaaaaaaaaagaaggaaataaaagtcttctctggaactagaacgttcctatgtagacgtagctggagggggaggctgtgtggtttgcgccgtggccatggcaagacacgacgggcagcatcttcccactccagcctgcatctctgccccagaactcatgatggttctcctaggatggggctgtcccttccgcttgctgagacatgaaggacgggaagagacccccggccctcaccgccgcatcgcctgccttcctctgctgctccttagcaggaaacatgccggagtgttccctagccatccattcaccaattgcatcccctctctttatttttcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggagggtgagtcgcagagcgctaggtcttggatgctgtggtaatggggggcctggttgctggctttgccacagaatcttggaggaagaagctggatatggggtggagggtgctaccctggagacccagaaagaccggaatgcatgggggtgggggtctgcaagctcaggagaggtggctctctctgtctgatgggaacatgccaagatgccccaagcgggacttgaatgagagtttggaaagattttctgggtttcaaggagcctcctttatgggtcaccgtgggccttgctgggacctctgtctgctgtgtgtccctggagggcctgggaggcttagagaatgaggagccacgcaggaaccagggcaggctcatgcaggggtgtaggacagggtggagttgagacccctagaagggctgtcacattctggtggctcctgcttgaggaattgcaggctgcctggatatgcccagcagaggccgagggcttggggaagggaggagggacgtatgcctcctgaggcttgcattggagcccatggtctggtcctcctcccccaggagggatggttgtggcagagggaggggaacatgaggagcaccttagcctgcaggacaaaattctcagggcactgggaaggggtgcctggaccagggggctgtgtgatagctgcacacggttttatttgggggtgcccttctggcgagaggagagaggccatggggctccagcagcgtcctgggagggctcaagcccacagccgtgctgacatggagcttacaggcaggggattggtgccagtcctgtgggacacagggcctgtttggaaatgccaggctgtgggacatggttgggtcccttctcagaagcgtgccccctggccccagcagggatcgtggctccatggggctatagtaaggtgccagctgggttagaagcccctcaagagccaggtctgattctgggcacaggatcagaactcagtaatgctcagtaagccttctttaggttggacaaacagcacagtctgggtttttgatttagctgctgcttcttatttctaaccgtggtgaaatacacaacatacaatgtgcaattttagccactttgcagtgtacgtttcagcggcattcagtacattcacggtgttgcgcagctgccaccgctgtccatctccggtacccttttcatcctcccaaactgagctccgtccccgttagaccaagctccccatgcccctcccccagctgctggcagccaccattctattttctgtctttattatgaatttatttgaccactctaggaaccttgtgtgtgtggaaaaatacaataactgcccattttgtgtctggctcatttcactcagcatgacgtcctaaaggttcatccgtcgtgctgtagcatggggcagaatttccttcctttcagaggctgaataatattctgttgtgcgatgcacttgtgttgtgtagctgttcctccatcggtggacccttgggttgcttccacatctctctaagtccctctttccatcttctttgacttttctttgacttttttgagacagggtcttgctctgtcctccaggctggcgtgcagtggtgtgatcactgcttactgcaacctctgccccctgggctcaagtgattccccagcctcagcctcccaagtacctaggaccacaggttgcgcgccaccatgcctggctaatttttaaattttttttgtagagacaggttctcactaggttgcccaggctggtctcaaactcctgggttcaaatgagcctcctgcctcggcctcccaaagtgttgggattataggcatgagccacccaacccctttttggtttttctttttgaatgagagttctccagtggtcagtgggcttgggggctgggaggatgtggggcctggagagggtgtgggtttggggggagaccagtgctcctcatgctttcatgggcatgtggagtgcacatttgtcttggcgggtctggggcctgggactctgcatttcctacagagggggcatcggaacacactgagtagccagaggctagtgggccttggaaggtcctttccggccctcagtgtgcgagtcccgtgttccctctcccatctctctaagcttgactctgaagagccaccctgccccagccacccagactcagtgacagtggttgctggtggcatggtgtcaggccaaaggcatgggcagtttgcagagtggcaggaggctgtttcctcccctgccttctgttggtgcaggacctttgtttgacgtgccggatacacccccatcctgggttgatgtgttcacactcagctgagtcaaacaggatgtggctggggaggcggttgtcaccgagccatctaaatctcggtgatggctggtgctggatgcacagggacgtggtcctggctctgggggacaggtagggggatgtccatggggatgtacaagaacattctcctccaggggcagacacagtttagcccctaaattgtgccagagactgtgccgggagccaggcccagggacacaacctgcgggctctgctttctggagctcaccgagccgtgagcaggatggctgggacacaaggagtgtccagggagcttccccagcagtggaagtacaatttcatcaggccaggaaggggagagaaaggcaggccacgtggaggcagcagcgttcagagctgccaggaacctggcgctctggggggacggtggctttctccatggaataggatgtacacgttggagccggggcatgggagaaaaccatcagcatcccagacccggccacccacggacagggacctgtgcaggtgggagtccagctcacgtggagaggtccgtgggctgggctgacagtcctgagggcctaagcaagtccaggtggaggaaatgcagggacagacgagggcagggccttcccaatggaggagtgctcttgaaatccgatgggagtggcttctcggggggcccaggcctgagccccactagttcttcctccgaggcaccacctgcttgcttctccgtcctccctctctgtgtcacgaccgttctggacacggatccagttctctccaactcagcttcctgcccatctttccttcaggcccatccccttctgcccctccatgtggggctgggctgggagttccctgagccccgacatgcacagctctgaccaatctctgcggcccctctgtcccccgagcaccagggatccagctggcaccatggggaaaggaatcatggagggagttccgtgccctctgagcagacgcccagccccttggcttctgcctgcgggagggcatctgtgctgtggtttgtctccaccccagagctgtgggtgcagggcagggtctcctggggccccagctgaattgctcccagactgacttccccaaagcacagcactgctgagatctcttcccgtgctgagccttctctgctcactcaccataggcccctccacggttgattcactctcctgctcagctcacacctctctccttcccagcttctcctgctttggtcttcccttggtctctcacacctttcctcacaacccctttgccctgacctcctgaaccctgacctctgcttctctttacatcactgccttggtgaactcctatgcatccctcaaaacctggtccaaatacctcgtgtttggcttgggatataaatgatttgtgtataaactttctttcctctgctagacttttttttttaaatgtgaaagtagtttttcagatcataaaaagtaatcgagtaccctttctttaaaatgcaggaagtacagaaatgagaaagaacctaaaattcacctgtaagccagcgatatccatgcttgaggttttgctgtatagtcttcaaaattcctttcatgcccccactagattctgagggtagggctgttgtctttgtttttttttgtgttttttttttgttttttgttttttgagatggagtctctctctatcacccaggctggagtgcagtggcatgatctcagcttactgcaacctctgcctcccaggttcaagcgattcttctgcctcagcctcccgagtagctgggactataggcgtgggctaccacgcctggctaacttttgtatttttagtagagacggggtttcaccatataggccaggctggtctcgaactcctgacctcgtgacccacccacctcagcttccctgacctcccaaagtgctgggatcatgccaccgtgcccagcctgtcttggtttttataaagaatcccataaggggccaggtgcagtggctcatgcctgtaaatccagcactttggaggccgaagcaggcagattgcttgagcccaggagtttgggactagcctgggcaacatagagaaaccctatctttacaaaaaatacaaaaaattagccaggcatgatagcatgcgcttgtagtcccagctactggggaggttgaggtgggaggaccacctaagcatgggaggttgaggctgcggtgagctgagattgtgccactgcactccagcctaggagacagagtgagaccctgtctcaaaaaaaaaaaaaaaaaaaaaaaaaatcccataagataccaagtaagtgacttggacataataggtgtgccatgaaattatgctgaaggagtgagccactggtggtgagttgggatggcttttttgtggttcttgtaggcagatgtagtgacccccatgggtcgtccctagagaccaagcagaaactttcctggtcaactttacccccaggacacctggtctctcctctggaggttgtgctggagggctcagtgggtgggtgttggcttcagtgtgggggttctggaaggagtcagcatttcaggagggagtgtgggcacctagatggttgaaggggagggagaggaagagaggcgctgcagagggcagaggcatccctgcctgctcctccgccccagggcctggtgaggtctgagctttatgctggtggggtggattctcggtttccgaggctctggccctgcccctggacttggcaccctccttgctgtcctcccacagaagggcgctcatcctttggggtcatccctggtcctctcaggctctgggtggggacggccttgcctcctctcctggatccctgctcttttcctgccccccaacatgggtgcctctgggtggagtggggtggggctgggctgcagcacccagtactgagcctgcaagggctggctgctggctcagagccccccccaccagagttacccccctccggctcctcagccacaccagccaagtttctccagagctgccttataaggcgggtgctcagcgctcgttcatgggtctggttctctgccttcttgggatgctcactgggggcaagagggaggccaggcccagtgcccagctcagttctgggcatgtcccagctctgccccatgagtcaactggttctgaactatcattccacccctcccagcctcaatttcttgatctgtcaaagaggcatctgcagaggtggctgggggctgagctctcatgtatccacccaccccaagaaccaagaagggagtccacagtggttctggggccacttgtgaacatggatgtgaaattggggcggggtagacatggcagcatgtctcagtagttttcctgtgacccagagggtctggaaatctttgtcatgtgggtggagcgttgagggagcagggggtcaggcccccccgagctgatgatggtgggcgtggctcttcgcatacttggtccgcaccgggccgtgtgttccaggggcagaacagggaggaatctcagcacagacagcagggctgccagtacagcgttgagtatagggttaatcaaagcacagggctccctggaaccacccaacacagagcagtgaagaggtggctttggggaaagtggggtcagagctgagcctgagtggggggtggggagggcgggcatcagcctgcaagggagggacacctactgggccccagaagttcctggtggggatcagggactgtgaagttggggagagggtgaccactgtgatttagggaggaagggccccatagacagcccagcttctggccccgtgtttacaggacaccccacataggctctgagcctatccctggactgtggactccctgaggcagggtgtgcaggttcgtccagtaccaggtgtaaggcagggggccttggtaagcgtcgagggactcactggtgtctgatgaagcagtgagtttggatcgtgtcatgcctcgggtcctgagcctgcaggatttttctgtggggctgtgtgcttctgcttctggaggtgtccagaaggcactgacgttcctgccgggatgccttactcggaaggtcccgctgctcccacctcctcccattttcctgagctgcttgcagagggcacccaggtccccttttactttgggattgggtctctttctctttccccttctaagaacaagtaccctccttctccgaactgtccctggagcctctcagacctaggtctagagtgggaagtcccgcatgtgctgggggaacaggaatcaatgcgggaggattggccaggcccggtgtgtctccttcgtggtgggacggggtggggccagagaacagagcctggctccagagcccaggaagagaacccctcccctcgccggcctgccaagcaccgtgcagtggtgagaggaaaggagggctggtccgggaatgcagcgggtgccgagcagctgtggaataccttaaatagagcgcagctgcggggaagggtggggccaggaggcaggcgctgggggcggtttctctgctccgccccctgcagctctgtggccctgaccacccagcctggccccaggatggagccccggcccccagacacatggcactgggtgaggccgcctctcagcacttgtcccaggaagtcagagcagctgccagaagagagaggagctgtgtctgtacccgccgcctcccaggcccgggacagctgccgggattgagggtctgcacaatggcgagcctgtccggaggggcgcgccgcggccagacagccatgctctgtgcggtgtggacagagggcacattcagccctggaggagcgcactcagactccccgcctcggggcccaaagtgtgggcagcccctaaccagaccctggattccagcagacagcctgggaggatgccatgtggtccaccctgacacactgtctcacctgtgacctcatttctgagagctgcagggaggcgcttcctcagttggactccacttcctctccggggttttctgtgggtgttataagtgactctgtctccttcagtccaaggggggctcctggggtatgggctgtaactgacaggctagagtagcccatggccagggctgagcttccttcccgttctctctgaacactgggcccaggaaggggttaaagtggagatgctctgattaaagttgagggaggcatggagctcccctgaccctgtccccccatcccactgctgctactgggtgtactctgtggagccccaggactcttaaagaacccagagtggagattcccggtctcatccagtgcaggtgagggggaaagtgatttgtccacagttacatggctaccatcagcacacctgggtcaagctcgattccactccacggcccctgtctgaaacctggaactggaaatggccctggaaatcactgattccatctgccgccttccaaaatggcccgcagaggttaagatatagactcctgtaatgccttgcccactcgtgtgtggggaaatggcagaggagcaccggctttgccctcacactgcctgggctgccgcccctgccctgcctagtggctttcctctctggtccgttttctcattgtggaagtgggcacaattcttcctgtgcagcgtggttagagtggacagtgatgattcgtgaagcagggtggagcgcctgggggattcgtgttaaacaagcacataaacaaaagccaacacaacccttacttaatcagcaagcaggccttgtctgaagcccctgggcagcacctcatgccatccctaggttccaggccggtggtgtcgccccgtgtctctctcacccgcaagctggtgtttagaagccctgctctgtgttctggctcccattctccctgtgacctttccctttcttcatcctaaaaagcaatgcacgacggggcgtggtggcgggcacctgtagtcccagctgcttgggaggctgaggcaggagaatcacttgaacccaggaggcggaggttgcagtgagctgagattgtgccagtgcagtccagcctgggcaacagaacaagactcccatctgggaaaaaaaaaaaaaagcgatgcccagtcattcttagatagaaaatgaagatcacatgaaatttggaaagaagtttttctctcccattccccaactctctcccaaggggtggccatgttgacagctgggtgtggcattctcctgaattttattcctgcagagtcattcagggcttgtgtaaaaaaagtcaatgtgtaaatatagacttttcaagaacacaaaggaaatcagacttctgctaccagcttttattttttccatttaacaacactgttgccacttgtagatgtagcacgttcctttttctttttctttttttttttttttgacagagcgtggcccaggctggagtgcagtggtgcgatctcagctcactgtggctcactgtaacctccacctttcgccttccgctttcaagcgattctcctgcctcagcctcccaagtagctgaaatcacaggtgcttgccaccacacctggctaatttttgtatttttagtagagacggggtttcaccatgttggccaggctgctcttgaactcctgaccttgagatccgcccacctcggcctcccaaagtagcacgttccttttaatggttgtgtcatcagctgtcccatggccctgccaggcttgtccagcttcccactgtgattgagaggctgcaacagatgttctcgcacttgtacatgtgcacacatgactgaaggatgagctcttagtgaatttctgtgtcaaggatgtgtgcatttaagttttgatctgctgggcacagtggctcacacctgtaatcccagcactttgggaggccaaggcgggctgatcacttgaggtcaggagttcaagaccagcctggccaacatggtgaaaccccatctctactaaaaatacaaaaattagctgggcatggtggcttgtgcctgtagtcccagttactcaggaggctaaggcaggagacttgcttgaacccagcaggcagaggttgcagtgagccaagatcgtgccattgcactccagcctgggtgacagagcgagactccctatcaaaaaaaaaaaaaaaaaaaaaaaattgatccttgttcctgaattggcctctaaagtggttactagaattttttaggacccctcccctcgtcgacctgctcagctgtctgctgggccctgtgcagtgatggtccagcagggaggtcctatgccccttacccctggctgagggccaaatgctctccaattggtgttttattttgtgcatctcggtcaagcgagagggattatctcttcgtatgttataggccagggccctgtgttctcttttcatttggaaggtgtatccttttcttgttgaaattttttaaaaagagttctttgtaagccaggcgtgatggctaacacctataatcccagcactttgggaggctgaagtgggcggattgcttgagcttaggagttcgagaccagcctaggcaacatggcaaaaccgcatctctgcaaaaattagctgggtgaggtggtgcgcctgtagtcccggctactcgggaggctgatgtgggaggatcatttgagtctgggagtttgaggctgctgtgagctgtggtcataccactgcactccagcctgggtgacagagtgagatcctgtctaaaaaaaaaaaagagttatttgtacatctttatcacagcaggtacgagtatcttgtccccagctgcctacttttgattttgtttctgggatgttcttctacacagaacattttaatcctgatattgtcaagtctctgctttcccttttagcttttggaattcacatcctgtttagaggtctcctgcgttctgaaattataggaaagaatttcacccacgttttcttctagtacttctgtggtttcatttttacatgttgaaatcatgaatccattggaatgtattttggtttcagcagcgaggtaggggtagatggtattgcttggatacacagcagcgagcttggtctggagcgggtggggcgtgtgtgtgtgtgtgtgtgtgtgtgtgtgtgtgtgctatttttatcagttttggtgtctgcattgtgctggcttagcaaaaacaatttggatgcatttcttttaccctctgccttctggaacattttaagcagcaacataataatctctctgttaaaacttttcaagaattcactcgtgaaaccatctgagcctgatacttttgggggagtctagcactttaaaaacttaaactttttccatgggtctgtgagtttgggagtttttctttcttcttaaaattcattactatttttttcctagaaaagtgtcttttagcttatttaaaatccgtcagcttattccgagggggttgctttagctcgcttagtgaggacagtgtgcagcgcggtgattgacatgattgatcagcagagcacgatcgatcagtcggtgtgcaaacatgactgactgtggccagcgtcctgggatgctccatgttgaggcacatgtgtgcagtgcagggtgatgtgtattctgagaggggatgaagccacaggacccctgcacccttaggagagagcccccctccccaaggctgcagtcttgagtaggtagtgacgggactgggtctagggggctgagtggtcccagcaggccaagggcttcaggaattatgagaagtttggagttgcccagagagcagctttcaaaaccagtctggactgcagcctccagaaagacatgcgattgacaccacgaaccaggacacacctatatatggggtgggggtggggatgggatgtattaatgaaaccaaatttccgtgatggaattcttacctttaccatgcgtgtgctacactcagtattttctttttttttttttttttcccctctctctttttttctttttgtttgtttgttttggagagagggaaggctttttttcatttttttttaaacagctttattgagatccaagtaagctactatacaatccaccaatttatttatttatttatttttttgagacggagtttcactcttgtcgcctaggctggagtgcagtggcgccatctcggctgactgcaacctccgcctcctgggttcaaccaattctcctgcctcagcctcccgagtagctgagattacagacatgtaccactacgcccggctaattttgtatttttagtagagacggggtttctccatgttgaggctggtctcgaactcctgacctcaggtgatccacccgcctcagcctcccaaagtgctgggattacaggcatgagtcaccgcgtggcccaatccacccatttaaagtgcataattccatggttttcagtctattcagagagtagtgcaaccatcgtcaccacaaccaattttagaaaattgaaaatttgagaaatttagaaaatttttttcttaagaagaaaccccgtagcctttagctatcaatcctgccctcctcctccatatttccttcctatctgtgtggattctttttttttttttttttttttttgagatagggtctcactctgtcacccaggctggggtgcaatggctcaatctctgctcactgcaacctccacctcccaggctcaagccatcctcccaccatggcctcccgagtagctgagactacaggcctgtgccaccatgcccggctaatttttgtattttttgtagagatggggtttcaccatgttgcccaggctggtcttgaactcctgggctcaaatgatcctcctgccttggcctcccaaagttctggaattacaggcgtgagctactgcgcctggccgattctagacatttcttgtacagagaattgcacgtttggcctttgtgtctggcttctccacttggtgtcatgtttccaaggtccatccacattgtggcaggtgccagtgcgtccctgagtaatattccaccatggcatggaccattccattgtggacagacatgttgccttcatcagctgagggacattgggttgctgccaccgctggtgagtgtattcttttcaaattaaaaaaaaaatgctggtcaccacccactagatcgttttcttggcccacagggtgggacaagccggcctgggtgagggccaggaggtggccaggtggaggcggctggagcggccctgggttgcctctgggcgcagcaggcagaggtgcaatggcagagtctgagcaggttccctgggcggatctccatgccggtaatgtttgtttattcaagaagtctcggccaggcgtggtgcctcacacctgtaatcccagcactttgggaagttgaggcaggcagatcacctgaggtcaggagttcgagaccagcctggccaacatggcaaaaccccgtctctactaaaaatataaaaattagctgggtgtggtggcgtgtacctgtagtcccagctactcggtaggctgaggcaggagaatctgcttgattccaggaggcagagcttgaacctaggaggtggaggttgcagtgagccaaaattgcgccactgcactccagcctgggtgacagagtgagactatgtctcaaaaaaaaaaaaaaaaagaaaaaaaaagaaatctccagtgctgccctgtgcccggcaccgaagccgagggaaggcagcattagtatgagctcccagcccaccgggctcctgtctggagctgacgtgcgaccaaggcacacgagggaagcatggcgaggtggacggtgcggaggcataaggagcaaaataaggcagatgcagtggctcagtggctcctggtggctgcgaggagcgtgggcaggacagccccaggagggcacctggagagcagggccggctggggcaaggtgtgtcaggcacttgtcaggagcaaaatgtaaggggacaccaaagagctcaggaatcaacacagatagtatttaatgcagtatttttcaatatcgaaatgatgcatagtaatctctatgatgaacaaatgttggaattttaaattaagacaggcccagccctgcacgtgcacagccctgtcagagtttgttcagcgtggaatttgatttgtttaaaatgttgcttcaaaatattgtttgattcctggattttttggcactgccttaacttttgcacctggacgaaggcctcaccctaatcccagctggagagggtcaagggctggtgaatttggctttggacctgcagagcttgtggtacctgagaggtggggccaggaacaggaaggagctggtgagaacggcacccggtatgggatggggccagatcagagcagcactgtggctctttccaacccgtggttttgctgctggatgcttggcgttggtgctgagcccccggccctctgaacggagtgtgatgaataacggggccggggagctcttgggcccctccctgaagcagcagtgaagccagggacatgccggcagcaggcagggagagggacgtctggtctgtgcctggagccagctgccccatggaggagctgggtgaggatgcggtgggaggaagaccttcccagtcctgcatcctccgaagcataactgagtgcttgtgtggcttgggggtcactctggtccgaggacagtcttgctttgcttagccaggctttgaagagccaccgggatacggacagcagccctgctgggtggcaggttgtccaccctcgcccactcaacgctggaactggatgcagagcacctggatggccagtcccagagtgtctctgacactcccagtcacctcatcccttagaccaggataagatgcgggatcccaacctcgagcctcccatgggctccattccatgtgctcccataagccactgggcccacctcctggctccagggctgtctggccatttggcatcttggtttcctcatctgtacaatgaaaataatagtcccagccttctcgaggagttacaagatgcctttcgtgtgaaaaactgggatttggtaccagactatctggatttgaattttggccctacccctcctaacctgtggctttgggccaatctggcctccctgtcctcagtttccccatttatagagccatctcattgagttgctgggaggatgaacataaggaagtgtactcatgtgcccagagcattgtgattttacttattattaccaaacgaggcacacaataagtgcctaatagatgctcagtgtcatttcacggattctgtgtgccttgtgtgtctccagcagccaagctctggaggtggggaagctgttgacgagttgcacgaggtaattagaaagaggaggccacaggtgcaagggtttgggtgacacctgtggacagagagaggccgatggaccctggcagaggggaagggggcccttgcacatagaaaatgtttcctgcatccaagatccttgtgactctggaacagaggcagcagaggtctgcaaattccaaatcataaacccagaaagcatagaacattcgtagagaggaccagaaacatcatatatcttagtgtgtatagaattttccacatagccaaacaaaagcacgtttctaactgaagctgttggagagttcctgaggactttataccagacaagggccggtaagtggaagttcaatacgcaggagccattccttttgttcacaaatgtttgccgtcttttctgtctatatccgcattcatgtgagggcactcataggtccaccgtccagccccatgctttgtttgctaccaaaaaatttcttaagaattcctcagctgcaaatcctcctaccggagggggggttccaggaacccagccttgctcggggttggggcacctcagcacctgctgcacaggcgttggtcattaaaggtcatgtgccgtatccgtgggccctcggggtctggtggcacctgggcacacagtccagtggcggcctcctacctgccagacactgggagtggggggctcctcattcctgttccctggcggtggggggagtgccccgagctgtcacacatcagaacccaccgactcacacgttgcggcaccttacagccccttgacagcctctcagcctgagagaccatcaaactgagttcctggagagggtggctgttgaggcctggacacaggtgtggacaggatagccctgcctcatctcggagtcccgctccggttcagcctcttgtgggtctgaagctcaggctgggccagtccctgcccctcagatggccggaaaggcagcccagccccacggcctccttgtcaggctctgagagccgcctggcctccagctctgctctttttttttcttaagatggagttttactctgttgcccaggctggagtgcagtggtgccatcttggctcactgcaatctccacctcctgggttcaagcaattctcctgcctcagcctcctgagtagctgggactacaggcgcgtgtcaccatggcaggctagtttttgtatttttagcagggaccggttttcaccatgttggccaggctggtcttgaactcctgacctcaagtgatctgcccacctcggcttcccaaagtgctgggattacaggtgtgagccgccacgcccagcctccagctctgccttgattttctcttaaggccgtgaggatgtccacgcctcctcctttcctcacggcccattgatgtctccagatgctctgcaaagccaccctcccctcgggagctccccagctggtgacgggggaccttttggggatcactgcccaggtagtcatgtaggtctgtgggccgtgcttccaggctggaccgagacccggtgcatggggtgcttctggtctgagctgaggcccctggaagccacagccaggaggcagcaagggacggctgtcatgtcccctctcccctgtctcccagggtccctgcgggacagatttccctgcctgagcctcctggttgcccataccctggcctcccaaagcccagcctgaagccttaggcaccctacaacctgcttcctctagcagcctgccctgtctcttctctgccgatgttcctgaaactttcctgcctctccttacctcttggccagagagagactggagaccctgtgggaacccccgaggggagggagaaggccgctgtttgaacggaggtggtctttccctctgcccctccccaggcgggtcacacttgcaggcccagcctcctgctgtggcagcgcttggggtgtcggctgcctcctgggcacgagttgggagctgagggaggcgctttcaggaccggagtggcaacccagctggaggaggagtaacaggcccgtggtcagcagcagccgccgcagggaccccggcgctgtacctgtgccccagctgacccctcccgcttccctagggtgggccggggatggtggtctgttgcccagcccaggaagaagaggggccgtaatcagcagcagccacctcaggggaccccagcgctgtacctgcgacccagctgacccctcccccttccccagggctggctgggaatggtggtctgttgcccagcctaggaggaagaggggctgtggcttccactctagaggtctctctcccggtccctcccccggtgctggtctaactgcaggcctgccttaggccgtgccggcacctgctgactgacgcttagcggatgctgataggagagggctgggatggggaagcagcaagtcccggtcactgtgggctcgggttacagatggttgaggcacctcctggccatccccaggaagcaaggccccacgcagcctccgactcacccactgcccgtgtgtatttcaggaggctgcatcccccaaggcccccaccaggtaacttcattgggctgggtgtcgctgcaaaaccacccattgggtgcggtggtcttctggtggggggcatggctggggaggatgcggtggaggagaagccagctccgtggttggggggagggcggactatccgtttcctgtctgtcccctgaactggagctcatggtccctcccccaggtgcctgggccatggaagaggtcacagccctgccttattcctgtggcagcctaggggagccctggccagtcccgtgtctcctgggagggcgacagcctggtcaggctgcagggcaggactggaatgcagacccctgcttggccatgctgttgcctggctgctctgtctggggaccttctgttcaggaagagagaagcgggccggacagcccggctcagtgattggaagctcagctccccatgttcagtccagcaggaagtttgcctcctcggaacacttgcgtgcttctgcatgtgtcttcttggctggtggttctgcgaggcccctactgggctgcgtcatgtcctctggccaccctggccttggtgcctggcccctgtgaaacagagatacctgggcagtcccccacttgtgcttgcaagcctgtgtggcttcagtgatggctgattctgctccacccagaggacctgggaatcctcagcccaactgtccagaggagtctttctcagtggggagagcctgagctgtcctcctggtggacagtcctttagatctcaggcggacttccctgccggccgttcctcctgctgcccctgctcctctgtcccccatctgtctcccaccctctcccctgcagcagccagctggcacggggacctccccttccctctgggattgtgaatgagacgactttcctggtccttctgggtctagatctttctggcaacagtcagtgaaacccttgtctcaggtgggaggagaaggctcagtatgtggtcacaacaacggtcctaaccacatcactctcaaacgctggctttcacttaccccttgccctgcccaacagttactttcatcatcccattttccagattaggaaatcaaggcgcagagagcttcagccacttgcctgaggcccccacagttaagtgtctggatttgaaccctggagcagcctggctgctgagctgtcctggagacggggtactgtgcagtggtcggggtaggggtggagctctgccgtcgctgactcccgggctacctggagtgataacacagcccagtgtctgggcccctgcctgagactttggctggatgccaggagcccgagaccttccagctctttcctgtgtaaggcgccatggggtgaaatgaaagaaaaccccagttagaaggtgtccccctcttccttcagtccctcagctgccctggattttgaaataagacaccgcccgtctgtggggtgagcaggaacagattggaaccgcatttctctccccccagtcacagctgccaggagctcatctttctctgtctcctccccctgccgcctctccccacaagactgggctggatgctgctgggaaagtcaacaggaagtcttttggctgcggtggaggtgggggtctgtgcttccctggggaccgagatgagggctccaggttggctccggcaagagcagggaggctcacgtctctgcctgctggttttgcttcctgtcctgggagaaggtatccacatgtcccagaatgcaccctctgcgtgtacagggatggcttttgggccattcacctgaggtttattgatctttctctttggaactggagtggctcctccacggtggattgggctgagctctctgcctcggccgacgtctttccccaggcacttcctctcaccgtgccagggtgcaggttgctagtggatgggtcttcaccctcggggattggcagctgccacgctcatttcacagtcgagacaccctggccgaaggttctgctaagctccatggagtgtagggattttttttgagacggtctctctctgtcgcccaggctggagttcaatggcccaatgtcccgctcactgtgatctcgacctcctaggctcagcagtcctcccatctcagcctaccaagtagctgggactacaggtgtgtgccaccatgcctggttaattttttaattttaatttttttttgtagaaatggagtcttactatatttcccaggctgaactccaactcctgggcttaaatgatcctcctgccttggcctgccaaagtgctgggattccaggcatgagccattgtgctcagctggggttttcctttaacccttcctggcccttcccaggtgcaggacccgggcctcagccttatgtgttcttgaacagctctgggctctgtcctgtacctcctgggcgcgtggtcaggcctctcgtgacatcagcaggagactcaggtgaagaagcaggcagaacggaatgcttgctcacccagcctcggggccaggcggggcggccaggacagtagcagtggctggtgtggcttcctgggaggtcagcccattggcgtggccagcgaatggggaggggagcttctccccttgtctcccctcatttctggtctctgggcctccagggccaggtctccagagttctaggtggaggatggaggtcagggaagctggggtaagagcgggctgggggtgggtggtcaggcggatcctggaaaaccatcctctgcaggtcccgctttccccagggagcactcagggctggtcccggggagccgggctaatggtcacctcggatggtgcaggggtccatccccatgaaaccgggcccatccccatgaaactgggcccacagaagcttttggttccggttctgttctgccccctggctcttgcttccaaagtaggactcaggatagctctgaattccctgccgaaatgcagcttcctgggccctaacccagccctccagaaccagagtctctggggtgggccctctgcttgtctagcagcctccaggggacacttgtgcctgccagagcaagtctaataagcactgctgtaaacccctcgtccccacagccttctggttcgtctcccttttcctgctgggatctgcatcaggattaaatgccaacatcagggatcaggttatacttgtgaaccctgagacaatacctgcatctttttttttcttgaggctgtcttgctcgctctgtcatccaggctgaagtacaatggtgtgatatccactcatggcaacctccacctccagggttcaagcaattctcctgtctcagcctcctgagtagctgggactacaggctcacaccaccacacctggctaatttttgtatttttagtagagatggagtttcaccatgttggccaggctggtctcgaactcctggcctcaagcgatccgcccgcctcagcctcccaaagtgctgggactacaggcgtgagccactgcgcccggcctgatacctatatcttgaccaagctgctgtggaaacattgagttccccttgatagttttgtccacagagtgaatgtttaggaaccggcgaggcatctctcacccccacccagatggcggcctggaggcagcgtttctgaccctgtgatgggatttgtctctcttgtccaagagactttagagatgtggcccctgaatgtgggggcccctgttggggtgggaacgggagctggccctggccattgtccagtgaccccatctcagtgcctcgatcctagcaccctcgatctcagcgcctccccttccccggctccgcgcggagatcacgtggcttgcgctgagcaatcctccactgcccccgtcgcgttcctgctgcagggaagcctttccagggagccagctgacacatttggcctccattatttgtttttgaacaggaatgaaaggagagagtgagtaagaaagtggcaggaggtgggggttgcagagtaggggaaggtcagagagaggggaggaaagatctggaaagtccaggcatgtgctctggaagcaggtgccagcgatgagctcatctggagggtggccgcccgccctgagccctgcctggggccagcagggaacactctgccagggcatgtcgctgggagcctgtccttggctcactttctgctgctttgagcgctgagcagatttgtttccattttagggacaacgcaaggaggctgtcattccacccctcaccttattaatatttcatgaatcataagtgaccacttactgcgtcctgacgtactccaggcgctgggctcgaagctttatgcgcttcatgggatgtatctgcactatcgccgtagaaaacggttcctgttactactgcagagaaggcaccgaggcacagagaggttgaggaactggcctcaggccacacagctagaagcggctgaccctggctgtgaacacagggctgcttgactccaaagcctgagctggtttgcagcgaggctcatggtttctgtgccactgtttgagcctctggtcgagccccttggctcagtggggggcccagtgacctaccagctgttccattatatgttgtggacacctccacggcccacctgggtgggagggaaggggcttcaggaggtgggaggggtacagggaacacagtccagcctgcttgggcccaataccttgaccttcaaggtaccccttgagggtagcatgaggctaagctcttgttctcctccaggactctgttcctgtgagggcctcggggtcccttgcttttttctgggggccttgctggtcaggatcacagagaagctctttgctgttgatctttctgcctctgtatcttttggcaagccattttatgactcagttgctttgtctgtaaaatgggttgaataacattgtcctgcctcggagggtttttgggaggatcaaatgagacctgttgcacagaagccctttgtaagccatgctgactggcggtcgccgggcccccaagtgaatgggcatccgggcactgagtgtgtggactcagtactcggaaggaggggctggggggtacctagaactcctgggaggcttggacccctgctctgctcagattctgagcttctccttggccagtttaattcccatcagtagggtgagggtaaccaggacttacgcatagttgggcgaagtcgagtgaccacatgtggaagtctagcgtccttcatgcaaagtgggcaggcggccaaagtgagctctgctccagtccccccacccccggggctgttcctggcgccctgccctcccccagagccccactgacctgcaccatgtgacccgggcctgggaagatgggcccagctgtgggaggtcgtgcgggctggggactgagagtgccggaggagggcctcccaggaaaacccagctgcacaggaagccgggccagcggcctccggaagcctctgggctttgcaagctggactccccagatctgtggctgtggggccctctcctgcctgcagctgagagcccttgacccgcacctgagggcttcagaggtccgggagggggatgtgaccgtgtccccagggtgaagcccacccgagtgtcactctggatacagccctcacctcttcctggccccctctctggtcatggggacgctgcctggggggggttcccttacatggaaggagctgcagctgagctggcgggcctcgcacacccccaaggccgcctgacttccagcctccaagtggggttgcattcaccactcaggacctggagcctcagccagagagggaccctccactgcctctttctctgtctcttgggaaaggtagggtctttgtgccccctcccacccagggacctggcatgttgggaggctaagaggaagctgccccccgctcatctaccccccaaccctcccagccagcagagttttacctgtgtgcttagaatctgtgcgtggagccagaagtcacaaggttggcccagctgtgtctgaccctggttgtgcggtcttggacagtcccagccctcctggagctgagcatcctgatctgtagaggagaggctgctgtgccggccccgcagggccctgtgcagaggggagtgtgtgcggctgtgagttcaggccatgccctcagactggaggataggatcggaacagtgggtcaggatggccagagggtcccagcctcaggaggaggcctccacacctcccagcacctccacaccaggaaatgcagccaggcccccaggcctcccatgtcaggaagcagcaccccgccccccacctctggttgcctgggcctgagaagttgagcactcctcccgaatccgagtgccctctgacccctgcttgggtagttgtccctcctgaactgaccgcctgtcctacacagtcccctgtggtttgcccgacagggtggccagcgagtcccctgcacagcacacctcccccaggagtgctgcctgtgatgatggtgtaaagggtgcccccccgagcccccggaggcatgcagtggcgcaacagcgtgagcccaggagccccggtgagctcctggatggagaatctgttcagatcactccccagcctaaaccttccctgggtgtctgctgtgcttggggcgctgactcatcgtggggcggcctgtgagaccctacgtcacctggccactcccctcagcccctgttcactgcaccggtcccctggcctggctgctcctggaacatgagggctcatcctcacggaagaatattcacttgttccctcctggaaagtccctccctagacctcctggccgcctcattcaggtcttgctgaagcgctgccatcttggagaggcctccctgtcacccgcagttaaaacagccctcccatgcctgtgggtggctttctatggggcatggatgagtattggagagtcttgccgtttatttgttcatatgccctctgggagggcaggggacactgacttgtgttgtgggtgccttgcatgtcacgggtgctcagtgaatgcctgttaagcattaggggagcacaaaggagggaagcctctgtccaactggagcagtcagggaagacttcctggaggaagtggtatctggtctgcttagaatgtggcgatttgtctgtatgcagacattagattagagggcaaaggccattatcataacttagcagacagctacaagcagctaaggaattgctatgacatggactgctcgtgattggagctaagaaggagtcagagacagaggtccctgtgctctggcgtgagtccttgggggaggctgagctcccagaatgtggggccgcctgtgcagaggccggaggtgggagacacacctgtgagtgccggtgagtgtggggtgagccactggggctggatcagaagatgggaatccctaaacccaccaaccagccttggtgccctgggagtgacaggagacggggcttctgggggactaacccagcacaagtggacgagatgggatgcaggggaaaggacaaagctctctgaggctttgggaagctgagttagggtagagccatgacagggtgagttccagaagcaacacaagaaaaaatagctagactgggttttcccttcactgtgggagatgccccacctcacttcccccgtcctccgggctctggcaatgggctgggcacagtgaatgggttccatctgcaggagtggtcacaccccttgggcacagctgcctcatacactgtattgagatgggatccgaggccgggaagaacagcttcttctgtaggttgacattgtcagccttcggggagggaaggacggcagggggcctggagcatctccttttgccatccacactctgtgcctgcctgcagggtcttgagccctgtctgttctgcctcagtcctggtcaggaacttgttggagcccataggggcagtcaggctggaacaggaggagaccaggccggcaggggagccgagagggggccctggacagcacccagggctgagtcatcctgggcctgcccgacttgctatttggagctgttcccgcttgctcatcatgtgcaaggtcctgatccactcgggtctgtttaaccagcgcccctccccaggcccagttagcctggttttcgttcgattcatttattgtcatcagtgccatccttgcaccacgtaactagcctttgcagcatgccagccaccaagctcagggccctctgtgcatctcctgtaaccctcacagcaacccgggaggcacagagaggctgagtcgctggcccatagtcacacagcaggtatggggcattgccaggatttagccggatctctgactccagggcctttccagggccttgggtgggacactggcaaggaagcaaggtatgaacactggccctgccttggacagagctcggggacggtggcctggcaggcccagctgacacagtgaccctggtgcaggttcaaccattggcaaagtgttcaagtacacacagaatctcaactggggagacaggcgaagcggtcaagggagggctgtgagtgacaggtggacactgtacctactggcagatcagctgaccttggtgccttctggagcctttcaacttccttatccagaaaaagaggaactaacagttccacccccaaactgggtgggagtaccacattcgaaattgaagcaaagctggtcgtgtcacaggctcggcagatgttagctgtgcaggcaacttagtgaccatttgaagtaggctgtgcggcggcatcctcatcttgcagatgtagtccagagaggttagggcactaaccctgggtcacacagcgacagctcaggctacagagagcagtgctggatgggagggtgttggcagcttcaggcacaggctgggagggctgtggggtcagcagagggagggcacacttcccagctggtggggttcccttgtgcctcagtactcatgtgggcccaaaggagctggaaggagggaggttagagccacccatgggttcagaagctgataagcaggttattgactctgaatttgcctcatcgtatgtaaattggggacaaatttggggatttaatgatataatgtaagaagcagacatgtcacagccctggttatacagtcagtgtataataagtggtaagccgtcagaggaggcagccggtgagaatgggagcatctcagcagccctccgccccctgctcctggttgcagatgtacctgttcttggctatttgtgccccagctccgtgtcctccggtgtgtgtgaggccaagctcctggggtggggacttgggggtgtgtctgcagctcctgaggccaagaccaaggctgaggccgaggctgaggctgaggccaccttggtgaggaggaaattgcaggtggagaagctcgttgaccgtgaccttgatctgaccgtaattttgatggtgccgatgccgtcagcacgcaggcctcctgccctcgccacgactggctcctgcagcccacctggctgagaggtgtgctggctctcgcaggttgcaaaatggggacatcaccgtccgcctgggctacagcgtgctcgccgattgcatttggggagggactgagggctgattgtgttgtggggatgttggcagagaatcagagagggcatccaaaaaggccaacagttcggtggggagaggaggcgcaaggctggttcctgttttctgggctttgatcgaaagggaacaggggacacatctggggacagtctccttcctggaggaagaagggcttagggtgctggtgtggagtttgcacagatggggataatgagctggagggtgctgggcaggagctggccagtaataggctgacgagggaggccctgctggctgggcctggttttcaagtgagcatcctgagctgcggggacccagggggtcttagagacctcagagctgagactcgggaccacagaggggtgggctgtgctcagggcaacacagcggatggggcagatgttgcgaaacctgtctctctgcctctctttctcctgctacagaactggatcctcccagctcatggctgtcaaatcctttagatgcttctgggttccatgggcgccttacactggcttccctgtaggacagcagaccctgggggttggctctgatggtattcaccatggggtaccccatgcaagcacagtgctttcacgcccagcctcccagcctgtggagtaggcctgtgtctggccagcctcactttgtggccagaggagggagacagtggttctggagacaggagctggcctggggctgccctcccagcccctgttctcccagctcatctccttgccttgcgggtgctggccaccctccccccgccagctccatccccagctttctctgcccgagccgtgacctgtcagtagggggcagtggaggccttgaaagtccttggagaggactttgaagcagtttttacaaatctgtccctggaaagtctctcctgtcacacccccagcggctccctccctcctaacatttttcctggggttgtcatgcagcggggggtggaggaacccactaggccgtggatagagcagagccatgttgacacaaaccctggctgaacccacatgctccctacagccagcggccgatcactggaaccagggaagtgacctcatagcaagggcccgcagagcagccatcacgcattcccgatcttggtttctggacccagctctggaaaagaagccagatcctagccacttggagctgcctagggaagaccccagcctggtgccggctgacagctcactggaacttttcatctgcttggccaggtgatgccaaggggcagaggttagaagtgctaagaagcaggccgagggtggtggctcacgcatgtaatcccaacactttgggaggccaaggcgggtgaatcccttaaggtcaggagttcaagaccaggctggtcaacatggcgaaaccccatctctactgaaaatacaaaaattagccaggtatggtggtgcacgcttgtaatcccagctactctggaggctgaggcaggagaatctcttgaacccgggaggcagaggttgcagtgagccgagactgtgctactgcactccagcctgggcaacagagcaatactccgtatcaaaaaaaaaaaaaagaagaagaacaagaagtgctaagaagcatctgtcttcctgattgaaaagcaatctttgctgggcgtggtggctcacgcctgtaatcccagctttgggaggctgcggtgggagagtcgcttgaggccaggcgttcgagaccagtctgggcaacagaggtgctaggggtagtggcgcttgcctgtagtcccagctcctcaggaggctcaggtaggaggattgcttgagttaggagtttgaggctgcagtgagctatgaccacaccactgtactccagctcctgggtgacaggatgagaccctgtctcaaaaaacaaaacacaaacaaaaaaccaacgtttatcttttgtgattttaaaaatcacacctacttgtgacaaaataattaaattagaaaatgtaaaggaaatgatcaataataattgcgtcctccagacaaacactgttaacatgttcacgtttccttctagtctttttctacatagacactcaatacttattaatttgttttgaactaaagatggttttctctgctttgtatgagaaccacctcagccaggcacggtggttcacgtctataatcccagaaagctgaggcaggcagattgcttgagcccacgagtttgagaccagcctgggcaacatggcgaaactccatctctacaaaaaaacacaaaaattagcctggtgtggtggcacatgcctgtgctcccagctcctcaggaggctgaggcaggagaatagcttgagcccgggaggtagaggttgcagtgagccaagatcgtgccactgcattccagcctaggcaacgggagtgaaatgctgtctcaaaaaaaaaaaaaaaaaaaaaaaagttgccacgttgtcacctctctcagggattttcatcctttctacttttcgcccaagacttgccctgtaaaaggatgaggccaaatagccatgggagggtggtactggatgttcaaaaaaatgtttcgtggctggcgggacttagaaacaggttggggaggtttcagcagagggtggaccccagctgggggtggggggcagcaggggggcccctcacatgctctctctgcgtgtttcatggggctgcctgtgaggccgtgtgaaccagagcccggctgggaagccacatgctacctggactctgacctttcctggcagcatgaccttagccaatacgctcaactatgttcccctctgtaaaatgggctaatagaaatgtccactcgagacatgatgagaaacaaaggtgttcatagagcaaagtgcttagaacggtcctggcatgacaggagcccacatgtcagtgctgccgttggcatcgtcatcatcacggcggcattggctgctttgtttctcccttgtccctgtcaccttcttccctcagcaggctctcattcacttgttcatttattcatggccgaggccccgtctgtgtcaggcctggtgctgagaacgggggtagagagatgggggctgtgccctgctccctgacccaagggttccctttgcaatgtgaagttcttggagactggaccctcaggctgttccaccagcccctcctcaggccagcttaacccttccgtgctcgttttctgagctgttagaggaagagagcgggaggaaggatggagtggggtttttgtggggactgagcggggggtgtgtgaggccctggaaatggtgcctgcggcactcacgcagcattagcttttgctgcagttgctgtttggagaatattcttggatttcaggacactgatgacagaaggtggaacgctttttctggaagccatcaagaggggaccaccgcggcggctgagcagagttgctgacttgtgagctgtggcctgaccacagtcactgttctcatgagcgaggccccctgtggtccccctcccaggaatttctggccccttggcaggggacagttcagggctgggggtgggtagtggtgtctgcaggccctcttggagtcagagaatcccctgtcgccgtggcggggctgttccctcctgcccctcccctcccgctgtgctctcagctgctccgacaggatgcttttggcctgagagacagaaaccccaactctgaatggcttcagccctcaagagaatttggagcttttttgtgcaaaatgagatgttctgagcatcgaggatgctgtgggggatcctccatcccaccatctccagccgtggtgtccctctcggtcacaggatgctgcagccacgttgcagggaaggagagcctcccttcctgtgagcctagggagcccctccatgcagccccttcactggccattgcctgagacccgacctggtggctcctgccccaaggagcagaaagggggttcgctaggtcagggtggggctgggtgcgaggaccccccccggccaacagggtctgcttaggtgtccgtcctgttggggcagcagggaagggacccacatgtggcactgggacacggagaggcttttgtgcctgtgacggccaaaagggatggcgccccagccacgttcccacccaccccgaggcccagcatggccatgccggaaatagcagcatcgtccccctcactgtcctggcttgctttcaataggccagaggggtggggctggagcgggcgtctgacctgtggctggatctagctgcccgtggacaggctgtgagtgaatctgcagaggaagggagatgggaatgccgggaccttctcctgcacctcccgaacccccgttccctgtgagttagatggggagtgcacccctgccctcccctcctgggtatcccctgcgccccccgccccaggcacttgatgttgcctgttcattttccctctctgcccctcccgctggcccttcccatatggtcctaattaggaccttccgcccgttggtggatgggcagagaggggagcttgctgtggggcctcccccgatcgggggacttcccagcacagagctttctggcctctgcagggacgctgtgtgtgcctgtgtgagtctggcgtgttagaagcgctaagctgcagctgttctgtgcgtttttcacatttctcacttctcaaaggccctgggtttggtgtctgtgggctggggatctgtgttggggtctccaggaggcccttggtgggagaggcagggccccttcccctttaatctgggcaaccttgctttggcctgctgtctgcggaaagtgccctaggatacggtggcaggactggctggggttctggctccaggcccagccccagcccctgtcagacttaccctccttgtgcctccgttcaccctgtccacccgcagggcctgcaggagcatcctgagagttggtagggtggcctgcccggcgtccgcacagggtctgctggtgggtggctgaggctgcggtgaggtctccatggctccctcgtcctgcacatccttcccttgttgtgttgtctcgctagcatatgagcccgtactgcctctgagtctgcagcctgttttccttaccaggtggctaagcagggtggcagccagggtggcagagtcccattggcctgcaggggaccctctgtgggctgcaggtagtcccctgtggttgaaggtgccctggcaggacctgcaccatgacccccgtcaaagctcacgtccaaggcatttgtgggcacccccgccccagacgtgagggttggcatcttctcttgcacgtgaagcaaaggcctgtttgaaggagcgtgtggaagcctgggtgtgatgaaggcaaggaccggtggctcacccctcttgcacctggaccttgggtggcaggcctggggccttcagtccttaattcaggagggtagccagtcgctggaactaagagtgaacttcagctgttgttgccatagctggagggaagaggggaaaggaggcgctgcaggggagcagagacctcacccttcctctgccgacatcaggctgccggtgctggacggggccctggcaaccgtggcaggagtggtgatgtccgatgatggtaacaagggcttcctgaggaccccgagctgtcttaagggctctttacctggagtaagtatcccctttaatcctcccaacaacactgtgaaattgattctgttgttattcccatttcaccgatgaggaacccacagcccagagatgttaagtaacctgcccaagcctccctctgagcatggcagagggagggtccgaatgcggaaagtctggcttcagtgcccccatccctaaccactgtcatttacctcttcggccagccctctgattgcaaaacctgaggcccagaggagtgcagtgacttggccagcttcgcacggcaggttagtggcagagctgagcagtgtctcccatgccctgattctgtggcttcttgaggtggctcacccctaaacacgccccccatggtggctctgtttcctcctctcctctgaacctgccagcctgtgctcaggcagggggagaagtagagcaaccatgccgggcgggtcgtcgtgccccagtgccgcctgccctacacctgattggcagcagagtggcccctccttggtgtggtctggaggtgccagtggtcactcatcagcacagcccagtctcacacatgtcactcccaaaggatgttgacacagaatgaagcagctaggggaggcggacgctttggcacgagggtggcgtttctggtaatccgtagtgctgttgtctgtggctgcctttggctggcatctcacctcctcctggctgtcctgcagccacctgagggaggtcagcatgtcgccttcatcccaggacagtgtgaatgcagcagcgcaagcttgccagcgccgcactgcgggatctggaggcctttgctcctgagccctgcctctgtgtaatccctaaagcacggacttcttaggggcttccattcctccacctggaaaaaccttacaccgtttagggcttgaggcagggctagagcatggagacgttgctggaggaccaagggagaactgagcgcgtgttctcttggcctcagcctcgtgtgtgtgtttatgcatgggtactttgccatccacactggcttccacggctgggtgggagttgagttgagctcggcggctgcctttccaccctgcgggcctggttggggagtgtgaggatgcctgctggaagccaacgtgcacgaaagagttaatggtggatcccatttcctcagccccctctccagctttcccagggaaagggcaggaacagagaggccttatcttcagaggaaggggtgggcggggacacagcgctgttcggcacagtcccctctgagccaccctgcatgtttcattccaccgacttctgcagcccagctgttcagagcggatccagaaggtggagagagggtttccaataagcagaggatggagtgaatgtgagattcattactgggatttggcaaagcaaagagcctcactttctccccgcagatgggacgggggcggggctggagccagcggggtgggggtatccagcaagagctccttcccatcctcccacttcctttgccatgggccccctcctccacgcagaccctcagcctggaatgatcagtgtccagcttttctcgcccctctcctgccccgctggagggagtgacctggcccctggccccggccacctacacctcctgttttgctgcactagcctcgtggtaggggctgcggcggaggtgggcaaaagccgcttccgggcagccagcccccatcctgggagtgactgaaagtccttgggggttcctgcagggtgagctgcccattctggccctggtaaggacacccaggagagggccagggtgcctgtatttggggcacagcataaagaacagccgtaagtgtttctcaggcaggagggtgccgaagcattgggaagctgggatttagaagcattgtttggggtggtgagtggaagatgcaggacacagattcacgcgattgtgcagatcacctggcctcactccctcggtttacagtggaggaaactagaggccgagagaggtgaagtgagttccctggggtcacacagcctagccaggcccagggcgccgacctcctgctctgccttcccgtgcccattcggttggcatcagcatccctgccttgacacccccgtgtggcagctgctgtgattctgtgactcctcctcaccccaccccagtggggccctgcgagggaaagaagaatgccctatgcagaagtggttggaaagcaagaagcctggagagaagtgaggcctctgtggtttggcctgagtccaggactcatggcctggttcccagggatggagcaccgacccctcccttctacacccccaccccacgcccccaggagctccctatggggaagccggaatggacctgggctcagagattgtaaattcatcttgctggatgtgtggctgcctttatgtaaccaactctctcacggagaagccaggggatggctctcagtactctcgggggtctctcagtgaggtgggaggacctcgagaggtcaggaggctgctcaagaccttctgcccctcagggaccaggtgagggcttgtcgactgctctgacctcctgatgcttctggtggggagacctcagaggggcctgccgtcaccatcgccagtggccctggcctgcccagtcatccttctggggtggccaaactccatgctgcaaaagcccaagtgaaccccagtagtggcctgggagaatcatctgtcacgagccaaggatggagtttctggggaggactttctgctgccccccaacccctttcgggtacattctcctgtagccccactccctgtaagaaagtcaggtgcctcccgaagcttctccctggccccaggccagaggtgacagtgggggccccttgcttgcgctggtgactgtggctggttgttggtgcctggccctgccctgcactgtgcacccattgaaggcggcatcatccgggcctctccggtggccatgcatgggtgagcagcccacgacacatctgcttccagcatcgtgtgggccggggctttcagaggggctgagggcttggatggccctgcaggggggtgctcctggccttgtgaccgaaaggagctgaaggtttggagaagccgttgggccgaggtcagttcttatagatttggcgaggagggaacagatgctcacggagctgctccaggcactgcacacactgcctcactctgcgctgacagccaagaggctggttccccgccgacccccattttacagataatgtgctcccccagttccttagtggtggagccaggattcgaacccacgcaggcagcctcctgggcctgtagtcctacccttcatctccctccaggacctatgtcttggggttggcaggataatgactcccagagttgagcacatcctaatccccagcacctgggactacgttaggtgacatggcagggccagctaaggtcactaatcagctggtcttaaaatagggagatgatcctggatgatccacacgggcccgctgtcatcacaagagtttttaaaagcgcaatagaccatctgaggggtgcagtgggagaggcttggaaggaggaaggaggccacaagccaagaaatgcaggtgaacagaaaatgcaggaaaacgcagtctcccctgcagcctcgggagggtgcgcagccctgtggacaccttccctgtagcctagtgaggtggagtgtgggactaatctgtgttgtttgacatcacaagtgtgtggtcatttgctacagcagtgatgggaattgaatgccattaggcagcagtgcttctatcccggaagaattaggataaattcccctgtggatctcaagctctgggagattctgggctcctctggactgctccagttctgcaatcataggaaaggtctcccatgtctgtttgggagaagaaaaccccgtagcaaatccatttccccttttgacaaatgaaggcgagggtgtgggctggacacatgtttcctttttgtggattttttttgttttaacacttagaattctgtagctgaaggagactttggggggttgtctgcctgatttgcaagtgaagaaatggaggcccagggaagttaagtgactggcccagggtcatgcagagtcatgctggaatatcaagctagatagcccagttcctgctccaaagtgctttcctccctggttggggaggagggttggagggagtggaccccgagcaacagcagcattggcaggggttggaagagtagctactgtatccaggtgctggagcctctggccacttcctgcaggaaccaggtgacccaccatggcacaggcctctccctgtctatctgcagccctgggggccccagggaccagaggacactctggcctgagggctggggcctgagagaagagatggaagtacccctagtctggcctgcccccgtggcgtcctgcaggcatatccggcagcccaggggtcctagagaacttggctggtgggcgtccccaccttgccgcagctgcaccctgtggccagcagcttgcaggacttgggctgttgcctgtggccctgaaacagtcattttctgagctgagtggggatcaggtgagcagatccccacaccttaactgctgtgatctttctgtcctggaggctggtgggcagcctggttggtgcttcatggcactttatgaccggccctgtcaccaggctcgtgagttgctcccctcctttcgggcatcctgaacggcttccctgagagccccgccctgggccttcgcctctgcaggcccccgctgcctggggcgcctccttcccctggaagctgggcctctttggggactcattaagaagggccttgccgagtgctgccaaattgccccatctggtccccatttgttccacttaccaccctattttaacttttatgtctcctccttggctctaagatctgagcaggcagggcctgtgaggcaccccaggtcccctgatgctgccagcacccaggggactgttagtacatatgcagggagggaaggaatgaaggaagagatgacttggggagtcctccagttcccatttgtaactggcacattgcgacaaaacactcatggcattttacctttttcatataccttttttttaaatttatttttatttgagatggagtctcgctccgtcacctaggctggagtgcagtagcacaatcttggctcactgcaacctccacctctcgggttcaagcgagtctcctgcctcagcctcctaagtagctgggattataggcgcccaccaccacgcccggcgaatttttgtatttttagtagagatggggtttcaccaagttggccaggctggtctcgaactcccgacttcaggtgatccgcctgccttcgcctcccaaagtgttgggattacaggcgtgagccactgcacctggctttcgtatatctataaaagagaatttgcccagaaaatctttcagatgcacctttagggttttaaggcacagatacatgaagcttgtcagtgagcagctgctgcttattcctttttctcttccaattcagagcggcctgcgtcccaagcggacagctgctcccttcctcttggctccctgctgcccacgctcccacagaagcagggagaagaggcaggaaggtgacgcgtgatcatccgctgggcgcccgcacagtgccgtctgcacaggtgccatctcctttacttgtcactctcctcgctgagccctttcccctttttgcagatgagagagcattgcctcccagaggttaagaaatgggcccagagtcactcagctgatcagcgtgcagccagatttgaaccacatcctgctgatctccatgcctgcaggcctggcctgatgagatggacagctgggtggtggagaccttgagaccctggatggctcccaaatagggcctgtagctcctggacagggagagtctggcacaaagggtttgtggagtgagctgggggagaaggtggcttagggtccctgtctctgaacaaacagatggaggggctattccagcgttttctcagcctctggtgtgctgggctcctggttctgggaggagagaatggagctggcctccattctgggctgggctggtttgggcccaattcagacaagcttcttagtttgccatgagtgacacttttgcctgccctggtgtctctgccaaaaatatgaagggtttcagaacccccaccccggcctgcttccctcccagacttggagtgggtctggggctgacaacagtctcatgccagatagcctgagcagccaccagtgccatcaggtctgacactgcggcccctgccccggagggaaaaacaaggccctctctgggggattttctgccagcttgtgaaaacaggcctggagtcagccagcgcccccatgcttagacacttcgtgtggttttcaaagtgcttttatgttgctagctcatatgatcttccccaaaaccccataagggagggcaggaagtttgagcaacagcctgtcaagcacccatacagcaggtggtttcattgccctccatttacagacaagtaaactgagcttcagggtggctaccgcttgtctcccaagccacccagccatttagccacggaagaggtcatgactttttacaccccagtgaagctgaagatttttctttccgtttttaaaaatgtttactccccagggcagtgaacacctggtgcctctgtctagcgcaagaggtgaacgtttgccacttccgtttctttcctcctaccagacctgaccctccttttgtgacgggaacatcctgcaggcagtctgtcctgctttcatagactttgagaaacggggtccaaattgccggctgtgggtgggacaggcgacactgcagtgaagaggtggagtatttttgtagcggggaagaaatacatttcctctaccctcttaggttcagtgtttgggggtctgtgaattaaactcactcaagataaattaatgagagaaaagacagatttaatcacatacgtatgggatttcactgaaaaacgtgactcaaaagagcaggtagaaggtggggcccgtgactggtccgaaggtagtgagttatctcagttgattgttcacagtcagttacagattagactccttgttccactgtctcccctcttcccacttgttttgttttttttgagtcagagtcttgcactgttgcctgggctggagtgcaatggcacgatctcggctcactctaacctccgcctcccgggttcaagcgattcccctgcctcagcctcccgagtagctaggattacaggcacccaccaccacgcctggctaattttttgtatttttagtagagacagggtttcactatgttggccaggctggtctcaaactcctgacctcgtgatctgcctacctcggcctcccaaagtggtgggattacaggcatgagccactgcacccagccaactagtcttaaaaaaaaaaaaaaaaaaaaaagaacttagggcccgtatactatcttaataggaaaaaaggaaggggtgaaagcacatattatgggccgggtgcgatggctcacgcctgtaatcccggcacttcgggaggccgaggcaggtggatcacctgaggtcgggaattcaagaccagcctggccaacatggtgaaaccccgtctctactaaaaatacaaaaattagccgggtatggtggtgcacacctgtaatcccagctacttgggaagctgaggcaggagaattgcttgaacccacgaggcggaggttgcagtgagctgagatcataccattgcattccagtctgggcaacagagtgagactgtgtcttaaaaaaacaaataaaaaaaaaaaagcacatattatggcaaaacaaatgagtttttggaaagataaataggcccttaggagctgagatgggagatgtgaagtcttgtgacaatgtcttcttaggtgtggtgtggaaactactcacatcttccagggaagagtcagttgctcccagggagcagatttgggcctgtataccatcttaataggggaaatggaaggggcaaaagcacatattatgggctgggtgcaatgtgcccagtgcaggaggcagacgtggtttatggttgctgttgaaaccagtgcagggcccgattgctttgtattgagtgttgaggatcctggttttgtatcagccatgagtttgcagctctgggacacacttgatgttggctcaaggggaaatgaggttggaggggcagggtggttggattggatgtgggcctggggccattgctgatctacaaagtggtcatcacacgggaataatagagctggctacagaccacaaccagcaatattatttaaaagtaaggtcacacttttaataataagtcacattttaagttattatcaatttataaaacacactgttggtataatgatagcttttcaagaaggatataaaaaggcatgttgggctgggtgcagtgactcacgcctataatcccagcactttgagaggctgaggtcggcggatcacttcaagccaggagtttgagaccagcctggccaacatggtgaaaccctgtctctgctaaaaatacaaaaaaaaattagcttggcgtggcggcgcatgcttgtaatcccagctacgggggaggctgtggcagaagaatcacttaaaacctgggaggtggaggttgcagtgagctgagatcgcgccactacactccagcctgggcaacagagccagactccgtctcaaaaaaaaagaaaaaaaagaaaaaaagtaaaaaggcatgttgaaggtacctgcttgtggaaagttgcaacttgacgggaggtagggcgagcacttcttagaaaggtggaaatgggccctcctgctacagagacccacaaacatagactgaggcctgcagcctaggagactcaaaagaggcaaaggtgaataagagtcaaggtctccaagtcagggtctgactctgggggtgggggtcacatatgatggaggatgtcaggagggcttcctggaggtggtgacatttaccaggggggattttaggtggggtttgcgagacagtaggacctggctgaagagcgtaggctccttagacaggagtgggaattcaggcttgaaaatgagttggccagattgcaggggtcctcgaatgcaagggaagaatttcaactttaacagaggagcctgggaagctgtttgggaaaaggagtgataaagcgggaggggtcctccagcagagccctgcatgggcaggagggagcgagatgggaggtgggtgttggtaagggatgatcccagtggtccaggggagcagtcatagggtggaaactaaccttgtggggtctgggcaggaagggactgatttgagacaccgggaagaaacagccagtaggactttggtgagagggctgggggtcggggaggggggtgtggagagtgggagcttgagtctctgaaaacagacagtgttccaagggggagacctgaggcaagatgtggagaggcagctgagctgggaagctggaacggaggtgtggtcactccaggagactaagtcagggggcgaggggacccttgggagctatctagaccccagcactagggaatacggaggggagaaggaggggagaagaaccagctggtgcgtgtcaggcactgccctcgaggtcagatggggtggggctggatactggccatgaggattttttcaagagctgggttaatagtgagacgggcggacaccagatggctcgggctaagaagtaagtgggcggtgggaagctagaagccgtggtgtagacctactttgagaggttgggctgttcagacagggagaaagttcacagtttgaggaggtagataggtcaaaggaagagggtttgcttgtttttgagattggggcatcctgaacgttctcccaggccaagtgagaagaaaccagaagaggaacatgtcacccaaatgtgctgaaacagcccagcagctgcgctgcctcacagaaaatgtgcagaggcccctctgtcccaccatgcctgcctggggacggccttcactcgggctactcagggtttccccagcctgccaacccaagggtggcaggagctgtgggtgctcccagccccttctcaaggttggtctgtgggtagaaatgtgggctgcctcggggcgtcacagctacaaatgcataccagccctcagaaccacattcctgctccccagccctttcctccgcacccccatgcagaagcgcggccgccagctcacaaaggatagggagggatattgctcttggcatttgatgggaagcatctgctgcatcccattggggtgttgcccaggatggattggaaaagagttggcaggaaggctgagctctgtgctcacaacctggcttggtggtggccgaggagcttggcaggagcagagtgcaggacctgggaactgggggttggtgcatgtgtgcacgcacgtgtgtgtgtgtgtgcgtgcgtgctgggtgggtagggaggaagctgtgaaaccacatcccctcctctctgctgctgtgttgctgtgtgtttcagcagcacgtgggtgtcaccacacttcctagcaggtgtcaacctccaagactgttctgggctcttctcccagttggctgagttggaggtgggagtcccaactgtcccctgtggcttccagagtgggaccttgctgtgggataggctggccaatggtgctccctcccctgtgacccttctgttgggtgggtcacgaggaaggactgtgggtgttgcccacagacaggtggacatgtggcaaggacaccttgggaccttctttctgacgccccttgaagggggcactttctcagctttgagatgagtctctgtggatgtgggaagttcactatctcaagagcagcagccttggaaaatccaacacagaaccccgagtaggggcgggaaggggtcctgtcccgctcactggctgcctggcagagttctgcacaaggaagcgcctgtgttgctgtgggcggaggaatggactgagggctacattcgcttcctgttgccgctgtaactgcttatcacaaactcagtggcttaaagcaacagaggctccttcctttacagtgctaagggtcagaagccgatcagtctcaccggactaaagtcaaggtgttggcagaatccattcctgcctcttccagctttgggtgggaggctctgctggagttccttggcttgcggctgcatccctccagcctctgcctccatcctcctacagcctcctccttctctgcagtcagatctccctctgccttcctcttttttttttttgagacggagtcacccaggctggagtgcagtggcacaatcttggctcactgcagcctccgcctcctgggttcaagcgattctcctgcctcagcttcccgagtagctgggattacaggcatgtgctactacacctggctaatttttgtatttttagtagagacagggttttgccatgttggccaggctggtcttgaactcctgacctcaggtgatctgcctgcctcagcctcccaaagtgctgggattgcagccatgagccatcacacctggcctgcctccctcttaaaggacgcttgtgatttggggcccacctgggtaatctcttcatctcaacatcttcagttacatctacagagtccctgttgccacatgaggtaacacagtttgggaagggagagttattcagcctaccctaggggcctgtggtgtatctcagggcccttctgattttaagatataaagcaagaaaacaaactggctcaaggggaaaaaaggacacgttgaattctgttgctttaaatgtatatttttttattgtgctaaaatgcacagaacataaaatttgccattagtaacactgagtacattcacagtgtcgtgcaaccatcagcactgtctagcgccagaactttttcatcaccccaaagggaaaccccgtatccatgaaggactcactccccattcgccctctccagcccttggcagccaccagaatgctttctgtctccataaattcatttttaataagtgcaattctgtgtgactttaaaataaataaacatgagcacgatgagttgcttattggaaggatatccatgcggggaggccggcgtgtggagtgcgtaggcctccggacgggcaggagttgaaggggcgtggatgtgccgccctctcctccccttgctctttccttggggtcactgcctgagtatccctctttgcaaatggccccaaataatgtctcagcccccacgtctgcatcgcctcctagcttcaggaccctccaccaaaaaacattccaagcttcagactcactcctgggaaaattccaatggcctcactctcccttttgagccagccagatcccatggcctgtggcgggctgcctttgagtcctgagcacctgtgagctagggaagcaggacaggcacacccagggaaggggaagagtcgtcgtcagtcacagtaattgatatctttggaatcgtctaagagatacttagcgtgtgcctaaaacattcatttctttttttgtttgttttttgagacgaagtctcgctctgtcgcccaggctggagtgcagtggcgtgatctcagctcaccgcaacctcctcctcccgggttcaagcgattctcctgcctcaacctcctgagtggctgggactacaggcacacactaccacgcctggcgaatttttgtatttttagtagtgactgggtttcaccatgttggtcaggctggtcttgaactcctgacctcaggcaatgtgctcgccttggcctcccaaagtgctgggatgacaggtgtgagccaacacacctggccacattcatttcttaggagaagctctgcattttctgaaagtgaaatgtccccaggcgggtgacactgatggtgggatctgtggcctcaccagtgtcttatgagagatgccgctgtgtgtttcaccaagctgtatcctattgtcctctaaatgtggcttgtagacatggtgccgagaatgatctgggaggttcaaatcataatatggtccaaatcaacagctctctgatgacctggtattatcctaggatcaaattgagactatccgaggatgggcgtggtggctcacgcgtgtaatctcagcacttcaggaggctgaggcgggcggatcaattgaggtctgtagtttgagaccagcctggccaacatggtgaaaccccatctctactaaaaatacaaaaagtagccgccggacatggtggtgtacgcctgtagtcccagctacttgggaggctgaggcgggagaattgcttgaactcaggagacggaggttgcagtgagccaagatcacgccattgcgctccagcctgggtgacagagcaagactctgttccccggcaaccaaaaaaaaaaaaaaaaattgagactctccgagctgcactgtccagcatgatagccactggctgcacggggccatttgaacacctgaaatgtggtgattccaagtggagaggtgccgtgtgtgtgaagtgcactctgggtttcagagtcctagcaagggggaaagaaaagaatatcaaatatctgtcatttttacattgattacatgttgaattgataatattttgggctctgttaagtgaatgatattaaaattaatatcacctgttcttacattttttaatgatttcctttttcttttcttttctttttttttttaaatatggggtctcacactgttgcccaggctggagtgcagtggcacgatctcggctcactgcaacctttgcctcccaggtttgagcgattctcctgcctcagcctcccaagtagctgggattacaggtggctgctaccatgcctggctaatttttgtatttttagtagagacagggttttgccatgttggccaggctggttttgaactcctgacctcaggtgatctgcccacctcagcctcccaaagtgctggtatgacaggcgtgagccactgtgcctggcttgttcttacattttttattgtaggtgctggaaaatgtaaggttgcgtctgtggcccatgtgccgtttctgctggagggttggaccgagggccagccgagaaggctctggggctgctctacctgaatgctgagtgtgtgctgagcggtagagaactttgagaagtgctgaaggacagaggctttgtgtgggggatgcagccccaggccggagatgccttctctgtgctctggagaccctcatttggtgacagcaagaggaaccactgcaagaggggcggccacctcagcaaagcacccaggatgctggcctcccagctcaggaatccagaggcagaggaggggaggaggctgggcttggaggagagcagggtcttgggccctgggaaaagcctggggggccagaaagctgggggacagattgaggccagaggcaaagagaagaaggttcggagaggagggccaaggaagaagggttctgcccacggggagggagaggcccacggggcaggggcgtggtgggagctgcatcctcgaggctttctgttgaccctgacacctggccagaaaggagttccttctggcatcctttgtcagcggtttctggagctgccctttaggggccagtgatgagggtgccctgggctgggctgcagacagtggaaaagacaggctcttctcactcccagtgctggggaaattagcttcttggaggaagggggagctgtattttctgagtggccgcacttcctggcctagacgtgtgtgtcttgctgtaattttggcgactggtgttggtggtgcccattttatggatggggaaggtcaaattccacagatattgagtgacaggcccagggccttggatttcagtgtttgactcagaacccaggtctctgatctgccaccagcctccctcccattcagatgggaacagggactccgggcatgcagtcttctcccagacactcccccggctctggcctggcgcccggagaccagtagcagcagctccccacggccgttcactgtgagggtggggagggccgtgggaccaggaggccttagggggaaagttggccatgaggagtgggaagcgacgggtcagatgccagtgactgctggctggggagccgctggacgtggctggcctgtttggccagtgtggcgggtgccccggggcttcagtcacccccagccacgtgtgggggtgcgggatgggaaaggtaagagtgtgtggagcccagtcagcactcaacatgaggtcccgtgggggctgcctgagggcgtagcttccagaattcagcccctggccctcagaaggtgtcaccaaaggcttctttccatttgagtgaatccctcccagcccccagcaagccctcggaacgagcccactcccaggcgctctctcctagtgtgggagtggccacgcccctgctgggagtgactcacttgggttcagaggtcgtggcactgagatgggtctggcagatcccagcgtccaggcccagcccctatagtgtcagctccctcctctggggacccccttgcttgtgcccctctgggtcccagcacatcccaggcctgcagggagggggagaggaagagactgactcactggccaggtcccccaggggctggagaggctggagaggcaggagctggatcagatctgaatccagaggctctcggaggaagagctcagggtgagctgcgcccccatcccctgcccctcctctcctgctccttctcccttccatggtcccagccagcaagcacctggggtagaggggacaaacccaggtggctgtgttccagccctggctgcaggtctgaatggctttctggggtggctggccatgctccctgagagcccagctgtggcgatgtctgagcaggtaggtgggggagcacctaggaagcaggggtgtcaggcagagcacaaggagagagggtgtccaggtcagtttcaggacctggctgagaggagggggctcctcacgggcaccgcctctggcaagcacagggacaagggcaaggacggcatggccagaggtccctgggagcctcttcccctctcttcttcctagcagctccccctcactcttcccagggaccctgtcactttcctttagcgtgtggcagctccttggcgtccctcccgtgccttcaggttgcttctgcgccgggcctgccgctgggcgcccctatctctgcctgccccctcctcctgctcccctcgccctgcccccttggagcaattccccaccgagcctcccttcccaggcagtcgaggtccctccctacctctgccccgcgctctgggaggctccttgttccgcgaccacaaagcccctttgatcctctgctcggctctgagccatgtgacccggtgggcgggccgcggctctcggcgcgtccagcgcagcccgacgttccgctgctggggtgagtcctgctcctttgttcttcccagccttgcaccactggctcgggggctctcaggtggcgcggccgcgaggcggaccctgatggccatggtggcggtgccgggagccacgctgtccctgggccccggcccgaggccggcaggaccgagcggggtccccaggagaggggtggcggggagctcgatctccacgcggggaccagattttcggcctcaaaatagaagaatagggctttgtgtggtcacagctatctctttgtaaatatttggccaactaagctgagtggctaagttctcctgctgcccggagcttcttggaacatgtttccttttcgcaaggggtttccctggcttccaggagggccaggaagaaattcgaattggccaccgctttctctaaaatcactccgctcaagttatcacccctctgggctcccgaagaccggctggctggaggctggagatagtctcaatgctcgaaatgccgtaaccgaagctccccgcggcgccggcactgggatccagggagctgctgctacagcgcagctctggattcctggatgtgttggatatgtgcagggcgttcctgggaggagcggggagggagggtgctgctggcggggctggtctgcgtgtgctttgcttctctacaatggcatgctgcgtgtcggccatgcagaggcatgtcagtgagcaggggctgagggatctccctaacggacctgctttcagagggtcttttcatgctgggagaaccccagagactaaatcatgcagccaacggggtggtccccggcctcaaagcagggaggggcgaggagctttgtaggcaatgccatctgctcctgaaacgccgtcccagtgactctggggactgactcagcctccagcctgctgcacttcatccctggcccctctctctttgctttttcatgtgaaatctgctgtgttttggtcagaggtttggggaacagctctctgctcatctaagataagtttgtaattcctttcctggagaaaaatatgccacccggaagcaggttgagcagtggttttctggcaggtctgttcggggctgtggagacagcacctgctggatcaggatggagttggaatttggtttggatcccacatgagaaaacccgttggaagaggaggaagcagaaaaaggccccattccctaataatgctgtgggttttcctcctccattcattgccaccttgccttgaaacttaatggggccacgtgtgtttccatgaatgtcattctctttggccaactcccccggcagccccaggagctccttttcaggaaaaggaagaaggtgtttgcttagcatctagtatacgagtccttgttggaaaggtgggattcttgtttctccttgggtctcttttaggctgagatgtggtcaaggaaggcctgtggtgtggctcgccttttttaatgctcgtctctggagacctgagttgctgctgactcccagcttgccccttctgtcccctggccatttctgtgtcggggtggctgagacactattgcattggccactttgtgttcccactagcccccgcccctgtaggctgtcattgtgatggtgatggggccaattcagctgcggtggggaggacccactgtgtgcgcctggggggtggcgtggggcactctgggatgagaagatgcgacttctgccctgagagccctgctttaatggaaggcgggggcatagttgcaggcagaagccatcaagcactgtggtcagaccagcattccatgtcaaaaatggccttgttggccgggcgcagtggctcatgcctgtaatcccaacacttcaggaggccaaggcaggcagatcacctgaggtcaagagttcgagaccagcctggccaacatggtgaaaccctgtctctactaaaaatactggctaatccgggcatggtggcgcgtgcctgtaatggcagctactcgggaggctgagacaggagaatcacttgaacctgggaggtggaggttgcagtgagctgagattgtgctactgcactccagtctgggcaacaagagtgaaactctgtctcaaaaaaaaaaaaaaaaagccttatctgggcctgggatctgtcctccgaacactgggtccactgtgctccacaaggactttcaccccggaagccctagacccacttgggcaaccagagtctctgggttgaccactccccagccctggccagcctcctgggccaccgtattctcccaacttcctgttgtgccacggctggtccaagctgctcttatcagacaatgcgaggcacttccacaggaggggacaaccccgtccttaggagccccttctccctgcccccaggcctggtgcagtgtgtggcttccctgccggtgtcaaaggtctcaaggcccctttaagaagcctgtcaccaccaccagcagcttccgttatctggttcttctgtacatgtaagcctttcccatacaccccggatgtttagggcttccgccctctctccctggccgggagtgtgggaagagggctttatttcaatgcttgagagtagggtcaatggccagggtaagctgtgggggctcctccccgccggcccctctctgcagccctcaccttaacacagagcatcgataccacctgggctttgggaagacctggaggctgaccaccctggaggctcccagcgtcccacagccactctttggggaagaggcttcctgagggacttgtggcccttggctgggactctagtcccagagttctgccttccggcgccgagctttgatttgtttattgagtgccagcccggttcccggacaggtagggacctgttcccggagctcagcagagccttgggaagctttcccaggagggctcccgagggtggcggccatgcccagtccgctgtacgtgtgagtttgtttgatgaggaattggctgggaaggcgcgggtctaattacaggcccatgagggtccctctcgcccccacccaggaagcagcggagatcctggcacactcagcacctgggcctgtgcctgcccagctgctggtggaatcatgggagccttgctccggggcctgtagagcagcagtgggaaccttccccacctcagcccctcccagagttggctgttcaaactcgccgccgctcagcctcttcctcctctctttcatcaaccctgggaatcgcacactgcccaccccaccgggccccggagcgggtgcaggaagagagagcttaacacccagaggtctgggccttctgcaggcgcctgagctgctgtggcctgagctgggttccctgctggaaccatcacagtagacctaatgatctgcctgcaggagttgcttcatcccagccgactccggggctgcgggaaggggctgggccttggttttgctgggggtggggggtcagtgcaaagggcctgaaaagtggcagaggtgatggcccatctgtcctccccctggccggccggcctaaacgcgattggctctctttcttttttttttttccctcccttttccctataaataacactaaatgcgatttgtcaatgcattcatttgggttcagtagttggaccatgggcagaagcactccagatttgtcactttccctaagctaagggtggggaacaccctctgtgagatcttggctcctgagcgcccaagactgctcttggaaccccaactctgggtcggtctcaggggactgacgttgatggagttgctgacattgacctccggcctctgcatggccttcaggaagggggcccttcgctctctgtcccgtcgagcctggctggcagcactcccttctcaggcctgtgcccccggcagggcctgctgcccccgccctgctctgtgggtgccaggctccaagcaccaggtgactcggtcactgaatggtcactgaacagtcatccttgctggtgtccccagtggaatgtgcatggacgtcctccctcccccagatccttgtcttttatctctcagcctttgttccaggggccaccacaggaccaggaggtacgcagacgtgggtggcacatccactgggcagattcagccctgaacctgcacgccccctccaagggggcccccagcgggcggggttgatggtgccgtctctctctctgtcactagaacggacatgaggattgtgtcttgtcgatccacgtcctgagttcccagacgtcataggtgcttgctcaacgagtgtttgaatgaatggtcagcattgtgtgaccgcagattttcaacttttatccaaatagtttgtggtttctgtgaggctatcccgagacagtctcacaagaatctccattctccctgcacgctccgcacaaggtctccttggggggtttttcagaaaaagggccaaagagcagcatttcctcggggatttgaacacgatctcccccggggcaggggactgccctggaagattcccggcaccgcttcccatgcgccacgtgactaggagggtcttggggcaggatggtgtcttttgtgccttgtgtgctggggccggaggaaacactgcccgtggccggtgtcatctgccagccctgaagactaatgatgggctggacagtggccccattgagtgggagggagaatcgctgctgtctgtagctggggggccgggtgggtgggagccgaggccagggagaacagcgcagacctggcacggagaggcctggaggaggagcagggggtctcagccacccagggtgcagggacgccacacgaggagcaggtgtggtgtgcgtcctcctgcgggttctccacctcttggcttcgttacctgcactaggctttgtggtgagagggcacagagtggaggaaggtgccgtggctagggcaggccacacgctgtgctaatggattgctgttacctgtcgcctctgtggttttgctgtcaggatcctccagcaccaggtccccaccaccaggtatgggccccacaggcactactggctccccgaagccagggacagaccccatagacaatactgagtccctgcagccagggatgggcccccacggccagtaccagatctcagggaccagcaccgggtacccacagccagggacaggcctccatggccagtaccaggtctcagggaccagcaccgggtacccacagccagggacgggcccccatggccagtaccagatctcagggaccagcaccgggtacccacagccagggacgggtccccatggccagtaccaggtctcagggaccagcgctgggtccccacagccaaggacaagtccccacggccaataccagatcccagtgaccagcactagatgtccacagccagagatgggcccctatggccagtaccaggtctcagggaccagcgctgggaccctggatgactgaaggagggcacggttgactaaagctgcaggagccagcctggccatcctgaggcactaagccatcactgcggtctcaggggactcagactcctctacttgtcttcttgaattctggaatcagacacacctgggtccagcctttgcccccggggctgtgtgcctgggatggttgcctcacctccctgaagctcagtgagatggggacggctgcacagggcccggcacagatggcacccgatggcacagggtcacctgcttgcatccatacagcctcggccctcgctctggctgcgtaccgagagtcccatgcccagacctctgctgagtctccaagctcctggtcatgcctcaggcctcccgtgagaagcatcactgcatggaccatgcctcgggacctcaccttgggctgggaagcttgctccatctccccaagtctcccctagaggcgccccatgtcccatcactctcactgcttgaggggtcagataggggaacccagtgtgggaggcccagaggtgccggagcagacgttaagcgagttccgtgtttatgcgctgggccttggcagacaccctgaatgagcctcttccccaggaaggagattggggtcccagtccaagttgtggcctcaaaccctgtgaccaagagtggagaaaaggcaagacccctcctcccagtcttccagaacagccgatagtggtggaaacatggggttcacactgaatttccttgtaacttgttgaagagaatttagcccacattttcaggggtggaggtctggccgatttggcagtgtgcccgtccccctggccacagtttactctggaccgggcaccctggtgccctccctcagtgacgcagtgaagtcactatgacgtgtttagttggtgagaaagtgcctcctgtaatgttttactcttcttagagggtgaataagccttgtttattataaataattatttacagaatacatgaggtttaacctaactctgggccacggcagcgtcccctgggtaaacccacgcgccaccctagctagagcctgtgcccccacaggcttcctggactcaccctgaaggggggctggattttctgcctgtcccgatgagagggctgcaggacagtccccagcgagcccttctgagggctgtaacctcttcccctggtattttcctgctcgccaggaatgtttcaagcttccagcagaagcctacccaccatagtcgctttccaccctgctcaccatccctcctgccctcactcattcagcagaccccgtgcacagcccagtgcaggactcagggtgggaaggtgtcccgggtgggctggagcaaggttcccagccagggcggggtcccaaggtgggtccacagccaggactgtgatttgggaggcccctccctgccttgttccagccccggcaccgccgctgtccttgtgctcagtggagactcactggctccaggctctaaaacctcagcgaggtctgcagacagggaggagccccactcgagggtagagtgactgccgggtccatttgcctgttacgaaccacgtggcctcagacctgccattcctcctctcctagagctatggtcttttgtctgaaaaatggataatgatggttaccatgtcagggaccattttgaggacaaacggggatgaaactgaagaggctcagcacggaacctggacacagaagtgctaattgtgtgttaccagctgcggtggctgccaaggcccaaccacatggcagccacgggctgagtggcgggcgggaagtggggagcaggagcatgcaagatgggcattcctgaagtttctgatccagtgagataagtacacacccagctctaagatggagtgtcccaggaaggtggagactgcaaaggccttgtggcgcaggagtgtgagctgcacctctgggctctctagaatttcaccagagctcagggaggaggtcagctcagatataggggcaacgggagagatgggagtgagaaaatggcttggcgtctggaagtggagcctggaaaggtgggcgtggggacagaggagggccttgggggccatgggcccatgcgtccaggaggtggaggcagtgaacggggccacggtcggccccacacgtggcaccaccagccctgctgagcctgcacctgctcctcaggccccctgagtgccactaccacctggcaccccttggtctgattcctgcttcctgcccgcctgggaagagtgagaccacttgcctaaagtcccttagctgtccttaaccattctggctgcctcctggccctgtccagggttagccgttgacctgaactgcctggtgccacctccccagactcctggggccttgccctggcaccaacagccacctccatcttcatcattcactcgcacattcacccagcagtgctttttgggcatccactcagcaatatcaaggcgctgagatgcggctgtggttaagacccgggcccggtctgtgaggacctcgcagttgccatttccccagagcacagccccagccaggcacactgtggggtccagaaagagaaactaatacattgtgttcgtccattttgagttgctataaggaatagccgaggctggggggttatttgactcacggttctgcaggctgtacaagtggtgccagcatctgcttggcttctggggaggccccaggaagcttttcctcatggtagaaggtgaagggggagctggcacgtcacatggcgagagagagaactcccagactctttttttttttgaaatggagtctcgctgtgtcagccaggctggagtgcagtggcacaatcctcggctcactgcaacctcagcctcctgagtagctgggattacaggcgcatgccaccgcgcccggctaatttttttgtatttttactagagatggggtttcaccatgttggtcgggctggtcccaaactcctaaccttgtgatccacccaccttggcctcccaaagtgctgggattacaggtgtgagccacctcacccagccctcccagactctatagcaatcagatctcccggactttgtgaccgtggggagggcaccaaaccatccatgagggatccacccccatgacccaagccccaccccccccaggccttacctccaacatcagggatcacatttcagcatgagatttggaggggacaacgtccaaaccatatcacacgtgacctctctgtgcgtgcgtcagtttctacatctggttaagcagtagaagctccttctctgttccttgttgagagagcggtgggggagaaatgactcagggatgggaggctggtcccccgaggggccctggtgtttgtggagtgggagtgcgggaaggcccctacgttgtgtgtgccgtgctgggctggctcctcacagctcaccgtggtgctccccgaggactgctggggaggaaagagctaattaacttggggacccagctgctgaagttatcattaaacttgagcagtccaggggcccctctccttctgggtcctatgtcacccagcacagtggggcttaattgaattttttctcatcccccaaggctcctggctggcgtggctggggtttgggatacggggagcgagagggcttgggcctcttccagatttggagtgggttcaccagaaatggcccaggaaaccgcgggggccacccccagcagctgggggctcctgtggtcatttcctcttggtcctgttgagcagccctggcccctggagccctcagcaagggatgtgggggcctgccaggccagggtcctcactgctgccgctatgcacagctgcatcttgcatccggggagtggggtgccgagtggggtgtttgggaggcaggttttcccttgtcccttctgcccagagaccttggggatgagttgagtgagacccttccggcttctgactggctgtgtttctgttgccatcccccactccttttaagtggaggtttatgacttccttctttatttaaaagggtcatttagtgacttagcagatcccagtctgtgttacccagggcccttttaaaaatctgtggggaggctgggcttggtggctcacacctctaatcccagcactttgggaggctgaggcgggtggatcacctgaagtcaggagttcgagaccagcctggccaacatggagaaaccctacctctagtaaaaatacaaaaaattggctgggtgtggtggcacgtgcctgtaatcccagttactcgggaggctgaggcaggagaatcactcaaatccaggaggcggaggttgcagtgagccgagatcacaccactgcactccagcctggacgacagagtgagactctgtctcaaaaaaataaaaataaataaataaaaataaaaatccatggggggacctctgtgtccattggctggtgtgaggagagggtgaggagctgcagagaaggtaccaggctgaggaccgcccccacccttgggctacagaattgaaggaggggacacatgaaagatgttcctagactcgggctggaggctggggacatccgagggcaaggacgacgctgtccctgctcttgtttgcagaggagtgcacagggctcaccagcttcttgttgctgtttaagtgatagctttatggagatagaattcacatactgtgacgttgacctttttaaaatctacagttcaatggttttgctgtattcacaaagtgattgtattagggtcatccagagaaacagaaccaatagaaggtgtgtacgtgtgtttagataaagagatttattattatgaggagttggctcacctcattacagaggttggcaagtgccaagattggcagagtaaatcagcaggctggagacacgggagagcccatgttgcggctctggtgtccacctgaaggcccaagacccaggagagccaatggcgtcgttccagtcccgagacccaggaaaagcgcatgtgtcagtttgagtctgaagcaggaaaaatctgatgttccaggttgaaggcggttaagcgggaagaattctctctcactcaggccttgtgtcctcctattcagaccttcaggcctttgtcacaaaattacaaagacctgatcagaacaaaatctgagaaaaaaccctttccttctatcggttttggattcattggctgggaccctggaaattagactgacagagattaacaggaaacaagcataacaattcaagtaagttttacttgacaccgagccttcataaggaaatgaagacccagagaaaccgttagcctgagcggtttttgttttgttttgagacaaagtctcactctgtcgcacgtccaggctggagagcagtggcccgatcacggctcactgcagccttgacttcctgggctcaagctggggcccagctgccggccccgggagctgctctgaacccactcttaagtcccagctcagactcccaagtagctgggactacaggcatgtgccaccccgcctggctaattttttattttttgtagagacagggtcccactatgttgcccgggctggtctcaaactcctgggctcgagcaatcctcctgccttggcctcccaaagtgctggggttacaggtgtgagccactgtgcccggcctaggcctgaacagtttttatttgttttgcttgttttttaaatttgtttgttgcttgttttgagcagtttttttgtttatttcttttgcttgtcttttgcccaggctggagtgcagtggcatgatctctgctcactgcaacctctgtctcctgggttcaagccattctcatgcctcagcctcccaagtagctgcgactacaggcgtgtgccaccacacccggctgatttttgtatttttagtagggatggggttttaccatgttggccaggctgttcttcaactcctgacctcaagtgatctggccaccttggccttccaaagtgctgggattgtaggtgtgagctgctgtgcctagcctaggcctgagcgtttttatgctgggtttgatgaagagtggaaagtcgtgggaaactgtgacagagcaacaaaagatgagctgaacagtgagcccgtgggggtctcggcaagacctgtgtactggggcccctctcagatcctctgtctctggagatgaggctgttcctttccgctgggtgtagggagggcacctcttacgtgaggggcttatgatctacttcagagaaggggcaggtcagtgagttcttcttggacctgccatttcttaaattccttcagctgaaaatatttactatgccaaggcactgtatcttggagtgtgcgttccaagccctgttgccttcaactgatcgggtgaggcccacccccatcagagcacacagtctgctttacccaggctcctgattgcacccttttcctgtttgccccgagaatactcaccagcagtgcttgtggctgcagcgttcaccccaagataaatttgccgggaagtatcttgcttttattattattttcacatcactctagtatatcgactttggaaacaaaagacatcattctgtttatagcattccatttttagtagtggtatttcctttaaaaaaaaatggtaattctcagctgggtgtggtggctcatgcctgtaatcctagcacttgggaaagctgaggcaggctgatcacctgaggccaggagttggagaccagcctggccaacatggtgaaatcccatctctactaaaaatacaaaaattagccaggcgtggtggtaggcacctgtaatcccagctacttgggaggccgaggccggagaattgcttgaacccgggaggcagaggttgcagtgagccgagatcgcgccattgcattccagcctggacgacagagcaagattccatctcaaaaaataaataaataaataaaatttaaaaaaaaatagtaattctcgatcgctgaaaatgtcaaatcctagagaacacagcattcctacaagtgatgttaacattgttcttgatcagttgttggctgaagattcatttgatgaatctgatttttccagaatagacgactcagatgactctgttgttttgcttagaaataactgcaggaacaatttaaaaaattttttttctttttaatttttttgttttttgagacggactctctctgttgcccaggctggagtgcagtggcacgatctcggcttactgcaacctctgcctcctgggttcaagtgattctccagtcttagcctcctgagtttagctgggattacaaggtgcctgccaccacacgtggctaattttttgtatttttagtagagacggtgtttcaccaggttgaccaggctagtctcgaacccctgacctcaaataattggcccatgtcggcttcccaaagcgctgggattacaggcgtgagccaccacgcctggccagtttttatatttaattttcacacagagcatccagtcagatttgcttcagcctcaaagagcgtgtttatgtaaaattaagtgagtgctggcagtgagctgaactttctaaaaggtaaaagggttaaatattaaactcatccaaaaacaccttcacagacacactcagaataatgtttgaccggttacctaggtgccccatagcccagtccagttgacacagaaatttttttttttttttttgagacggagtctcgctctgtcgcccaggctggagtgcagtggcgcgatcttggctcactgcaagcttcgcctcccaggttcacgccattctcctgcctcagcctcccgagtagctgggactacaggtgcccaccaccacacccggctaatttttttttttgtatttttagtagagatggggtttcaccgtggtctcaatctcctgacctcgtgatccacccgcctcagcctcccaaagtgctgggattacaggcatgagccactgcgcccggctgacacaggaaattaaccatcacagttacacagccatcgccattaatcccagcacatttcatcatccccaaaagagaccctgcccccattagccaatccccattcccaactccgggctctcagcccctagccaccgctcatctgccttcgtctctatgaattcacctgttctagatagtttgtataagtggaatcgtacagtatgtggccttggtgtctggctcctttcacttggtagaatattttcaaggctcatccacattgtagcaggtgctggtgcttcattctttttcatggccgaataatattccatcgtggatagaccacactgtgtatctcttcatctgctgatggacatttgggttgtttctgctttttggcataattctgttgtgaagaattctgcagtgagtgctggtctacaggtttttgtgtgaacatgttttcatttctcttgggtaattgcaagatcatgtggtttagccaaccagcctttaagccatgtgtctgctgagggacccaggcctggtgggggtgcattgctgtgcttggccagccaggtgctgcgagtccgtgtcgcagccatttctctgtgctgtgctctgaggttgtctcgccggcaccgggcactgtgagccccaggaggccaaagccccctttgttttatcttgagtccaggcctcgctccatgaactaggatgaatggacattgaatcaacgcagggatgggtggggctggggtggggacgcagagtgaccccgggggcctgcagctgggtcctggctgctgacttccagtttcctttgcctgttggagcccagaacaagtcagaaaggggaaatgcaaagttcgagtgtcttttctgtggtagactggcaggcctgggtgggtgagccacttgcagctagttgcagcgtgagagaggaagtgggaggggagggagagggtgagtttggtgtaactcacccctggaaggaggctgggctgaggctgggggaagtgacttttatttttctgagaggattcttccctggggccaacttcaaaccaagggagacaagaccttcctgggggaggctggaagtgctggggcccccaggtgggcaggtctcccagggccaacgtcttggggaagctataagttaccatgtttctggactgtcacacacacacacacacacacacacacacacacacacacacacacacacacacgagtaaactgtaacacaaatgtgtgcccatgaaagtgcccactttaaaccaccacacagcctgtaaagcgaaggccctggcccgcatctgggcacccactgcccagccagccggtaggcagtttgcactgtagtctgttaccatccctcagagatgcagccgaggagcccagctggcttggagggcccagtgggcgcagcctcaggaaagtggtcaggcccgggccaggccccttccccctcccagccttgggagaaattaccatatgaatgtagctccttcccggagttcgggctggaagggcctgggaggggacaggctcccaccccaggagcttccaggttccggctgctgcctgtgttagctgcgtgagcgtgagcgagccaggggtcactactgggtggaaggaagaagcgggcatttcttccaggaggtcaccgttggagtcccacagtaggtcaaccccaggccctgggtcctcgggaggaggagaaagaagagaagcaggaggtgtggagggtaggccaggaccagaaggcacacagggtcggggcagtgtgggagaccctgggggctccctcatttaaccagctaacatcacagcgttcataagaacacgctattactgcagttttattactttgctctgatttcagaaggcacaactgatgactttagggaacggagaatctgaggaaggcctcgcaggagagggtcagatgcgatcgagtaaatgtgagccgtctgtaaactgtagagtgcacgcacagcaccggtcagccctggggtcagtgttcccctggtgctcagctcggcctctgcaccttttagtgctcggctgggctctgtgggggtcagggctgggtctggtacattagaggacttctaccaagcccctggcagtgtctcagttactaaatccagtttgccagttactaaatccgctctgccggttcccgaatcactcttccgctggggccggccatgtcacgtcaggcttttcatgcaggacggcagatggatagacgctgggaccaagtcatccttgggccgcgagacgtctgaccttctgctggtgtctcagaagatgctagctctccgtggcatgtcttccacgcggtgcttggggaccagtggcctctaaggggcccccctgcctcagcgtggggagtggcctggccaaggtctcagtgtctggttggagccaggcataggctcaggtgtactggctggaggcctcctgcccatgggctctgcctgtcctgtgtccctggtccttactgtgtcttctgtgttcctgggagagaccccaggggccctgagcccagcactggggttggggagtgggcggggaagagggtggggattagggtccctggctgcagaacagccaggccccaagtccccactccactcccctcccaccgggcgcctcatcccacactgaccatttcctgaagaaaatttcctgaaccggcctcccaccccggctgtcccaggaagcccatccatccttccgccttaatgctttgtggctccagaaggatggtggaagccggaaatcatgagtctcattcacaggcggccacacaccgaagccgcggagacgccgtgggaaaggactctggccagcgcggccggcacagagggagcggtgttaccggggtagacgggaaccgtggctgcccccatgctggtctgggagagacgaggggccggacgaaaggacagcagactggccattcattcatttattcattcactcattcacagcgtcttactgggtgcttcggacgtgtaaggttttgtgggtagtgaatgcgacagaccccagacagcaatcggagggccacgtgtgtaagaactgagggacctaggctgggcgtggtgtctcaagcctgtaatctcagcactttgggaggcagaggcgggcggattacgaggtcaggagatcgagaccatcctggctaacacggtgaaaccccgtttctactaaaaatataaaaaattagccgggcgtggtggcgggcgcctgtaatcccagctactcaggaggctgaggcaggagaatggcgtgaacccgggaggcagagcttgcagtgagcccagatagtgccactgcactccagcctgggcgacagagtgagactccatctcaaaaaaaacaaaacaaaacaaaacaaaacaaaaactgaggaacccagtgtagatgagctatcccgggaaaacaagtgggagttctaggaacagcatggggaagggatggtcccggcagggaggacctctgtgggtagccttgttggaagagctgaaaggcagccagagaggctgtgcgtggatggaagctgaagagtaggttaggggcgtgtgttttgttaacaaagacttcaagcatttactgaccaggcacaacactatgtgcttcataaataaatatctcatttgatccccagcattcttatgagacagatgttattatcccatttcacatgtaagaacattgaggcacagagtggttaagttacttgctcagggtcacacagcacgtcggtggtaggcaggattctggagccacaggaatctggtatatcccaggtgcaatggaaaccagtcacggcttcatagagggaaatcatcagattagtaaattttacacacgccccctggtgctttgaggaggagggattcggacaggggcagctaatggtggtggctgtgagatgtgttgggttaacattgatgagagtttgggatggatgagtggattcggagtaatggaaatggagggcccaggcccggcccctggagatctagctgcaatagctgttggctggagaggctgttcacttagatgggggatggggtgggaggcaggtgagatgagagctccagagttcagcctggggcacggtcattgggttcaagatgccttcagatgttggggcttgacagtgacagtggctgcagatacccaggacccagcagagggcctggcacagcggggcccagggacacgtctgtgagtcaggctggcactcaagtgtgaatctggacaaagaaggtggcattgttggcattgaatgctcaggggctgggtgaagtcagctagggagaggggctctcaaggcaccaggactgactccgtgggtgagggcggaggaggagacggcagaggctgagagaatagccagagacaggaggaaggtcagcagagccatgcacagaagcctggagaagatttgaggaaaggaagggctgggtggtcgtcattccctgcagctaggaggcaagggtgacccctgtgtgtttcattcttcagaggattggtggctccatctggtcagaaccccaagtccagagatgcatctgagcttcatgccatggtgcaggcagcaggagccatggagcaggcctgcggggtcacggcctgcctgctgcttcctggtgtctctaccctgagctcaggggttgcttggatgccctgtgctgcatccccccaggcggtgttccagagaggatgaaagtggctatctcaaggtgtgaccaggtagcggtccatgcacactgctttttcctggggagagtctgggatggaagggtatgtgtgtgtttctgagactccttgaataggctccatgtacctatccacccatcttaccacccacccacccatccactcactcacccatccacgcacccacccatccacccatccactcatccacctgtcaacccatctatccactcattcacccatccactcatccacctatctacagtcattcactcatccacccatccactcatttacccatctatccatccactcatccacctgcccatccactcacccacccatccactcatccacccatccacccatctatctatgcactcatccacccatccactcatccacctatccactcattcactcattcactcatccacccatccactcattcacccatctatccatccactcatccacccatccactcattcactcatctgtccatccactcatctacccatccactcattcacccatttatccatccactcaaccatccactcatccacccatccactcatcatccgtccactcacccatctatccacccatgtatccatccactcatccacccatccactcatctgtccatccacttatccacccatctactcacccacccatccactcacccatccatctacccatcctctcatctatccatccactcatctacccatccacttatccatccatccactcatccgtccatccactcatccacgcatccactcacccatccatctacccatccactcatccacccatccacttgtctactcatccactcacccacccatccactcatccacccattcactcatctactcatccactcatccatctatccactcatccaccaattcactcatccacctatctactcatccacccatccatccagtcattcatccatttgctcattcatccgccaacccatccattcacctgcctgttcatccacctacccatccattcatccatctgtccatccatccacccacccactcacccattcacacacccatacacccatccatttatccaaccatccatccccatccttacttcagaaagcatttgaagttgctggggtgtgcacttggaaaatgcgtcataagctttcataggcctctctttggcttcctcacttctttgattggtctttctttcggacatgcaggattctgagcagctcttctgggaggtgggtgcagtccaggtaggctgcctgcaaagctaggaccgagggagccacatccaaggcactgtgggttcccaaggcgatggcactgtgggcccactgcttccagacctcctcaactcccaggctcctgagcaggaggactcctggggcagggcctggagacgggaagagaaaacaattccagtctctcaactcttgtcagtccaggtgggtgctgcatggattgggggcacctggaacagttggccccttcacccctttcccccacctttccagcccctctggctataatcagacagttgtgtgcgatgtctttctccctcctgaaggggtcatttagtcaggctcctactcatggcccaggaatgtgcccctccctgcctgtcccctacccccaagcaggccgtgcctccagccccctgctgtctctgaagggcctgggcatggggcagcctctgcagcatccccagggcccgagctgatctgcacagcagaagggaattgggggaaagctttttttctacccagcacctggcagggggccaccctgttgcaccccagagacccttgtctaagttttgttatttcagatgatttcataagttgggggaggcggagccccagcccccacagcccctgttgttgcctcactgctgagctctgctgtgtatctgctgacaggtctgctgatagcagaaggggctggagagagggaagctctgggccctgccctccccaacccctgcttaggggacatccctgataagaggaaattccagcctgtgacagatggccagtgtccacccacccacgggggaacttttctttctctttgtaagtttgcagatttgccaggaactaaaggaatctctggttgacaggccactgtggacatggctggagggctggcacgggctggatcttggggttgctttgaggtaggggccgctcctgctggaaggttccttggggtggggaaggcatcagggccattccctgaccctccctctgcagtggatccacttcagagcctgagacaaggcaagggggcagcagaaaacagaatataaaatagccccccccaccacacaccgcaccagaagtcagaggattcatccttggcctgccctccctgcagcctaagttctgagagtggctctttaggaagtgaatggtgatggtttgcaggtcagagcttgctctggcccaagattgatgtctcaataggccgcggagcctgggtgaaaaaactcaggctagggaggtggtgggttgcaaatgaaagaacagaggagggcctcttccagaaagcggcgggtggtgtgaggagcccttggaccttgtccaaatttgactttaccgactggggccaattgaaaccgtgctggcagaaaggcaaaactgcttgagattccttcctccacaatagaggagaggtttgcttgaaagggtttggcgagggaaaagctggaggaaccttggccggcagtaaaagtggggacccccgccccctgcctcgggggcgcctcggcccctgaatgaatgaaagaggaggctggatggagacagactcacaccacctgtcccttccaggtcctgcaaaggagcacacagggttcttgttggctcttccaccttgttagtcaccaagaaggagaaaacaccaacaggggaactgtaaagctgcagttttgtttaagccccatagtggaaaccggaaagagctccagctcggagaaaaatgcagctctttgcctttgcaaatccgtgtctttctctgggaggccagagccattgtgctcgatttctaagcagggtttcagagtgtctcaggaggggaaggcagagtctcagatttccggcatcccaggtcctaaccaggctttgaggagacgcttcctgtcccatacaaagtgtgaagtgtaatttgatttggagttagttaacaaattagatgagctgtgtgcattttaaaaattcagtccttgatcccccacccacacacatttgcacaatttggtcatttatattcagtgtttccatctttagaagagaacaggaagtccccagtgacatttatggagtgtttgtagtagcttgggtaggtcagtaggaacacaatgcagtgaaaagcagagttgagatgggaaaatatcctgttttcagagccccccagggatgacattccttatcgtctctgtccacccgctctggagtccactccgcaaacagcaacttgttctcacttgagagcttcctcctgccggagctcagggatggagagcagctggcctcagtcttctcctcttacctctttgtttctcagactcatcttccaccttgaataattgtttttaacctgctctccctcttctctagctgtagaacccagaactttgtgtgtgtggtcaaaagtttagagagtgctgcaggtaatgctgagataaccctattaaattctgtaagttctcatcacaccaagtttgtttgttttttttaattctcattttattttatttcattttatagggatggggtctcgctacgttgcccaggctggtcttgaactcctgggctcaaacgatcctcccgcctcggcctcccagagtgccaagttatttttttaactgggatccacgggcctagggattctttgatgaaccgttcaaaatacgtgtgtgtctgtctgtctgtcttcaatgtatacttttctagggagagtctttacttttcaccagaggtttgtggcacacacatgtcctgtactactgtatcagattgtgaattccttacatgttaaagactgcttcaaatctgtccggaagtctcggctaataaacatttaaataaatgaacttcaaattcccatgtgccaccactgttttcattctgactactctcaagcctgtagtgtcatctttttgttactgtgaagtagacactcaataaatacttgtcaaatgaatcaatgttatggtcctggtccactaggaccccaggatcatcgtctaccattattgtctatagtttctttaccatcttgttccagagcagttctttctctgaggtctgctcacctctgcacgtgtgtctagtttccagccctgtcgccttaccattctctttcctttacctgcatttcctgaactgttaatagttaacaatagcttctccctccacccactcactcatacctgaagtgagaagtcatcattgaggtctctgtggattttgtcagcccaacctggggcggcctcctggaggtggagttttcagatgagggatggacattttggtgtctgctgggtagatctacctgggagctttggcaggggccccagggcagctctgcctctttattttggctgtgggacccctggtgcactagggtttctcaagtaagcatctgtgtcctgggagagccataggcaggcctgagagggcccctggaatctgggacccccagcccggcccagtagctggtaccatcatctttcttgcaagggaagttatggaaactaagatgctaatgtgctttgataggcctggggtggctctaagccctgggaagagccctggcaactttccctggctggcgggtagaatcttctcctggcagttcagggctctgcctccagctccctgggggagagcaactgagggaggagctggaggccaaggcctcagtgctgagctgcctgcaccgcagctgcaccttctgggtcctggctgcaggaaccccatacttctccagcctttccatggttcccgaagacctggcctggggagggggtcagcagcctggggctcacctacctggcttcaaatcctggctctaccgcttactcgctttgcgaccctcataattgacaaaagccctctcggtctcggtttccttatctgtgaaatgggacaataacagtggctaccttataggattgtgtgatgatccatcagttataatagctcctgagcagcgtttagagtaacacctggggctcggtgcagtggcttatgtctataatcccagcactttgggaggccaaggtgggaggatcgcttgaggccaggagtttgaaaccagcctgaccaacattagtgagacccactctctaaaaaaaaaaattagagtaacgcctggcacagagagcccccagtaaacctcggctgctgtgatgagctttgtttcttcatttgttcattcattcaccagactttttgccggggcttgccgtgagccctacgctgctctgaagaaagccgggctggggtgagcgtgatggatgaggtgtctggcttcacaaaccctgtgtgggggggttgtggtgagaggaaaccgcacacatcattattcagttaccatcgtggggagactgtctggacgcagagagcaggctctgtgtgggagcggggagggcaagccctggttgcgaggcagggcttccccaggattcagcagggatctgaaggactttgcaggcacccagggagataggagaggaggagggagcagccctggccggacactgtcctcctagcattgcctgcatcagggactcactcagctttaagaagcccctttgtgggggacagggagcatctgttagtttataggacctgaagtgcccccatgggctcaagtttctgggaaggcctgcaggtggccgtagggctgccgcaggggtgctggccccagggtctggattcaggggagcctgcagagggagggcagctggaggctgctccagtgtgcattgttacgaggcaaagtaaggagactgctgggcccacgctgggccggggtggatggaggcaaggaagtcttcgccggggcaagggcaccagctgtagatgccggcagctttctcctggacacgggcctggaaggctgacagggtgtggtgagtgccaccggctcccctgccgtggcctggtcagtggcttcacaggcctccgtgggcaggaggaggatgaccttgcattctgcttggccaccattggcagtgacagacaaggtgtgtggggatgtggccatttcggtccgtgctctgagagccaggtgtgggttgggtttggggaagacaggggaatggcattgacttgaccctgagcactttgtcctggggtgcaggcccggctgtcactcccctggagctgggaatggcattgggcggtggctcagggtcccttgccccagcggcaccatctctgcatttggccagcaaggctgatgggacttgtgtggacatttctgggacgtagaccaggcagcatgacacacagggaggggtaggcagagaagggcggcccctgggtcttggtttccaagtcaggctttgcaagcctgctgtgtcaagccctctctcggcaccaggccaggtgggccagggtcagccctggggctgtgatgagtgtgagtgcccctaaagtgtgtcatgtccaatagctgcctcctctctgggcactgcctcccagccagatatcctacagcccccgtcccagccacagacagcaatctgattccctcatcctcggcaggtcctggggttggggtaagaatttgtcactaagtgcagatgttcccagagggtgctggctcagggctgcgtggattacagccctttcatccctgccttagacccacctgcaactctggagaaaagatggcccagtggacgcctgcggggaggagggagctggtccccaggatgagcagatttgggggcagtccccatcacgggaccggtgacctactgccaccagcgccagtgaatggcagaggggccctggcataaggcctgggttcagaatgggaacctgcagagaaactgtcaaggtctcccgccacctgacacctccgcctggctgccaccctagaaacacccttgctgcaagaagatgggggagtttgtctggggcatggtctggcgacaccaacttgagaacctcaggcctaagtgttggcctctgggcctcagctgtcctctgagctgtaaagctggctcctgggcacttgtggaaaacactggactctttattttattttactttacattctgggatacatgtgcagaacgtgcaggtttgttacataggaatacaagtgccatagtggtttgctgcacccattggactcttcaatccagctccactagaaatgactgccttctttcccttcttccgtccctccctcctcccctcccttttttccttccttccctgtttccttccccctccctccttcccttctttcccttcctctcccgtcctcatggggatataatttccatattacaccatccgccgattcagaaagcacagttgagtggcattttttcacaaccttctataagcatcacctctaattccagaacgttttcctcaccccaaaaggaaacgccatcctcggtacacagtcactccccctcccccagcccctggaaatcaccaatctgcgctttgtccctacagatgtacttattctgaacatatgactagaaccctaaaagatgtgactttttgtgcttggtttcttgcagttggaatgttttcagagttcatctgtgttggcgcacgctcgtgcctttttatggctgagaaatagtccgctgtgttgactcagcacgttgggtttctccacgcatctgttggcggatgtgttagttatttctggagccgggtgtgttgtgctactcacgggctgcactaggagctggggatatcactgagtaagccacagcctcgggcacccaggagctcgcagagcaggagctgggagggaggtcaggaggtgcatggcctgtttgccaggctggagagacttgcaaaaagtcactttgagccagaaaccagagcctgaggcctctgactcccagctgcggagccgggagggaagctctgcattttgctttgactgtggggtgacgtgtcagttactgtccaaatcagaacctttctgagagtcgacgtgggtactgctgataattagtctggatacccgaaagaatggaaagcagggacccagacagatccttgcacaaccgtgttcgtagcagggcgaggcctggaggtgcgatggggatctcaacggggcagctgccgtcttgctggagcccacggtctttggggggggtcacaggtgttaaccgcatatcatacaagcaggagtgtgaaatttcagggttgccaaattcagtgagggtcttgtgctggcctggccacttacagtggcatttcaggaaaaaaaatcactctatggacctcagtttccccattagtaaagagtaggttggactggaattctgtaccatccagtatagttgccatttatgaaatgtggctatttaaatttaaataaaaatagaaattccgttcctcagttggactagctcagtgtcaagtgctcagaagtcacttgtgaacacactgtggcaattcctcaaaaaacgaaaactagaaccaccgtagcatcccataattccacttctgggtgtggattcaaaagaatgcacagcatcttaaagagctagagatatttgtacacccacattcatagcggctctgttcacagtagccagcgggtagaaacaacccgaatgcccgcggtcaaatgaatggagaaatcaaaggcgggacaggccgggcgtggtggctcacgcctgtaatctcagcactttgggaggccgaggcgggtggatcatctgaggtcacaagttcaagaccagcctgaccagcatggagaaaccccgtctctactaaaacaaaattagccgggcatggtggcgggtgcctgtaatcccagctacttgagaggctgaggcaggagaattgcttgaacctggggaggcagaggtttcggtgagccgagatcgcgccattgcactccagcctgggcaacaagagcaaaactctgtctaaaaaaaaaaaaaaaaagggtggaacatacaaggaatttgactcagccgtaaagaggaagttaggatacctgcaacagcaagggtgaacctttcgggtattacgctaagtgaaataatttggtcacaaaaggacaatcctgtaggattccacttataccaggtccgtagagtagtcagattcagaaaaacagcagaatggaggttgccagaggcttgggggatggggctggggagttgtttaatgaggacagtttgttttacaagatgaaaaagttctggagatttgttacacaacaatgcgaatgtacttaacaccactggactgcacacttcaaaatagtgaccgtggcaaacgttatgacaattaaaaggaaaagtcacgtggccagtggctaccacgctgagcagcgcaggcctcggacggtgtcgtggtcacagacaatggagtgggtgatctttaccattgtttccagctgtctgagcaccatggtgtcctggggccaggatgaaagtgtctctgggtatgggggtctctgcttttcccacttgggagtcctgaaggcagaccccaaagctcacctggccaggtaggagagcgaggcgggctcttgcattgctctctgcgtgcgtgcctgcctgcgggccagccggggcctgcaaggccgcctctcgagggaggggttgcaggaatggctctcacctgtgcagaaggcaagccactgccctacgtcaatggcaaagatggggctcggctgcgttgtattattatttctcaagcggggcccctggtgggcaggatgtttggtttgatttgagtttctgcagtgagtgctggtgcctgtggagggacccagctgcagctgagccggcccctccctcgctctgggctccaggggcgttgggggcgagaaaggagagttcagggggcagcgcctccccccaggtcctgctggggagggttgagggatgctggggggaggtgggggcgggtaggggctggtcccagtcccaggcaaaatggctctcagacccacaggcagatggaagcgattttcggtcacgtgggtggggactgaactgctgccccgcaaggcaaggccccatgtctggcttcaggaagcggccccaaagccacatggtccatggccagatgcagggctgtgtctttgtttatttaaaggtcctggaagcccaggggagagtatttctgaagggggagcaggagcaggagcaaagccctgaaggcttccaggctgcgtggcctgggtgggggccacgtgggggcacagagagaggagccctggcctccaggtccgcctgtgggtattgctctcagcagtggagatgtgtggacccccccttggcatttcccaacaaggaattatattgttcctttgttcccccaattccataagataggaattcctgtgccctgtggaggctgagaagacggggaggtgcctgtgaggataaaccagcccccagtttctggcttccagagtcttttcctctctcacctctgatgcctcaggcctggggagcctccctccgacaccctctgaccgctccagtgaaataggccgagagggatggcttgaatcggctggggatgcaggctgcagccagggggctcagtgggcatttcctgagttcggttcttgccccgcaagtggaagggcagttgaactgaagtctcccactgcccctcctggcctggaagcctgcctcccaccttctgggcagagtgaggagtgggcgtgggccgggagggctgcctcctgtctgggagggctgctcacttgcctgtcacgggggatgagccccctgcagcctcccgtgctgtggccctggctcccacgccggctccactcccctgtggctgcccctgctgggtgcccaccggtcccagggaaaagccactcccctcccggaggactggcgggaggggccctgcctgggagcgtgccgtgtggtccctgtcttagcgcaggatgcctgaggccagatcctccctgggaggcaggatggggcaaaagtctccccgcaggcagagcagggcctggatgggcccaagcagggacgggggcacagaacagcagccgcccagcctgcgtgggagctgagggccaccaagggcagctccagcctgtggggactagcagaggcaccacctctgtgaccagcgagttgtctgcacctgcatgcgcatgcaccagtgagtgtggcgagtctgaggtgtgctgggacctggcccgtgtaccagccagccctgatgggaaccagccccatcctgggtacccctggaaccccactgtgtgggagcacctgggtcctcagcaggcgtcttccgggcgtccgcccccagccccaggcctctgacccgtgtgtggtgtcttaacagcagccaggagcagggccatcgaagggacctacagacagaagaggctttagtgatttcgggaagttcagctccacgtgccccacatacccaagagtaaaacttggtcttggcctgtgggtgtgcagcccgtgggcgctggccaggcacacaagacggccgcctgggtcagtccagggggaggcagatgtggtgcaggggcccccctcctccatgagcccaggaacagctctgcatccaggcacccgccctgcacccagcacttttccttctcccaggactgctggctcgttctatgggattgaacacacaactccatggggaccgacgctggttctatccccctttcttacaagaccatccatggggatgtgggaggcggggacacacgctggttctatccccgtttcttacaagaccatccctcctgtgtcttggctcgtggatcggcttctaaggcctttgagtggcagcaggcggtacagcttatctgagtagaggtgaaggagagggccaggtccacctgggtggcccgaggcagtgtggagggccaggagaggagagcaccctccacccttgtctgagcagccctccagggtacggagacaggagttcagggtcagccctgccttggagcgcagggggcccccagcttggcacagctcctagaagaggagatgaaaaagcctggccttgggagtctggggatggagctttgctggggaggcagcgtggctgcaggatggcagctttttagaggacaccacggccagggacatccacccgggggaattctcaggggtcgcctgggcaagtcgcttagcctttctgagcctcagtgcctcagtttccccatccaaggatgggtgtgacaaccacctggcaggcgcctgtgtgtgagcccctgttccgctctaactcctctgctgttccttccccagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcggtgagtcctcaccttgcatgccactcaaccaatgccggaaaccagcctcagcccccagggcggcccacaagcctttgggcttggtcttcccttctgtaaaatggggcagcaaccctgacctcaaggacggattgccagtgacattgcgtgtgcatgcatgcgcctgggaggagcccacagcctccagcggctcctcagaggggcctgtcctgcacatccagggcccctgagatgactttggggagcccaggccggcctggagcaggtcctgatgagtggtcgctgcctctgagcaatgacgtcagcttgtgcagagggttctgtggcagctgtcccctcactgttgctccagcctggccctccaggctccccaccgcaccccaccgcaccccggccagaggcttcccagcagctcagcttcagctctgccctggaattggggcctcgtggcttccacaccccctggtggccccggagagctggaggtcaccacgggaggtcgtcgatcagcacgacctgggcagggtgagggggccaggctggagtctacagtgggccgcctgttgtttccaaagccccccaggtcccattcaaacctcacagggaccctgtgaagggggcgtcccgttttccaggcagaagcgaggctcagggaaggctgccaaggttccttagctcacagggcagagaaccgcagccaccgttttgactcccagaactgtgttctgcccactccacggggtccagggaggggtctggggaagtgcccccgccaggtcacaccctaaacaaaggtgagcttgcggggtttctgcaaggtgtctgggcacctctcaggccgggcctgtttctctgacctttgccagccgtgcacgtccttcctgcccagctctgtggacgcaaacccacacctgccagcccgacacctttctttcctcttctgcactgatctgggccctggctcccctggggtcttggtgtcctctctgcttcctgtagcctcatgggacccggctgctcatggccctgctgtgctcacagctgcctggaagctggcagcctgcttcaagggagggcggaggtgtggggtcccctcctacggcccccaccctgttctgcctgttgtgggggacgtgcttgtaccctgaggattcagggctgcctcccgggaagatggctggagagaaagagaggggagaggcccaaaggcagtggccaggctgggactcatctctgtgggctacggaggggctgccctgctccctagccagggacagggtgagaaggacctgggaacctctgcgtcccagccatggcacaggccttcttccggagctttggccccaaggagagggagaggcagcccagcagccctcgccttccgtggctgccactgtgacagccttgccctctgggaatggtgcgcaggaggccacttcacctgtctgggcctcttcgccctttcaaccctgagaagaacagtggtcctgattccccacaaaatcactccctcccagggatgccgagtgaggaacaagacgtggggcagctctgctctcctccctcctccctcccatggcagctgtgcccacctgcagaggtgcaggcaaggtggaggggcacctgtttggaggtccacagaccccggggagaatcccagctttgtcctaactcagcggggtgaggcttgtgtgtcttcccctgggctcctcctctgtgagccttagcttcctcgtccataaaatgggatcatcccataaagtgagatcaagcgagctaggccccgggcagggtccccaacaggttgtggttgttcgagaatttgcagcagtggtgatggtggttgtggtgatgaggatgatgggggtggtaatgacggtgatgatgatggggtgatggtgctagtggagatgatggggatgatggtgatggtggtggtgatagtggtgggatggtagtggtgatgtgggtgatggtgattgtgatggtggtggtggtggtgatggaggtgatggtgatagtgatcatgagggtgatggggatggtggtggtggtgatggtgacagtggtgggatggtagtgatgatgtgggtgatggtgatggtggtgatggtggtggtggtgattgtggtggtggtggtgatgatggtggtgatgatggtgattgtggtgatggtgatggtggtaattgtgatggtggtggtggtgatggtggtgatgatggtgattgtggtgatggtggttatgatggtggtaattgtgatggtggtggtgatggtggtgatggggatgatgatggtgattgtgatgggggtggtggtggtgattgtgatggtggtgatgtgggtggtggtggtgattgtgatggtggtgatgtgggtggtggtggtgattgtgatggtggtggtggtggttgtgatggtggtgatgtgggtggtggtggtgattgtgatggtggtgatgtgggtggtggtggtgattgtgatggtggtggcgatggtggttgtgatggtggtgatgtgggtggtggtgattgtgatggttgtgattgtgatggtggtggtggtgatggtgatgatggtggtgattgtgatggtggtgatgggagtgatgctggtgattgtggtggtgaagggggtgatggtggtgattgtgatggtggtgaagggggtgatggtggtgattgtgatggtggtgaagggggtgatggtggtgattgtggtggtggtaatggtgatggtggtaaaggggtgatggtggtgattgtggtgatgtgggtggtggtggtgatgtgggtggtggtggtgattgtgatgggggtgatgatggtaatgtgggtgatggtgattgtggtggtggtggtgatggtgatgattgtgatggtggtgaagggggtgatggtggtgattgtgatggtggtgattgtgatggtgatgtgggtgatggtggtgttgatgggggtgatgatgttagtagtggtggtgatagtgatggggatgatggtggtgttgatggtgatagtggtgggatggtagtggtgatgtggttgatgatggtgctggtgctgatgattgtgatgacagtggtggtggtgatgagggtgacggaagtggtgatgatggcgggagtgatgggatgatggtaatagcagtgatggtattgtgatgatggtgctgatggggatggtggtgatgataagggtgatgatgatggtgatgataataataaaagtaacaataataaagggatacaccttgcagtatcccagttggcatctcctagatctaaggtgtcgtggctggaacattgacataactcctgacctgaggttggccaggacacagacctggtggacagagagagatggacgaggagtgtccgtccttgggctactaaacagttcaggccagggattcccagcaccagcctctgtcctcccaggagcccacacttttcctagaaaggtgttatcaaagtcagaacatcagtgtaatttagggtgttttttgtgttgtgtttttttgagacagggtctcattgttgcccaggctggagtgcagtggcatggtcttgactcactgcagcctccacatcctgggttcaagtgattctcgtgcctcaggcatgtgccaccatacctggctaatttttgtgttttttggtagagacagggtttcaccatgttggccaagctggtctcgaactcctgacctcaagtaatccaccctcctcagcctcccaaagtgctgggattacaggcgtgagccatctcgcctggccgatttttgtttttttaaaagacagggtctctgtcactctggagtggcaatgatcctagctcactgcagcctcgcactcctgggcttgagcaattctcctacttcagcctcctgcgtagctgggactataggtgctcgccactacacctagccaatgtttacattttgatgtagagacagggtctctctgtgttgcccaggctggtcttgaactcctgggctcaagcaatcctcctgcctcagcctcccaaagtgctgggactacaggcatgagccaccacacctggcctagggtattttttttggtgtgttgctagcgtagcccaaggcagctctgtgcagggtaaagcaatggggctccgagtctggaggggtgtgtgtgtgtgtgtgtgtgtgtgtgtgtgtgtgcgcgcacgcgcgcgcgtgttatatgtgatttgtttgtgtgtgttgtgagagttgtgtgtgaggtatgtgtaagaggtatgtttgaggtgagttgtgtgtgtgttgtgagttgtgcatgtgaagtgtgtgtgttgtgaggtgtgtgtatgaggtgtatgtgagttgtgtgtgttgtgttgcatatgaatgctacttcctcatcctcgtttgtctcagtcacctgtggactggctgtctgcacacacggtcactgtccctcgagtggcaccaccctgcaggccagcgccccctagcacatggccccacagaccccatgggacatgcgtgagcctgcctgatgctcacaccagctccacgggggaaggactgtttatcccattttgcagatcaggaaactgagacacggtgaggtcaggtgacttgcccaggccctggccggtcagggaggagcagtttgaacacctgggctttggttgcaaccaccctggtgaactgcaggaatcccggccacctggtgcaccctgggcagccctgggctcctccgccagcccggcctctgtcctgtccaaaatctgagccaccaggagacctcctgtccagaaagcacaaggggcacaagagatgccgactctcccaggcccggctcacctctcaggagaggactgtggcctgggttgtgctggcatcagagcccggctgtgtgggtttacacagtcactggacacccggctcgagggtgaagtcctcgggggctgcttggcagggatattgccgggaggtagcccaggcactgctgaatctcagactggagagcctcgtgcctgggtgggaggggccccatgtgcagaccctgctggtctctccggagagacccctgaccggcctcccatcctctccccagggcagagcggcttgggtaaatccaccttaatcaacaccctcttcaaatccaaaatcagccggaagtcggtgcagcccacctcagaggagcgcatccccaagaccatcgagatcaagtccatcacgcacggtcagtggccgggagtgggctgggggtgcaggacgcccctgccttcctggagcacaggggttgggggtcaagaccatcacacacagtcagtggccaggggcgggctgggggtgcaggactcctctgccttcctggagcacagagtggggggtcaagaccatcacacacagtcagtggccgggagtgggctggggatgcaggacgcccctgccttcctggagcacaggggttgggggtcaagaccatcacacacggtcagtggctggggatgggctggggatgtgggatacccatgccttcctggagcactggtgcggtgtgagggtgcccgagtcaggcaatcccaggtccccaagacggggactcgctgtgcccaccatccccagcatgttgagcatgttggggctctggctgtgatgggtcagtgtcccggacccctgtgggccccgtcacactgagctccccacagacaactgagttttccaccaaaagtctgacaggcaaggggctcccaggggaaccgtcaccggcctgtgccggagttggctgaggaaggccattaatttcccggtgtctccttggttgtcatcgctgcctacctggggttgccccggggtcagtcaggtgtggggtgtctgtgagggtcttccgtctcccctctgactctgcgtccgtggctctgtgcagatattgaggagaaaggcgtccggatgaagctgacagtgattgacacaccagggttcggggaccacatcaacaacgagaactggtgaggcccctccagggggaggagcactagcgggggcttcagggctccctggaccccacccagagtcagccctagaggtttcccggcccgcgggggtgcagggcccacctcctgggacctgacatgctgccaaagccgcacgtctcaggggcctgaaaattctggaccaaagcagaattacctggggaatcttgctgtccccaactcatcacctgaggccagcccggggaggctggtttgggaggccgagggtaaggctgtggcatctccgctcagcaagccagacctcccagggcatgcatttcattggaaggtggggtgttgggctctgagtcctgggaatgcacgacctgcttggggagggcatctcatgtgcctgctgactcgtccccatcccccacgcagctggcagcccatcatgaagttcatcaatgaccagtacgagaaatacctgcaggaggaggtcaacatcaaccgcaagaagcgcatcccggacacccgcgtccactgctgcctctacttcatccccgccaccggccactcgtacgtccctgcagtgtcggcgtcctcatgccgggtgccctgggttccctctgtcccctgggactgcaagacggtgctgtctgccctgctgctgggtgcagaggggctgagtcaggggccatggccgccagctatgaagttgggggtgtgccatgtctgcacctccaaagcctcacactgacccctatgcaagtgtcctgcccagcccccatccttcagctgcgtcttggggagctgagggtcaggcaggccctgggctgttctggagcctggtggtctgtgtcctgccttctcaggccaggctctggcaggtggagtgggagcccccagccaagcacccgtagcggtgactgaccttctcatccgggccctgcctcatgggaccccttagagggtttggtgcgttcttagacgggaagcacagagatcagtgctggccccttccagggctggacggggctgctgttggtgttggtgagagccctttcctcccgccggctctgtccgcacctgacgtcgcccctagagatcagcaagggcgggaggctgcatgtaccctggcaggtggactcttcatggcctcacggaccctctgtcctcagctccctgtgcaccccctgccagacacctgtggctcaccctgagccagggctgggaggaggaggaccagaggccagcaggagtggctggtggaggcagccgtgggtggcttgtctgcatgggtgggtggagaaggtccttcgcacctgctgtcccagatgtacttccctgggcggaggaagcccaggggtttggggaaaccatactctgtgggcaccaggtgcaggaaggagcctggctggtgggcagcgggcctcacccagagtctgtgggaaaacccaagccggagttttcgagcccaccctctggcatcatcctctgtgggccagcaggagtcaggggcagggggccagcccgctgtccatgggcctctcctgaactgaacatctgccctcccaggcagaacggctcacctgcggtcctgtggcagctgttccagctgctccaagctttgcctcagctgaggctgatggcaggaggcagaagcctctcctgatgccagctgggcaagccgagggcgggcgggcggtctgtggcacttctgccactccccagcactgaccctttggctgggactccagctaggcatgttgcctggtcccgcccaaggcgtccagtcccatggggcaggggcgggccttggccatctctgcttaaacttctgcccggagcgggcttctccccagccatgtgtgtgaccgatttattctcactgtgggaaaagctcggctccagaactggggaagatggtgccccagttccagggccctgccagcccctgccacccacagctttccccacatcagaccccaggctcactggggccaagcaggcaaggggagcagcccgcctggtgcaggggagcagcccgcctggtgcaggggcaccgcacactggtgctagcttctatttctcttgcctctcccctcccagccaaagccccacagcaagacggctgctgagccaacgacagcccttctgtgtggacatgtaggggtgtggttgggaccccagaactcatggacgagggtgcttggagctggccctggcccgcctggcctgtgcagtggtgtcacctgtgtctgggacacacccgtgtccttcctctgccccacactcacagcgtggccgactcggcccggggccctgtccttgccagcagggacccccgtgagccccgagccagcacctgagagtgtcgacacctgcttgggggtgggtgcccccccactgccccgctcccccagatgagcctcacgcacatccctctgcttcagcctcaggcccctggacatcgagtttatgaaacgcctgagcaaggtggtcaacatcgtccctgtcatcgccaaggcggacacactcaccctggaggagagggtccacttcaaacagcgggtagggttccatctctacttgccccagcccttctgtgcaacctggagacgctgcaggcctggcaggggccaccccgtctaaaggagtcacactgtcagggagaccgaaccgctggtcactctccccagcgggtggctggcctggtggtccctggcccaggtggctgctgggggccgtccctgagatggcctctccagctcccccatatctcaaaagcagctttgtgggagtgccaattctccagcagagtctctgaggggggttttggagaagacctggaccaggcagatggtgaatctctcttccagggagtgaggccgagcaggggccgtgcgacatggcccaccttgttttatgccccccctttttttttttgagaaagggtctggctcagttgccaaggttgcaatgtagtggcacaatcatggctcactgcagcctccacctcccaggctcagtccccgagtagctggaattacagacgcacaccaccatgtctggctaatttttgtatttttagtagagacgaggttttgccatgttgcccaggctggtctctaacccttgggctcaagggatcctcctgcctcagcctcccaaagtgctggggttacaggcatgagccacctcacctcgccctgcctggtttttattagatggaagagaagctgggccaggtgtggtggctcacgcctgtaatcccagcactttgggaggccgaggcgggcagatcacttgaggtcaggagtttgaggccaacatgatgaaaccccatctctactaaaaatacaaaaatattagtcgggcatggtggcgggcgcctgtagtcccagctacttgggaggctgaggcaggagaatctcttgaacccgggaggcggaggcttcagtgagccgagattgagccactgcactccagcctgggtgacagagcgagactccatctcaaaaaaaaaaaaaaaaaaaaaagtttcaggagggatggtctctgccaccttcttctccgccaccgtctgaggcccctgctgtgggatagggaggggcatccaagcaagagggcagccctgggctcttcctcctgacagggcagcacatcagagccacatggggtgcctttcaaaatgaaaccgaggtgcctgggctgcggcaccacatctgcctcggtgggtgtgggtggggcctgtaacctactccgtcctggggccaggtgtcagggaccttcccagcatgtgcaggggaagacagtccacacaaagtgggtgtgtctgccggaggctacacacgggctgtggtctgtgcctgggcaggcgagcagccgctcactgggatgtttctgttgcacgtacccatgtcgggctgctggcagggagctgagaggttactgcaggcggggcccctgctggaactggggactgtgacgagggttttttaggaagggtttcaggaggggaggtctcggtaaccctgagtactttcttggggctgtgatgagcaggagaagagaggtgggaggtgctcaggacgatgaccttaagcccctggggagttgcagcgtcgctcaggacagcaggtgcacctgcagctgcccctcttccctccaggaggcacaggagttggaggtgattggtgtcacagccccccagagcctgcccttgaacccgagcctggggcagcacacagtgtggaggtcatgtggcaaacaccagtgggtgggtagagcttgccacagggatgggcccatctctctccctccttatcccagatcaccgcagacctgctgtccaacggcatcgacgtgtacccccagaaggaatttgatgaggactcggaggaccggctggtgaacgagaagttccgggtgagtggatccactaggatgttgttcccaggggacccccagttcctgctgaagggtgggttgggggtttggaggaccttaagccatgaaattatattcttggggccagagggcactgagcccaggtgtctgtacccagtgctgtcaggctgaggctctcgtttttgggggaccccaggctcagggcagctcctcccgggggcccaggggagggaattgccttcccgcacatgtgtaaccaataccgtctgcccgttccccaggagatgatcccatttgctgtggtgggcagtgaccacgagtaccaggtcaacggcaagaggatccttgggaggaagaccaagtggggtaccatcgaaggtactcgccgcaggcgccggggctccagacagatgggaagacagtctcttctgctgacccagagcctgtgggccacgcctgagccagggactcgtggaacctcatccactgccttgccccacccagagggaggggtctccttgtccccattcaacccttgggaaagtgagagggcaagtggcctgtgcagatgcctccaccccagacctccccccgggcagggaaagattcagggagacaggagctgggatgggggccgccaagttctggatcctggtgcaggctctttcataggcacctgtgtggccctggacaaatcgcccaacctctctgggcctagaaaaggggtgggctgtagctctgtgagccagatggaccctcggccccttaccctgctgaagttcctgggaccctcacaccttagtctcttgagtggctgttgtaaccaattagcacaaacgaggggacttaaaacaacacaaacgtattttcacagttccagaggccagaggtccgaaatcaggggctgtttccttctgaggccctgaggaccagcctcatccatgccttcctccttctggtggcgcctggcattcctagttgtattgtaaaggcatcacatgctctaatctctgccccattgtcacagggccttcttccctgtgtctctgtcccgtccctcctcttcctttttttttttttttttttttgtttgagacggagtctcgttctgtcacccaggctggagtgcagtgttgcaatctcagctcactgcaacctctgcctcctgggttcaagtaattctcctgcctcagcctcccgagtatctgggattacagtcacgtaccacccacctgacttaatttttgtatttttagtagagacaggatttcgccatgttggccaggctggtcttaaactcctgacctcaggtgatctgcccaccttgcttggcctcccaaagtgctgggattacaggaatgagccaccgagcctgccctctttccttcttgtctttggacaaggatgcctgtctttggacttagggcctaccctaagtggatgatcccatttggagatccttaatgaatctataaagaaagacgttttccaagtaaggtcacaatcatgggttccaaggcctggaccttgaccatgtctttgaatggatgggagcccctggggggccacagttcaacccactcctggcggtgacaccccgggagggatgggcccgaacgtttccttccccttcctctctctgtcccttcatttctcattagaatggaagaggggaaggtgcagagggaaatgcagcaggaaaagccactttgttctgggagagcacttggctgaaaggcccagtagagcaggaagcacaagtctcttaatcttccagggcctcagttttcatcatccacaaagtgggtgcagtgtgccaagattttagtgagttgagagactgtcccaaagaccacagagctttttgggaagctgttgctctaaaaaaatggtcataatgacaattaccaggaggcatcagacactcctgtgccactggctagacatgggttatctcgtttcatgtccgaagctccccgcacccaccctccttgcagagttgaagaggtgctgtgagcagaaaacctgccaagggacccagaacgggaggcggctctagaatctacagctccagccctgcaccagactccctcgagatgggagttcatgcctggaggagggtgtggagaggcacacgggcctttcccctgtctgcactcctcccctaccaccacccctgccgggcccaccctgcgggagctgcccagctgggtgcagcctgggtgttttccagtatccgcctgtggtgtcaggctggcttgcctccccttggcccctctgcctgcagttcctctcttcctctctgcccaaagagttcttgctgtttaggaaactttttatgaaaggcaggtttgggagagttagggatggatgggcctgggacgggccggcggctttgctatgggcgtgcctctgctgcaccctggtggccaaccttgagtaccgcaggtggccggtgacagaaactgtcaggaaatgcacaagagagaggtccccgcacctctctgacctgtgcgttgttgagcaccactggctccagctgaggaagagtctggaacctgtcaggacagttgtgaggtggtggggcccactttccagcagtcttatatgaggaccctggaaatgtgccttcagcactgctgggtttttatatcaggggccccatgagttcatagctgacctgacacccggactagtaagggctgtgccttgttcttgcctcccacttggtgaacagcatcttgaggtatctttcccatccttagaaaccaccccaagtattgtcaatagaaatgtggggtgtaattgatcacgccatgaactcatttaatcctcatgtccctgagaggcgggtgacgttattatccacattttatggatgaggaaactgagggaatgagagtaacttgcccgagccagggagtggcgatcacacactccaactccagcctgagagccccattcttcctgccggctctcgctgcccgtcagtgttagatgagagtgctgctggtcagtctgcaggaggttctagtgtggacaccgccctacacagggccgtggcaggagggcctaggcaaaggcaaccggcatagcactgagagcacttgagggctgggcaaggtggaggccccggccctgcctgctggcctaccaagtaaaaactagacatttttaacttggggaaaagccatgtggctctgcgatggggcagcctggagccaggtgtatgggttctgcatcccgctccagccttatgcactgtggagctgagacagacacagttcttgcgttctctatgcctcattttcttttcttttctttttctttttctttttttttttttttgagacgaagtttcactcttttgcccaggctggagtgccgtggcgtgatcttggctcaccacaacctccacctcctgggttccagtgattctcctgcctcagcctcctgagtagctgggattacaggcgcctggtaccaggcctggctaatttttgtatttttaacagagacgagatttcatcatgttggccaggctggtctcgaactcctgacctcgtgatccacccacctcagcctcccaaagtgctgggattgcagacgtgagccgtggtgcccagcgtctacgccccattttcgtaagataatggggataacaaaggaatcacaagagacacttgcaggtgtgtgaagacgaagttcatcacatgggagggcaccgggtgtctttatttgccttccctgcccggctccccacctccagtgatgccgttcactgccctccttgttaaaaggccttctgttatataacagttacacatgccaggcaccgcgtgttcatataggagttacgaagcacagcaataaaatgaccactctgagatggccaccagctcgagcccgagggcacttgtgggtgcccgtggtctcctgcccagtctccctgagaagtggccactgtcccgagcttgggcttgtatgtattgtgtgaagtgcacatgtccctgagcaatgtttagcattgctgattcttgagcttgtgaatggtcgtccacagtacgtagcccctgtgtgtgtccctgtgtgtgtgtgctctgagcgcacacaaggtggatggggccgtgggggtaacaccctgtgggccacaggttttctttaaaatcccagctccgattcctgcttcatcccattcccagcagcccagccccctgcctgtcttcaggcccctgctgggacgtcctgctctccctggtcaccccagtggtgcgggggcccactgccctggcttctccactgtggcttccttccatgctcctatttggcctggtcactgtgccatctcccattagccaggaactttctggagagcaggagctgagctgtccaggagcaggagctggtgctggtcactccagtatcccccagactgagggcagtgccaggtgtcctatactcagctgcagagcaggtggttcccctgccctcctgcccatggggctgccctcagactctgcttttggcaccagcatttctgggcagggggagagaggtggggtccgggcagagtttctccactgggacattaaagcccctcctgtctcctctcctagttgaaaacaccacacactgtgagtttgcctacctgcgggaccttctcatcaggtgagagacagggtgcttgggtggggctgacggcttcacccctaagagggccctacagcgggtgggggcagtgggtgtggggccgaagccctgggcagagtgggtgccccctgccacctgcctgccctgccctcgggaagatcttggaagcccatcttctgaaaaagaaaacccactgggaaatgaagcaggcagtgaagatccttttcaacccctgcgaagttggctggatgggaaggctgagctttgatccactgtggtctggcccgttagagctgcccggtggccactaagggcccagtgaggcctcatgtgcaggccctgccggcagcgtggggcgtctccagctccgatcccactggcctctgacccctacccctttcacctggctgaggcttctccttgtttcccttgagtccaggcaaggaggggaagccctgatggagagggtgctgggtgggtggtccctggagtgtgggccctggcctgggcaggttcttcctcagcaagcagctggcatggatgatgggaatgttatcaagaggaggggcctccaggttggcgggggcaggggtggggggattccgggagccgttctgccattgtggggatactgggctttccaacctccctccagattattcctcctgagctgcagaggaatgaaaatccgagcccaggacttttttttcctggggacaagggcaacccagccctttgccccaggccacctgcctgccacaggccatagtcctggaggccggtggtcacccactgcttccaccctgccagcaccctggacaccggcctggagcaacaatgctccagccctgtccctctgagtctatgcactgtccctgggccctggacccagggccatagggtggacccagagggagacacatgcactggaatatgtgtgttctgaccgagtctgggcttaccagggggactgacccttcccccaaaacgtgtaccagatctggtccaacatggtgggcctgggggaccccatggggagccaagcagtcgggatggggagtgggggtgggggcaggcgggcctgagtccgaggcaggccgagcagggcccctgccccgctgcccccaccccgctgcgcccacctcactgacccgcccgccccccacccccacaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccagaa

SEQ ID NO: 1829 - DNA, 181083 bp, Homo sapiens
ctgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcaggtacgcagacagccccctccccatcggccgccccccactgccctggactcggggctttatttatgcctgggggaataagcatgcaaagggcgcttttgctcatttttcacagaaatatttcttttctttttgacggttccaagctcgtgggatgaactccgtctcagaagctaagctctcctgagtctggcttttatttaaactcggctctcctctctcctggctacttccctttcattttccagtgtgccattcttgcatgtcatggccactgtcaatgctgaggctgttggcgccgaaaccttgggagggtgtgggggacctgcccccctggctcgggtctggggcggcggcgcttggacctggctggtggttggtttgtccactgtgtggtttgttttttgcttccagccaaagtctgtcttcaaggctgcctcggtctcctacctaaaatagcatttctgtgccttcctggcagttgattatagagggggaagctcccggcgctcagaggagcctggcgtgtgtgtgcacgtgtgtgtgcatgtgtgtgcgtgtgtccattcacgctggcagcccccttgccgcaggcacagacccatcagggcgtgaacaggcaaatgaagagaaagggggctcccctgcctttagttcaccccagctttccaggccctccctcccaggcccagcctccttggtcccttcactcacatgcggtgccgtggctgccatctcacgtggccagcgccgtcatcggtaattagcagtgatgacagtttctgccgctcatgccgccctctgagcccagcgctgggagacatggggtggctgagccaagctccaggctttgggtattctgaagtgacctacgggccatggagcgggaggtcgctaagagtgtcaacccctacgtgccttgggccctggtctgttggttgccactatgtgtgtgttggggggtccctgagaggcctgagagagggaggcccatctcggtggctcctctctaggacgtgtggtcccctccaccactgctcccagggccacatctttttttttttttttctttgagacggagtctggctctgttgcccaggctggagtgcagtggcgcgatctcagctcactgcaagctccgcctccctagttcatgccattctcctgcctcagcctcccaagcagctgggactataggcgcccgccatatttttttgtatttttagtagagatggggtttcaccgtgtcaaccaggatggtctcgatctcctgatctcgtgatccgcccgcctcagcctcccaaagtgctgggattacaggcgtgagccacggcgcccggcctcagggccacatcttgattgtcacgttgggactggtggagcgggtgtgtgttgtgccgctgagcacacccagtcgggcacagcaggcggacctcaggagggggccaggggagacggcagaaggcttgggtggcagtgaaactgcatcttatctgtttgagctcgggggctcaggcccgctgggacgggtgggtgtggagcccagcgtcctgctctccgcccagcaggagccgcagggcagggagcgctgagagggaccttcgtcaggcttgcacagtggagccgtcctcggagtgaccaccccaccaggcagcctgggcagaccacagtgggtcccctgcctcctgggccaccagccccaggaggacgtcactccacccgcctggctggcaggggcctcggggagcctcgggttcggccttcactttatagatgatctagccgaggcccagatgggtgaccagcaggggatctgagagctgagcagagaggcgtgggtttgggggtggtgctccctggggagctggaagtgatggcaccctcccaggctcacaaaacacgggcttttcatgaactgaacaaaacactctttgaaagcagccagtgctgtgccccagagaccactctgatccctgctgcccttggctgaggacagcacagccagggatgaagcggggacctcccctcgggctgtgccttgatgaaagatgctttctacaaaatcccattcggatgtgttttcatgtaagaaaacgtacatttttagaaactcagttgtaaactggctgccttccgaatgaacacgacagtcccggagctgtttcccttaatgaggttctcgtcctgggcaaactttagcgctggtctttaattgtcactgaactcccgcacagtccctggggaagtgacttccttcctgtccctgctgggtggccttgagcaagccacttggcagctctgggccgcagttccgtcatctgcaaggtgaggggtgggagcggcacggcccctaggcagcgcccccacctcctgcgggtttctgcgcgtgtcctgagttttgtgggcgcctcttccctcactgaggggctcttcttctctgcagggcatggctcacgccgcgttgtcaggctgcaagccactgcgagagctgctctgatccccaagcatgctctggcctgaggaggagccatggggaggacgctgtgcctgtgtgacagaggcctgcccggcagatgccggcccgctgacttccagacgtggctgtgggtgcctcatgccccactgggctggcgtgtgaggcgtgtccagctcaggctgccctacagctgcccaggaagggtttgtgggagggggtggtcctaccctggtgagtccacggtggtctgccagccccagggaaggcttaggagccccaagacctgccctcttgtccctccctcggcagtgtctggctccggtctggtttgtgaacgggggcctgggtactctcccgccctccctgggggctgtggccttcccctgggaaggtgctggagggtttgtcagcagggccggcatgagtcatggagtggtgactggccgctgaggcatggaaggccactccttccagccaagggtcggagctttttttttgttctggaacggctttgtggcttttacaaattaagcagttttatcttgttccaagagcttgtatttcagcagggagagagtctccaagaagggaactttccactggggagctctgttgggctgggaggctaggaacaggccacgagggagggctgcaggcaggggaagtggccgtctgtgcatggtcatgaatgcaggcccggggtcctggagggggcttggccacgctgtcgctggacgtctgtccccaccagggtccatctgatgcagtacggcacagggtaaagcccagctcctcttacggggttcctgggtcatcagtgggcggggaaccgaggcctcctggagggcggtgcctcagccctcacccctccctcctgtccctcgctgtgctgtccccgatggcctctgccatcccctgggagttcttacccctggacgctcggtgcctgtccggtctcaacctctccagctctgcttttccatctccgaggtgagaggcctggcctgacgcgctctgcacccgcttcctgcccagccccgtgggaactctggtccctgtagtggtttcctggggctgccatcaccaagtgccacaaactgggtggctcaaaacaccagacatttcttctctcgccgttctggaggccagaagtccgaaatcacggcatcagcaggcctggttctttccggaggctccgagggggagcctgcttctcgcctctggcagcttctggcggctcccgaaacccttggcgttccttggctcgtggccacaccactcgacctctgcctccgttgtcacggggcctccttctgtgccctaaatctccccctgtctgtctctcatacggacagtctttctcggatttagggcccactgggtaacccaaaatggtcccatctcaagatccttaacttcataacgtctgcaaagaccctttttccaaataggccatgttcataggctctggggtggatgtaaattttaggggccacctttcatccccctgttgtccccgtgtgtctggatgcacagcatggttccatgtcccagactccttgctggacccctctggccctttggggtggcctttggccttttccactcgtttctgtgctcctggtgaggtgtcggggtcgggcttagcccctgcaggaattctggggacagcatggagccggcaactccccaccaggcgtcttcctacctgcccagagctcatggttgtgaggggtctctccttgtggttttgatttgcaattccccagtggttagtgatgttgagcatcttttcgtgtttattgctcatttgcacatattcttgcagaaatgtctgtccaagtcctttacctgtgtttgatttggatgattgttgttgctgagtgttaggagatctgtagattaatatccagatactaatcccatatctgacctatgatttgctgccattccatggattgccttctccccacgttgttagtgccctttgatatgcaatttttttttttttttttgagatggagtctgactctgttgcccaggctggagtgcagtggcatgatcttggctcactgcaacctccgcctccctggttccagcgattttcctgcctcagcctcctgagtagttgggattacaggcacccgccaccacacccagctaatttttgtatttttagtagagacggggtttcactgtgttgactaagttggtctcgaactcctgacctcaagtaatccacccgtctcggcctcccaaagtgccggagttacaggcgtgagtcaccgcacccaggctgatatgcaaatattttaaacttctatgacgttccactttatctatttgttcttctgttgcctgtgcttttggcgccatatccaagaaatcattgccaaatgcaacgtcaggaagcttttcccctgtgttttcttctaagagttttgtggttttagctcttgagtttaggtctttgatgcaagttgagttgatttttgcatgtggtgtaagggctggtccagcctcatgctctgggctcttgattcacttctcttcttttctcacgcccagctggttccgctgggtggcggggaggagtggggaagtcccgggctgggcctgcactcgatcatcccctctcaggccagccagggagtctcagctcctgcccaggacctggctggacgtgctccctaccgggaaagcctgggccgtctttctaggctgatggcagggccagcccggggcgtcctgaggcctgccctgcggacatgccccttgttctaggtggtgtggctgcccggcctgcgtgtgagaccagctgtctgtgcttcaggccatggaggctgagtgtttccagcctgtccccttgctcggctctccctctggggaagcccctgcagcccattctctgcctccgcttctgccatctgtgcctttgtctgcttcctgtttggaggtggtcatccctggggccacccctcatgatctggacacaagtctccatcctgaagccaccacccaaacccctgtgcctcaaacccctcccacccaccacatgggtttccactgtgaccaactcagcagctgatgaagcttcccttggggctctcctagcaacggggagctggctttcccggaggcctggcctctccctaagtggaagtggggcgtgagggtgtcagcctttttctgctgcctggtgctctaggttggcttgtcacccctggaagcacttgccatccttatacagcaccccacacccacctccccgcctcctaccccttcttccaaggggtcatctctgcttccctccccacccaacctcacccatgtggtccgcccagcaacctttgacccccaacatgacaaaataaacctcccttgccggtcactcattcattcattcagcattgggtgctccctgtggacttggcgctggggtcccgtggaggacaaagccagacacagtccttgccctcatgggactgcacaagtgcaagaccacatcagtaaacgtgaaacacaggaagtgacaggtgtgacaaaggggaccagtggcaggacagaacctgcggttcgtaggaccaggtcaggagggctgcctcggggggacaccttcgggctgagcgcagaaggatgaggggagtaaaccaggctcaaacccagcaggcagaggcgatcgctgcaggcaaccggcaatgtgttcaaaggccctggggcgcggggggctgaggccggcagcacggcaggaagtaagactggggttgaaagagactgactgtcatgttgtgaaatatacacttggttttcatctccatttcctggcacacaactcctaaaatccttggaatctccaaagtgatgtctttttggatgctcatgattgacagaccagctggcagcttcaggatggttcccagggaagaccaggtagaatcacaaggttcagcaccaccccgcaacctccaggtaggggagaggggctgaaggttaagcagatcatcagcggccaatgattgaatcaatcatgccttcgtaatgaggcctccgtgaacactcagaaggatggggttccgggagcttctggatggatgagcatgtggaggctcctggagggtggagcgcctggggagcacatggaagctctgcgtccctcccccataccttgccctacacatctcttcccctgtatcctttgtaatatcctttataataaactagtaaattccatgagccccaggaacatgtgtaaaagaaaaaaaaaagaataaaccatagctgctgtagcaagttaatcctaccagcactggctctcatctgccgaccttacctctggcaatgcctccctctcctgggctcctgggacccctccggccccaccacccctcctgtagtggtctcgctggctgctgccctcaggttagtttatttttacccggcctgctcccaccaggggctgaggcctccttgctcactccagcttcctggcccgtctcttgctctgggcacccccccactccgaacggccagagcttctgaagccgctcgctgtgtgcccccgcctggccccatgcatcccgcacggtgctccccagggtctcccactggcaagggcattggcatagattctggggctgccttggttcaagcccaccctgacttggagcctgagggtccctgagggggtcctgaaggccagggcaggcaaggctggcatgctctgggcagtgggggctgggtatgggaggggatcgtgggtggggagattcctcttaaccagcggcccacgtttggagactgatttgggctccaggctacgccttgaaattgggacagagagtggcgcagatctcagcccggagactccctctgcctgtggacgccctcatacctccatccgtggagccaccctcctctttttttttctaaatggggaaactctgacttgaacactgaataaacaacacaccctcgaaatcagcgaagaggcactggctctgaaactttgccatgaaagcttgaaaatgctctttggaccgatttgctggaacagacgggtgtgatggggctgcggggtttcaggtggcaggaggcgtccccgtgcctagggcatcccgatgctcagagtttccccgtgcccagtgtgtccctgtatccagggcatccccatgcccagggtgtccccgtgcctagtgtgtccctgtatccagggcatccccatgcccagggtttccccgtgcccagggtgtccctgtatccagagcatccccatgcccagggtgtccccgtacccagggtgtccccgttcccagggcgtcctgtgcccagggtgtccccgtgcccagtgtgtccctgtatccagggcgtccccatgcccagggtgtccccatgcccaggcactgcctctccccactttcctaatctccctccaccaacaggtgtcagctgtgaaatgcctgctgtgtgtgtcctttggttgagttcatcttgtgctcttaagttcctgttagacacaggcaggctgctttagttcttctggcaaatgttttgttgttgttgtttgatacggggtctcactccgtcacccaggctggagtgcagtggcgccatctcgcctcactgcaacctccgcctcccaggttcaagcgattctcctgcctcagcctcccaaatagctgggatgacaggcgtccgccaccatgcctggttaatttttgtatttttagtagagatggggtttcaccatgttggtcaggctggtcccgatctcctgacctcaagtgatccacccagcttggcctcccaaagtgctgggattacaggcatgagccaccgtgcctggcccgtctggtgaatgtttattgaggcctactatgtgcagcccctctcttaggtgcttggcctgtaatgaggagcaacaaagacacagtcgctggtcgcttgttacttaacagttggaactgagaggcagtccacaaatgagcaaatccataggtggttttagatgaggactgtgaagaagctaagaacaggttgctgggggtgcatatctgtgtgtgtggcgaggggattaatggaagccctttctgagtggtgacactgagctgaagctgtaatgaccagaaggacccagccaggccaaaatccaagggaagagcaacctggcaaaggaaacagcaggtgtgaaggcccgaggctggagcctggggaaggtgggagtggctggagtgtgttttcagagacgggccatggtgacaccaatgcgacaggcagggccaggtcgtgccgggccttggaggccctggtgagggcttgattttattctcactatggtgggacctcagtgccctgtggctgctgagaatggccaggggcaggcagggaggcctgctagggaggaggctgctgcaggccctgcagctggagagggaggatcaggatctctttagagaggaagttggagagggaggatctctttgattgctggatggacccacctgcctggctgcccccgtcagcatccagcagaggccactggatgctgacaggtggccggccctgcccagccttgcactgccctgtgctgccctggtggctgccggctttaggaggagcgcttttggtgtctgagcccagtggtcctggctgtggtttggtacacttggccgtgggtgaggccaaggtggtttggatcctgggaaggttgggtacctggcagcctcaaggcaggagctggggtgttggaggaggaagcacgctcatccctcgttccttcctgtttcgtgggatgctgagtctctgggcagggacatggtgagccctggtgtgatgcacttaacacctgctggtgcccccatccccaagcaggaaccctggtgcctggtgcctgaggactgctgtccaccgtcccaccatccttcaggtttcttcccagcctctgactcggggcaaggttcagatatccagaacattcttggctggctcttggagctggggtgaggcagaacctccctcccatatttacagcaccagccaaggcttcggggtttggacaccatccctgggaggggtgagcaggacaagtgaggtctccagacttggggtggcttcggactggccaggcaggtgggtgggggctgcagtccatgcccccgctccaggcaacacagtcgagctgcagcccccgctccatccccagctggggctccctgtgctcaccttctgcttccttcctctccctcggaatggggggtggacactccaagactagcctcccagccactctccctgcctcctgcctcctctccttcgggacagacccctgtgatcgctgggtgttcctgatgctctgtcccctctgcgtcctgtgccgtgggtgagagagggcttcggggggacttccccctcttggagcacctgctgctccgggtgcctctgggggcgggcccccacctcacattgtggagctggtgtaggaaggaaggtgccgggagccagctccaattcacgtgctggctgtggccctcaaggtgtggatggcaggaggtggtgagacagggactcattgatcatgggactgacaccccctcatgttgatgtgggccctgagccataatctcaccagctcctgagttttggcgctgctcttggcgatggcgtggactcagccaggctctcgggcagcctttcctggattcttcctccgttctcccctgggcagtgtttctgttcacctggaaaggatgggtaggacttggagacaacagggattcaaagaagtcgggagtgggggcacctgtgcagctcaccctgcagaacagacaatttggttaaagcctaaagcctgctgtcaggagcctcgcttgcctctcagagagcacatggcttgaccatcacggggactgggggagaggcacaggcatgcctgtccggcagcagaagggaaccccgggcctgggcctctccattctgtggcgttgtctttcctcagagttgcactgtctccttcactgtccctgcctggccccagtgctcatgtggcttgtggccctcagtctgggcttggtctcccgcaattcaccctgcccagccccacacagcttgtccctccagctgggaatcggagctcacctggagtcccaggcagcagattcgatgcagtgatgcagggctgtcagccatgccagcaggccctgctgctcacagagggatgggtattgctgttgacaataattaaagaactacggcttcaggctgggtacagtggctcacacctgcaatcccagaactttgggaggccgaggcaggagaatcaattgaatccaggagttccagaccaggctgggcaacatagcaaggctttgtctttacaaaaaataaaaaataataataataataaaaactacagcttcagaatgattgacttcagcatgtttataaagtcaagggtcttcagtgtcctgggcctatgtcactgcgtcagagggagagaggaagaggctggggtgatgggcactggggcttatgctcctcctggaatgggtggtcttggactgtgcctgtgtgatatgtttgtcgagcgggggcggtgtccactgaggactggatgttgaggtgtgggtggggggaggttatgaagcactgggcatttcccgtgcaccagtgccccgagattgcagagaggggacccgcccagcctgggcagggaggcgggtggcagcgaggaaggggagaggaactcgggtgcagaaagcctttcctccagcaggtggcgccgcaagctctcgagagtccagctcctgcggggtttgcattttcactgaatttgtgggcagaggctgcctgggtgtagtttccgccaactgtgactgctcactgcgggcgaggggaagtggagtgcagagaatgcaccggagggcagatgaccagcccccgcacaggcacgggggtgcctccttccccgcacaggcacggggggcccgagcccttggggttcctgtcctaactgggcggggaaagggagggttggaagctgagttagggggaaagggggtggtctcctgccatctcttttattttatttttcctatttttggttgataggtttcaatcttttttacatttttccaactttttgccgtaaaacttttcaaacatagaaaagatgaaagagggctgagtgtggtggctcatgactgtaatcccagcactttgggaggttgaggtaggaggatcacttgagcccaggagttcaagaccagcccgggcaatatagtgagatcccatctctataaaggatacaaaaaattagtcaggcatggtggtgcaggcttggagtcccagctactcggaaggttgaggtgagaggattgcttgaacctgggaggttgaggctgcagtgagctgggattgtgccaatgcactccagcctgggcgacagaacaaaaccctgtctcaaaaacaaaacaaaacaaaaccacaaaaaagaaaccatgaaagattctaaagtaaacacccatgcacctaccacctagattccacagcaaccattttgctgtttgcttcaccacaaatccctctggccaccagcatccacgctggttttgatgcacttaaaataagctgcagaaatcagcacacaacatcctgtcaacacctcagtttgcatttcattaactagagtccggcatttgtctgtgattatttttgtttttctttgaagtaaaatgtatataccctgagatgcacaggtgtgaaacgttccgttctttgaattttaacaaaggtatccacgtgtatcccagcctgaccagaacatagaacatcactatcaccccagtaagttcctcatgcccctccaggtgcatcacagtccccaccttccccagggcaaccacaattgtgctttttttccaccacgaaataattttgccagtttgagtgtttcttagagctacccatgttgctgcaggtgccagcgatttgttctgttttattgctgagtaacgtccactgtgtgaacattctgtgggtttttagtcattctcttgttgaaagacccctggctgtttccatctggaggctcttatgagtaaacctgttacgctggttcttcttgtacaagtttttctgtgcatatgggcgttcatttattctgtagaaacacctagagtaggtatagggtaggtatacatttagttttataagaaactgccagatcttttcccaaagtggcccttccatttcacactcccaccagcaatggatacgagttctagttgctccacatcctggccaacatttggtgctgtcactctgtgaaatcttagtcattctggtgggcgtgtagtggtatcatctcattatggctttaatttgctttggcctgatgactaatgcggttgagcacattttcatgattggctcttcatatatttttcctttgtgaaatgtcttttcaaatctgttgctcattttaaaattgggttgcttgactttttcttctggatactgatcttttgtcagatacgtgttttacaaatattttattccagtctgtggcttgcctgttcattttctttcctttttcaagaacaaggtctcgctgtattgcccaagcaggtctgaaactcctgggctcaagctgtcctcctgcctctgcctccccaagagccggttttacaggcatgagccaccatgcccggcctgttcattttcttagtggtattttccaataagcaaaagtgtgtcactttaatttttatgaagtctaatttaacaaactcctttctttgtggttctctctctgtgttctttgtaagaaacctttgcctaccctgccaaattgcaaagatatttatgttttcctttagaaggcttagagttatatagcttttatgaattaacttttgcatatggtgtgaggtagagggtcagggttcattttgttgtcgttttatgtgtttattcagttgttccaaacttcatttttttttaaagcttttattttgtattttcttggtgacttatgaggtcgcacaattttccaagatccttgttggtcatttacgtattttcctttgtaaaattatctgtccacgtcttacttctttttaaaattatgttgtttcaagatcgagtgatttctgaagccttcattttataatgcttgaaagaatgaacaccttgttccccagctacaggcttctgctctttgtcctgcagctgcacagtggggtaagacttgggttttgttttgttgctgctttgttgtttcttcatttgactgtttccccatgggtctcatttaaaaaaaaaattggccgggcacagtggctcacgcctgtaatcccagcactttgggaggccgaggcgggcagatcacgaggtcaggagatcaagaccatcctggctaacacggtgaaaccccatctctactaaaaatacaaaaaattagccgggcgtggtggcgggcgcctgtagtcccagataatcgggaggccgaggcaggaaaatggtgtgaacctgggaggcggagcttgcagtgagccgagattgcaccactgcactccagcctaggtgacagagcaagactctgtctcaaaaaaaaaaaaaaaaaaaaatgttgtttcatatgttttttatatattctggatataagtcctttatcagatatatgtatcataagtttttttttccacattgctcctttccttttggttttcttaatgatgttatttaatgagcaagagtattttgttttcataaagtccaatttatcaactttttccagtttcgatttatgatttttgtgacctatggaggaaatctttgcctacactaaggtcaaaagaagttctcttattttctagaaattttatagttgtatattctatgattccttttattttttaattttttaaatttttacattttttaacctattatagccgtcaggatgttgtatgatccattttaaatcagtttttgtatttggtttgaggtcagggttaattcttgtttttctatactcatatccagttctagcaccgtttgttgaaaagacataccttactctattgaattacctgacacctttgctaaaaatcattgactgtatatgtggccctatattagtatatgtacgtatatacatgtaggccctgtgttgactgtatgtgtggtcctatattagtatatgtacgtatatacatattggccctatgttgactgtatatgtggtcctgtattagtatatacatatcagccctatattgactgtatatgtggtcctgtattagtatatgtacatatatacatgtaggccctatgttgactgtatatgtggtcctatattagtatatgtacatttatacatgtaggccctgtgttgactgtatatgtggtcctgtattagtatatgtacatatatacatataggccccgtgttgactgtatatgtggtcctgtattagtatatgtacatatatacatgtaggccccatgttgactgtatatgtggtcctgtattagtatatgtacatatatacatataggccccgtgttgactgtatatgtggtcctgtattagtatatgtacatatatacatgtaggccccatgttgactgtatatgtggtcttgtattagtatatgtacatatatacatgtaggccctatgttgactgtatatgtagtcctatattagtatatgtacatatatacatgtaggccctatgttgactgtatatgtagtcctatattagtatatgtacatatatacatgtaggccccatgttgactgtatatgtggtcctgtattagtatatgtacatatatacatgtaggccctatgttgactgtatatgtggtcctgtattagtatatgtacatatatacatgtaggccctatgttgactgtatatgtggtcctgtattagtatatgtacatatatacatgtaggccctatgttgactgtatatgtggtcctgtattagtatatgtacatatatacatgtaggccctatgttgactgtatatatatatgtggtcctgtattagtatatgtacatatatacatgtaggccccgtgttgactgtatatgtggtcctgtattagtatatgtacatatatacatgtaggtcctatgttgactgtatatgtggtcctatattagtatatgtactgtatacatgtaggtcctatgttgactgtatatgtggtcctatattagtatatgtactgtatacatgtaggccctgtgttgagacactattgtgttttcttgatattttgtccattcctttgctgatgccacatcttgattaatgtggctttacagtaagtcttaatataaagtctctcaaatatctaaaatattactttgaatattctaggtcctttgagtttccttataaatttaagaagtagcttgttgatgtctacaaaaatgcagtgtgaattttggttgagattgtgttgaatctgtagatcaattaaggaagaattggcattttaacaatattgagtcttttgtatagatggtatatctccgttttaaaggtccttttgtatttcttttatttctctactgaaaaaaaatctctacagaattacattgttttgtagttttcaagaaaaagatcttgcatgccatttgttaaatttattcctaagaattttacttttggcactattttaagctgaaatagattttaaatttcatttttaattatttgctgctagtatgtaaaaatacaatagatttttgtatgtaaatcttatatcctatgatcttttccaaagtcatttattactctggtaatggttttgtaggtcttttaggatttaaatacatagttttacttctttctgatcttgatgccttgtttttttttcttgctttattgcactggttagagctgccagttcagtattgaatagtagtgattagtggacatccttgcctgtgccaaacttataatgttaactttagatttgtcatatatgacctttgtcagattgaggaaattcccttctattcttaatttgctgaaattttttaacatgaatgggtatgattttagtaaatgctttttctgcatctatggaaatgatcattgttttgtcttttattcgtttaataggataaattacaatgattgatttttgccccccgttttttttttttttttttttaaagaaacagagtctcactcttgcccaggctgtagcacagtggtgccatcgtagctcactgcagcctgaactcctggacttaagcaatcctcccacctcagcctcctaagtagcagggactataggcacatgccaccatgccaagctaatttttaatttttaaaattttttgtacagatggggtctcattgtgttgctcaggctggtctgcaattcttgagcttaagcaatactcccacctctgcctcccaaagtgctgagattacaggtgtgagccactgtgcaggcctgattttttaatattgaaccaaccttgcatttctggaagaagtccaacttgcttatgagatatcatcctttttatatattgctaaatttgatttgcccagtttttaaggatttttgcgtgttgattcatgagggatattggtgtggtattttctttgtttgttagtttgtttcggtaatgtctttgtcagcctcattttggcttcataaaattagtttggaagtgttcccttctctttgttttctgtgttttcataaggttgatgttgtttcttccttaaatgtttgatagaatccaccaagaaaaccgtctggacctagaattttctactaggaaaggtgattgtttgtttttaatcacaaattcaatttaatgtatagaaagagttattcaggtttttttacttccccttgtcttacttttggtaagttgtactttgaaggaatttgtccctttcaggtaagttgttgaatttactcatttaaagttgttcgtaatacaagcatacctagggtttgcttccagacctcggcaataaagcaaatattgcaataaagcacgtcacacaaactttttggtttcccagtacatataaaagttatgtttaggccaggcatggtggctcatgcctgtaatcctagccctttgggaggccaaggtgggcggatcatttgaggttaggagtttgagaacagcctggccaacatggtgaaacctcatctctattagaaatacaaaaattagctgggtgtggtggcacatgcctgtagtcccagctgcttgggaggctgaggtgggagaattgctcgaacctgggaggtggaggttgcggtgagctgagatcacaccactgtactccagactgggtgacagggcgagactccatctcaaaaaaaaaagaaaaaagttatgtttacactatactatagtctattaaagtgtataagatcattatgtctttttgctaaaaaatgctaataatcatctgagccttcagcaagccataatctttttcttggtagaaggtctgcctcaatgttgatggctgctgaccaggtggtggttgctgaaagttgaaggtagctgtggcagcagtttctttgtttcttttttctttttctttttttttgagacagagtcttgctctattgcccaggctggagtgcagtggcacgatttcagctcactgcaacctctgcctcccgggttcaagcaattctcctgcctcagcctcccgagtagctgggactacaggtgcctgccaccacgcctggctaatttttgtatttttagtagagacagggtttcaccttgttggccaggctggtctcaaactcctgacctcaggtgatccacctgccttggcctcccaaagtgctgggattacaggcgtgagccactgcacctggccggcagtttcttaactgaagtttttgacatgggttgactctttctttcatgaaagatttttctgtggcacgcattatgtttgatagcatcttacccacaatagagcttccttcaaaattagagtcaattctttcaaccctggccacggattgatcaaataagttgatgtaatattctaaatcttttgttgtcatttcaacaatgttcacagcatcttcgcctggagtagatcccatctccaggaaccactttgtctgctcatccataagaagcaactcctcatctgttcaagtttgatcatgggattgcagcaatccagtcccatctccaggctccacttctaattctagttctctgctatttccaccacatctgcagtgacttcctctgctgaagtcttaaaccgctcatccatgagggttggaatcaacttcttccaaactcctgttaatgttgatatttcaacctcttcttgtgaatcacaagtgttcttaatggcatctagaatggggaatcctttccagaaggttttcaatttactttgcccagatccattagaggaatcactaactatggcagatactgctttataaaatatatttcttaaataataagacttgaaaatcaaatttatcccttctccatgggctgcagaatgggtgttacattagcaggcatgaaaacaacattcatctttacatacatctccgtcagagctcttgggtcacaaggtgcattgtcaatgagcaataatattttgaaaggattcttttttcctgagcagtaggtctcaatgatttttttttttttttgatggagtctcgctgtgtcacccagaatggaatgcggtggcatgatctcggctcattgtaacctctgcctcccgggttcaagtgattcttgtgcctcagcctcctgagtagttgggattacaggcacacaccaccatgcttggctagtttttgtattttttgtagaaacagggtttcaccatgttggccaggctggtctcgaactcctgacctcaggtgatccacctgcctcagcctctcaaagcattgggactacaggcatgagccactgcaccgggccctatttgttttttttttgttgttgttttttaattgagacagagtctcgctttgttgcctagactggagtgcagcagcgctatctcagctcaccgcagcctccgcctcccaggttcaagtgattctcctgcctcagcctcctgagtagctgggactgcaggtgtgcactaccatgcctggctaatttttgtatttttaatagagatgaggtttcaccaccatgttggccaggctggtcttgaactcctgaactcaggtgatttgcctgccttggcctcccaaaatgctgggattacagctgtgagccaccgtgcttggcccttttttgtttttttgttttttttcaaattgagacagagtctccctctgttgcccaggctggagtacagtggcacgatctcggctcactgcaacctccgcctcctgggctcaagcggttctcctgcctcagcctcccaagtagctggaattacaggcgtgtgacaccatgcctgaataatttttgtatttttagtagagatgcggtttcaccatgttggccaggctggtctcgaactcctgacctcaagtgatccccccgccccagccttcaaaagtgctgggattacaggcgtgagttgccgcaccaggcctcaatgggtttttaatattcagtaaaccatgctgtaaacagatgtgctgtcaagtagggcctgttattccatttctgaagcatagacagaatagatttggcagaattcttaagggccctaggatttttggaacggtcaatgagtattggctttaacttacggtcaacagctgcgttagcctctcatgagagtcagcctgtcctttgaagctttaaagacaggcattgacttctcccctctagctatgaaaatcctagatgacatcttcttccagtagaaggtgggacatctatgctgaaattctgttgcttagtgtagccaccttcatcagtgctctgagctagatcttctgggtaacttgctgccgcttctccatcagcacctgctgcttcaccttgcacttttacattatagagatggcttctttccttaaacttcatgacctgacctctgctagcctcaaactttccttctccagcttcctcacttctcttagccttcataccattgaagagagttagggctttgccctggattaggcttttgtttaagggaatgttgtggctgatttgatcttctatccagaccactcaaactttcttcatatcagcattaaggctgttttgctttcttcttcttcatgtgtgcactggaatcgcacttttaatttctttcaataactttttcttggcattcacaacttggctagctatttggcataagagatctcacttttgcctgtcttggctttcgacacgccttcctcactcagcttaatcatttctagcttttgatttaaagtgagagacgggtgactcttcctttcacttgaacacttagaggccattgtagggttattaattggcctaatttcaatattgttgagtctcagggaatagggatgcctgagcagagggagagagagcggggaacagccagtcagtggagcagtcagaacatacaacgtttattgaataagttcactgtcttatctggatgtggctcgtcatgccccaaaaacaactgcaataatggcattgaagatcactgatcactgggcgcggtggcccatgcctgtaatcccagcactttgggaggccgaggcaggtggatcacctgaggtcaggagtttgagaccagcctggccaacatggtgaaacctcgtctctactaaaaataccaaaattagccaggcgtggtggcgggtgcctgtagtcccagctactggggaagctggggcagaagagtcgcttgaacctgggaggtggaggttgcagtgagccgagatcacaccactgcactccactgcactccagcctgggcaacagagcgagactccatctcaaaaaaaaaaaaaaagggccgggcgcagtggctcacgcctgtaatcccagcactttgggaggccgaggcgggcagatcatgaggtcaggggattgagaccatcctggctaacacgatgaaaccccgtctctactaaagatacgaaaaaaatagccgggcgtggtggtgggtgcctgtagtcccagctactcgggaggctgaggcaggagaatggcgtgaacccgggaggcggagcttgcagtgagccgagatcgcgccgctgcactccagacagagcaagactctgtctcaaaaaaaaaaaaacaaagaaagaaaaaagaaaaaagagatcacagatcaccatagcagatataataataatgaaaaagtttgaactatttcaagaatcatcaaactcctacacagagacacagtgttaacatgttgttggaaaaatggtgccagcagacttacttgatgcagggctgccacgaaccttcaatttgtaaaaagtgcagtatctgtgaagcacaatgaaatgaggtgtgcctgtgttccttgtcactgtaatgtcggtaggatccgtaaggaaaacacttcattccttttattgtgactttatgttcgccatctccctctcatcagcagcctggctaggaggttatcaatctagatctttttaaagaaccagcattggactccccttttctggtgtccatttccttgagtttctctgttatcttcattacttccttccttgtacttgcttcagcgcattagtcagggcccagtcaggaaacaaaaaccacaccggcaatttgaatagcaacttgtaatataaagtgttcttaactgtaagaggtagttaactattaaagggatcacaaaggggtgacattgtgatataagaaagatgtatttgggctgggctcggtgcagtggctcatgtttgtaatcccagcactttgggaggctgaggcaggcggatcccttgagctcaggagtttgagaccagcctgggcaacatggtgaaacctcatgtctaccaaaaatacaaaaaattatcctggcgtggcggtgtgtgcctgcggttccagctacttgggaggttgaggtgagaggatagtttgagcccgggaaggcagacgttgtggtgagccgagattgcactactgcactccagcctggatgacagagggagactctgtctcaaaaatcaatgtatctgtctgtctgtctgtctatctatctatctatctatctatctatctatctatctagtctctgtcccccaactttgtttggcatgtagctcctaaaactcttgaaatctccaaagtgatgggtgtctttttgtttgctaaggaggcgactggtggctggaggctcctggacagcctggggataagggctggttgccaggggacccagccttgtgattagaaggctagaacttgcagcctttcccatccacctcctgcgaggcaagaggggatgaaggttgagttgatcatcaatggccaaagatttcatgtcatgcttatgtagtgaagcctccctgaaaacccaaaaggatgaggtttgtagagtttcaggttgttgaatacctgcaggtgctgggagggcagtgtaccctcccgtggaagctccatgccgcttccttcatacctttcttatgcatctcttccagttggctgttcatttgtatcctttgaaatatcatttgtaataagtcagcaattttaagtaaactgatttcctgggttctgtgagtcactcaagcaaattattgaacctgagaagggagttgtgaagacctcaaatttgtagccaagtcagacagaagttatgggtaacctggtgtcttaccacttgcgactgatctctgaagttgagggcagtcttgtgagatggaacccttaacctatgggatctgcactaactctggttggtgtcagaattgaactgaattgcaggacacccagttggggactgctgagtattggagaattgcttgggggtcggcgggaggaaaccacacatctggtgtcagagctgaagcactgagtgttgtgaatgagagtggagagatagagtttgttttgccttatgcaagaggactctaaggagtatagaaagagcaaatatgagaagcagctactttagaagaaaacataggaggaaagcttcgtgacattggagttggcaatgctttcttggatgtgacaccgaaaatacaacaaaagaaataaatgataaattggacttcaccaaaacttaaaacttttgtgcatcaaggaatactaccaatggcgtgaaaaggaaatccacagaatggaagaaagtatttgaaaatcgtatatccgataaaggactagtatccagaatatataaagaactcctacaactaagccacaaaacaaaaaaaaacaacccagtgaacagacatttttccacagaagacataccaatggccaagaagcacaggaagagatgcgcagtgtcactaatcatcagggaaatgaaaatcaaagccacaataaaatatgatttcacaccctttaaggtggctgttagccaaaacatggataacagcaagtgttggcaaggatatggagaaattggagccccgtgcactgctggtgggaatgtaaaatggtgcagctgctgtggaaaagatataacaattgctcaaaaaattaaactcagaatgaccataacatccagtgattccacttctagatgtatactccaaagaactgacagcagggacttgaacaggtgtgctacattcttgtttgtagcagcacttttcccataaccaaaagatgcaggcaacccaggtgtccaccagcggatgaatgaacagacaaaatgtggtccatctgtacagtggaatattattctgccttaaaaaggaaggagaggccaggtgtggtggctcacgcctgtaatcccagcgctttggaaggccgaggtgggcagatcacttgaggtcaggagtttgagactagcctggccagcatggcgaaaccctgtctctgctaaaaatacaaaaattagccaggcatgggggcatgtgcctgtaatcccagctactagggaggctgaggcaggagaatcgcttgaactagggaggtggaggttgcagtgagccgagaccatgccactgcactccagcttgggcgacagagcaagactgcctcaaaaaaaaaaaaaaaaaaaaaaaaaaaggagattctgacacatgctatagcatagatgagccttgaagacatgctaagtgacagaagccagacatgaaaagacaaatactgtatgatttcacttttatgaggtccctagagtagtcaaattcagagagacagaaagtgggatggaggttgccagaggctgggggaagggagaatgaatgggaagttggtgtttaatggggatagaattgcagtttgggaagatgagatggatggtggtgatggttacacaacagtgtgaatgtgcttcatgccaccaaactgcacacctgaaaatggttaaaatggtaaattttctgtgatggatactttaaggcatgtatgcaaacacacagaagcagttactaccactggggttgatggaaaagaaaccaagaactcggagcgtcctccacaccttgccacgtcttacgttcaggccttgttggagagtgtgtgactgccacagaaacctgcagcctactggtaacaaaaaggttcttgccagaaggtgtagaaagagtggatctgcaggatcagcttactgggtagccgagaaacctactagagggtatgggtgggcaggagctgggtgtctgagaagtttgctgaggtcccattgggctagagctggggtgctggagaaactcagtacagagcaggccccactgggcacacgccactggcagctgtgccttcagaggaaaaagagaccctggaaccaggaagagaagctgctacctcagcaaggcctggcagctccccacagtgttgtcccctgtggatagagcctgacatgactgtatttggccaaggagaaagactcataaggcctcggtccagtatcacggagcggggcctggcaggatgtatgcagagttaagaggcaatacatgggtaactggcatatttttccagattctttgttttttttgttgttttgttttgttttgttttgttttgttttgttttgagagagcatcctgctctgttgcccaggctggagtgcagtggcatgatctaggctcactgcaacctccacctcccgggttcaagccattctcctgcctcagccttctaagtagctggagatgcccaccatgcccagctaatttttgtatttttagtagagacagggtttcaccatgttggccaggctggtcttgaactcctgatctcaggtgatccacctgccttggcctcccaaagtgctgggattacaggcgtgagctacactgcacctggcccatttttccagattcttaaagcagatccttaggtctttttttttttttttttttttttttttttacttcttttctaatataagcacttacagtttccctctaagcactagcttcagcctacgtattttagtatgctgtgttttcattatcatttcatttgaaatattgtaaaatttttcttgtgatttcctctttgactcatgggttatttagaagtatgttgtttaatttgcaaatagtcaaggctcctctgagtatcttagagctattgatttctaatttaatcttactttggccagacaagcatattttgcatgcttttaaaatttgagacttatggcccagaatgtgtatcttggtgaatgcactgttttcacttgagaaaaaaatatgtatatatattctagacttcctgagtatagagctttataactgctgattaggtcaattgctagttaccagtgttcttcagattatctgatgcttgtttctcagatgttgagagaatggtgtttgctatggcctacctgtttgtgtcccccaaaattcatatgttggagcttaatctctggtgcagtggtgttgggaattggggcatcagggaagtattggctcatgagggcagagtcatcgtgaatgggattagtcccttctgccatgtggggacacagcaggaaaaggacatctctgaagcagggagctagctctcaccagacactgagcaccctgattttggacttcccagcctctagaactgtgagcactacaatctgtttataaattacccagcctaaggcattttgttttaacatcctgaatgaactgaggtggtgttaaaatctccaactatgcatccaggcgcagtggctcacacctgtaatcccagcacttcaggaggccaaggcgggtggatcacctgaggtcaggagtttgagaccagcctggacaacatggtgaaaccttgtctctactaaaaatacaaaaattagctgggcgtggtggcaggctcctgtaatcccagctactcgggaggctgaggcaggagaatcgcttgaacccaggaggtggaggttgcagtgagccgagattgcaccattgtactccagcctgggcaacaagagtgaaactccgtctcaaaaaaaaaaaaaaagagtctccacctatgattgtggaattgcccatttctccctttaattctttcaggttttatatcatgtattttgaagctcctttggttaggtgcatacacatttatgattataatggtgtctcgatgaactgatcatttaaccatgatgaatgtattcctttatctcgtaataattttatcttggactcaactttattgatatttatgtagcctctccagccttcttaaacatgctgtttgggatgcataagaaggctggagaggcttatggagaaacttatgatggtttgacttacagtttttcaactttaccatggtgcgaacgtggtatgtatacagtagaaactgtactttaagtatgtgtgaaaccattgtgtttctcactttcagtacagtattcaataacttacatgagatagtcaacactttattataaaataggctttgtgtttgttgattttgctcaactgtaggctgaagtaagtgttctaatcatgttaaggtaggctaggctaagctagaatgttcggtaagttagatgtattaagtgcatttttgagatgatatttattttccacttatgatgggtttgtcaagacataactccatcatcattcaagcagcatcagtatgtctttttccaaacagaaaatttcaacctgtgtttatactgaaacagcatcttttgtagatagtatatagttgagtcttgctattttattcattctgacagcctccgccttttaattggaatattcaggctatttctgtttaacatagttatagatatgactgggtttagagctactaccttgctctttgatatttatttctttcatcttgctttcttggcttcttttatgttaattaagtattttttagaattctattttaatttatgttttttttttttttttttttttaagacagagtctcactctgttgcccaggctggagtgcaatagcatgatcttggctcactgcaacctctgcctcctgggttcaagtgattctcctgcctcagcttccctagtatactgggattacagacgcctgccaccacggccggctaatttttgtatttttagtaaagacggggtttcaccatgctggccaggctggcctcgaactcctgacctcaggcgatccgcccaccctggcctcccaaagtgctgggattacaagcgtgagccactgagcccggcctgttttgactttttaattgtatctctttgtattgctattttagtagttactttatagattctattgcacattcttagcttttcacagtctacttagaattaacattgtttttcttcatggaaaaaaagtgtaagaactaggcaatcctatgggttcatttaccactttccatcctgtatgtgatggttgttagatatttactacatccatacacattgtaaactagacaatacaataaggaaatttttgctttaaacagccccatgcattttaaagaaattaaaagtaaaacagaatcttttctatttgcccatgtatttgctatatcctgtgctcttcattccttcctgaagagctgagttcccatctggtctcatttcccatgatcttggagaacttgcttcacggtttttgtagtgcaggtttgcagacagctaattccctttcattttcacttatctgcaaatctttattttgctgtcattctttctttttttatttttatttttatttttgagacagagtctcactctgtctccccacaggctacagtgcaatggtgtgatttcaaaactcctgcccaatctcaactcaccaaccttctcctcccgggctcaaacgattctcctgcctcagcctcccaagtagctgggactacaggcatgtgccatcatacccagctaatttttgtatttttagtagagatgggatttcaccatgatggccaggctggtctcgaactcctgacctcaagtgatctgcctgctttggcctcctaaaatgctgggattataggtgtgagccactgtgcccagcctgctgtcattcttgaaccataatttcactggttatagaattctgagttgtcagttttttctttcaggactttaaaatatagggttccagtgtctttggcctccgttgtttctgtcaaggaatcagcattcatctagctattcccctgtagaccacatgttgtttttccctggatgcttttaagactttttatccaagtttgattgctcagtacctacctctgggcaaaaaagcctccagaaaccagaaacttatctagttttattcccctctgtcaggtgtagactctactccagcttctacctacttgagatattctatactgactccaggctgttgttattttgttctttcaaatattttgtccagagctataatgttttctgcagaattgaccagatagcagctactctctgtgaccaggagccttgatcttccagacttgctgatgggctcacaaagctcctgcccgtggccctcagttggcagtggcctctctgccttgaagttgccatgagtgtgtaaaacctacaggctcaaccttcctcattagtacagtccagaaaagtggaattcctggtctgggtggctatggtgccctagaccactggctagaccagggtggtgactgccagctggccgaatgtggggtctccagcctagcacccttggactctaccccaggagttatggctgtttcagggccaggggcctggcctcagcccctgtcccccttctcttctcctcaagttgcccagcatcaggtcccaaccagcatcttttgcagacagggtgggtcggctcctcactagaggggcagggttgggcgggaagcctgttgagccctccttcctgtgcagcccacagccctggggttagctccagaggggtgcagaaaggagcccccaaaggcagaaactcacccttctctctgttcttgtgcttccagggataaaggagaggtggtcctagctggggggctaccagtggcatgcaggaggcccacatgaccactgtttgctggggcctttccttctctgtgagagagacgagagagaggagagagagtgtgagtcagggtagtgtcttcttccagtaacgcagacttctgcacgtgttctctaggagaaatcccgtcactcgctagagctctagatctggaagaagctctgcctctcttctctcctccagtgcagtgtgtgtgtgtgtgtgtgtgtgtgtgtccccacatgcattacacccttctacagaggaaataattcccgtccaagtgcaaaggttgggattggagcaggcagcatgtgggctaaaggagcagagaggaggaaacgggggcgggggtgagggtgggaacaggaggtgggtagatgccacgaggcatgccttccacaactagaagggctggtggagatgaccagaatgctccagacagaccttttatcaaacttccaaaattcaatcttgtttcatgaagcctgaggaccctgcagagtgaaagacaaggaagggctttcctgcaggggggtgtgtgtgcctgtgtgtgcctgtgtgctgtgtgcccccatgtgtgtgcacgtgtggacctgtgtggtgtgtgcctgcacatgtgtgcacgtgtggacctgtgtggtgtgtgctgagtgtgtatatgtgtgtgcctgtgtgctgtgtatgcacttgcacatgtgtacacagatctcattttccttttttctggcttactaagtgccagaaagaatttccgtgagcctctccacccttcccaaggctgcacatggagggacttgcgcaggcacatgtgcgcgtgcacacaacacacacacacacacacacacacacacacacacacacacacgagtcaggggcgagcactcctgtggattgtacctaggcctggcaggaaaccgggttctgggaaactgtaggccccacctttggcagaaaaccatgtttttgttgctgctcgttgaagggaacattaagtggggctggggacagtttatgttgagaagagcaaattttgcctatggcactggggacattgagtggctcctgtcccgggctctggagggcttgggagacacgtctgcagctctgggcatctctcaaggtcacgggcggccacactcaaggttaggccctcctctgtgtgagctgcggtcagcaggaaggctgacctcagaggcggccccagggcccttggaggccctgcccctgagacatgggccaaggtcagagagccgagaaggctgctgctgaggactctggttggcgcccagcccagcggcccttcaggcgggccctgtgcaggggctgatgaagtcagctgggaaatctgtgaaataaagcacaggtcccccaggcttgcccagagccccggcatcagatgaggtgcagagaagggaactgagctgccaagtgtgaacaggagagaggagccccaggaccacacaggggccccgacatggcaggtgcttggtcagcagcggtgctgcccttactgctggacgtgggaaaatgcactgacacttgctgaccagagccggggtgagcatctgggtgaccctgcagatgagacaaaataagggctgccgtgggggaggggcccttgccgggccaccctgctgaggccctgtgttactgtcctgcggctgtcataacaaaggaccacaaatgaggtgactcaaaacatccgaaatcggccacgtgcggtggctcatgcctgtaatcccagcactttgggaggccgaggcggttggatcacgaggtcaggagatcgagaccatcctggctaacatggtgaaaccccgtctctactaaaaatacaaaaaaaaaaaaaaaattagccgggcgtggtggtgggtgcctgtagtcccagctgctcaggaggctgaggcaggagaatggcatgaaccttggaggtggaggttgcagtgagccgagatcgcgccattgcactccagcctgggtgacagagcaagactccgtctcaaaaacaaaaacaaaaacaaaaacaaaaacatccgaaatgtcttccctaaagtttctggagccagaaatcccagaccgaggtgtctgaaggttcattcctcctgggggttccgagggagactgtcccatgcctttctccgagctctgcggcggccagcaacccctggtattcctcggcttgcagctcggcctaccccccacctggccttcaccctgtgtctcttcttgtgtctctgtccaaactgccctctctgttgtctttttaatttatttttagggacaggttctcattctgtcctccaggctggagtgcagtggcgtgatcatggctcactgcagcctcagcctcccaggctcaagcaatcctcccacctcagccttccaagtagctgggacacaggcgcacgccaccatgcctggctaattttttaatttttttgtagagacgagggcccaggctggtctcaaactcctgcgctcaggcaatgagactttgcctcccaaaacactgggattagagacatgagctgctgtgcccagcctacctctgtcttataaagacacctgtcattggatttagggcccactctgattcaatatgccctcaaataacccaattacatcttcaaagaccctatgtccatataaagtcacattcataggtactggggggtcaggacttgcatatgtcttttgggggaacacaattcaacccacaatgggtctcacccacagaacgaacggcctctccagggtgtgcgcaggtgggtgaggggcccaggagagggacctgcgtggcaagagggcttgtgttcacgtcagagattccagaaggagactggatggggtggctgcatggagcaaggggctacagccactgtctccaagtagttggtgggttgtctggtagaaagggagcatttattttgagttcccccaagatatgaagctagtaccaggtacctggaaggtgctagcgagtagagcttgactctttacagaaagaggtgtttttctcacaatgttcacttgaggacggtggaacaggctatttcacaaggtagtgagttccccatgcctggaagcattcaagcaggggccatgtgggagttgttcaggagtgcatagaagggacctcagaggtccctgccaataccatctttgcttgtcttattttacgacaacttgaatttcagaatgtaatgttattggggatatgtctactagaggggcctccagcatcaggccccacacactatgcatcatttttagggcagggaatgagagcaggctccattctttttggttgtctgtgaggaccaggaggcttgctgctgaggcagcttcctgtggaaacagtgtctcagccccgcaatccattcatcggagctccaacatcttaatgaaacactgtgtcagatgggttctgggcatgtgtgtgcagattgtcacaagtccatgagaatgcacacacgcacattgcatgtgtgtgcacacatgtatgcacacatgcacaagaacacgaagacccgaggcaggtatagtccgtgagacagatccctctaggctgaaagactccccacaagggtccctagaacaaggctccagcctcggcagtccctcccacttctggtgggaggatctccacagagaagaagggtcaagaagcacagctcttgatgctcacggtgtaccaagctctgctttaagcttgtgtcttattttttacttatttagcaaatctgtcgctcttgttttgtgccagatgctgttctcagcactttacaaatattgatgcatgtttgtttcatgacaaccctgtgaagtaggtagtgttaccccgttttatagatgaggaaacaggcgtagagggataaagggacttgcccaaggtctgtctctaccttacacgcacatgaacgctcactcatgcggcaggcgctagtttccctctgatgtgagtcaggccttgagctggttggggtctgggtcccactttggttgtgttttgctgtgggcaccaaggaagcttctagcagcctcatctccctggtatgacctagctccagggactggatttccccaaatgctcctgcccagcctggagcctcctttccagctgggggagggctgaacgacccctcactcttggaggctgccggagcccctcctgcctgcatgcggccgctgccgggtggacaggcctgcttgtgggttgaggctcccagcagctggggtggatcatttctcctcccaagaagctttgggagaagcagctgagggggccagcgtcctcctgaggccaattccctgcctcccccagcgcaggcgcgaagccatctttgcttgtgtgtttgccacagacagtggagggcggtgcaatcgtgacgcctgcttgttgcactttgcgtccttgaggacgttgacccctggccggtgctgggcgcttgctcttcagtcatcttgccctgacctggcgtggcaggcccgagcactgctcttttacaaggaaacaggctcagaggccttgagtcacttgcccgggctcccccagccaataattggctgagccaggatttccatccagctctgtgactccagaagtccaagttcttcccatcacgtcagggccaggaaaggattagaatgcttttctacgtgccgattatttggatgatctgtgcagcttagctcgttgtagttgctcaataaaaatgtggaatgaatgggcctatatgtcccattgtgtgactcagagccaatgactctggctgatcctcctgttttcattccgtggcccagcatctccctttggggtgtgtgaccttggaagcagtgactctctccatcccaccttgaatggtgtctgcgccgcagcaggggagcagctggggattgccagcgcctgttgctggtgggctgtgcgccagatcccgtcttggatgtgtgggtgattgtcagccacatgtgtgtgaagggctgtgcgtgtaggatttgtgcaaatgtgcccctccctgctgccagcccatgggaggctgtcaagattctgcccctgcacattagcccacactctctttgtggcccactgctgtggctgttcccttgtgtcacgtggctgcaggcacagcccccaagtggatggggatcgtgggctgaatgtgcatcagatgctcctgcttcttggtgggtggagaccctcaacccatgcaccgtggctgccgcatctgaaaggccttccatggtgaaggacttggacctgagcaaccctccgcagaggtcttagaagtgctccctggccgggcgcggtggctcacacctgtaatcccagcactttgggaggccgaggtgggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacccaggaggcggagcttgcagtgagccgagatcgcgtcactgcactccagcctgggcgacagagcgagactccgtctcaaaaaaaaaaaaaaaatgaagtgctcccagctcttcctcctgtggtgaggttctgagtttccatcctcagaagaaaacctggctggggagggcatctctagacccggacataaacgccaggagaccagggctgccctctcaggtgaccaatcacagagactcagggaaagtcacgtttggaagaggcgacactgtgtctcagcctcattcatttctccatcctacagacactgcctggtgcccagcccgcaccgcgaggcttcctaagcagctctgggcaccgtgcacctggcatggcctccagccccatctccctgccttgggagacccggtggggactccgggctgagctcctgtggctgtggaaccttggtggtttattgtggtggctgagaacagggacgtggggttggacgggttgagtgtaactcccagtggctccgtgaactgcctgggagccttgggcagctctttctcactctgtgcctccgcttcctgatggaaaaatgggggccaggggggagcgaccttgaaggtattcgtgggaaccaagcgaggtgataaatgtagtgtccttggtagagaactggacacagagtccacccccatgaagggggctgctcctcctccttctatgtttcctcttgttcttatttctcctcttgtatcttctcttcctgctttccctccccctcccctccccccccacatgcaggcacactccatttggtgccccaactgcctttctccattgtccttctgtaagtggttctctaagtgggaactcaggcctggaaagggtgggcaccctgtctggtgggctctggcaggccaggcgctgagcagcctcaggagacacaaccctaggaaaaggctcatgcaggctggctgtcatgacggactgttggtgggagaggggaaggcgccgtggtaggggaagctttggaaacatccactagtggccttatttatgactcaggacacctgccaggtcactagaacacagctgaggaagctgtcggccagacgtccagaagcatcaacctggtggctgggctgtggggggacctctctggacaggcagacaaggtgtcggaggaaggggctgacactcactcagtgtctgtcatgcactgagggcacaaagggcaggatggagagctggcccacgccacctgtggaatcttccaggtgtgggggcagatggggaagcaagggggcttgaagacacatgcgctcattaaatgtccttaaatcccaagaagaagaacaaggacacatccacaggggcagggctgaaagtctgatgcatggtgttttggggtctgctcctgctgcaacagctacagtggctccctcttacctttctcttccctccattctgttgtgaaaatgttcaaaacacatggtcaagttgaaagcattttacagggaacacattcagccatcacctagattctaccactaacaccaagctacacctgctttatcacctcaccgtccatctatccctccttcgcctggccatgaatccattttatttttattttttggtgcatttcaaagtaatttcaggtcatcctgattatctctggaatcactgtcagaaattccctcccttcccctcccctctcctttcctttccttttctgagatgggatcttgctaggtcacctaggctgaagtgcggtggtgcagtcatagcacactgcagcctccaactcccgagctcaagcaatcctcctgcctcagcctcctgagtagctgggaccgcaggcatccaccaccacacccagcttcattttcaaaatttctcaccaactcctcactccttgtattcacccaggaccacttctcacaaagccagggtgctgcaggaggggtcagaaccccaagccctaatcctggctctgtcattaacactgtgcgaccctcagcaaatcattttgcctgtctaggtcctgttttcattcctatgaaacgagggcgttaaactgtatgttataaataatgagggctaccagttaccaagctcctattttaggccaggcacttttcacatgttattatgagtcctttcaatctaggtattgttctcaatggacagcttagtcaacggaagctcagagaggtggtgtaacttgccaaaagtcccactacccagtgaatgtccccacggggtctgcacccaggagtctgacacagagcccaggcctcagcacctggcgatgttttgggggtgtgagcagcccagcctactctgggcacgtgtttacttgctgttccttctgcctcatgtttgtgtttgtcccctctgaagctcagactgttattttccagttccaaataccaaaactggctaggcacggtggctcatgcctgtaatcccagcactttgggagaccaaggcgggtggatcacttgaagtcaggagttcaagaccagcctggccaacatggtaaaaccccatctctacaaaaaatacaaaaattagccagacatggtggcgtgcacctgtagtcccagctactcaaggagaacccagctacccagctactgaggcacgagaatcacttaaacctgggaggtggaggttgcagtgagccgagatcgcaccactcctctctaggctaggcaacaagtgtgagactctgtctcaaaaataataaataaataaaataaaataaaaattaaaaccaaatgccaaaaccaacccacaaaataaaccttggttaaagtagcctgttcattttgctttaactatgtatattgcaccagattctgccaggggctcagcgtataaagatgagacccctgccctgccagacaggtgggatgatggccataccttgagttagtcaaggcaccatctggctgtgtaacaaaagctaaaacatcagaggctgagcagcactcggacccacgtcccagtccaagtgtcagtcgttatgggggcccaggacagcccggacctagttcattcctttggtgcatcctcgacacacagcttccatctcttgagctgagatggttccagctcctgccgtcatgtctgcactccagccagagggaagggaagaagggagaggggaaagggcaagtgtccctctttatttttaagggcatgacctgaaagttaaacacttcagctccttcccactggccagaacccagttgtatggccgctcctgtcatcagggaggctgagcaatgtattcttcagctgggcttccctgtgcacaaccaaaacttcagttactatagaaaaaagggagctcagatattggggaaacaactagcatctgtaccacatgcactgatagctctctttgtatgaacagagctgtggcaggccctatgccagggagaaagtaagattggaaaagagcttaccaaggaggtggcatttgcactgtgcttaaggggcaagaaaaacgtcttccaatcaggagccacaaatgcttggctgaagtgctactgctctttcatcctggagctggaacagacgtcaccagtcaatcatgatggctgctgggtgcactggctaacatctataatcccagcactttgtgaggctgagggtgggaagattgcttggggccaggagtttgagaccagtttgggcaaattgcaagaccctgtctctgcaaaaaaatataaaatgtagctgagtgtggtggcacctgtagacccagccccagctactcgagaggctgagatgggaggatcgcttgggcctaggagttcgaggctgcagtgagctatgattgcaccactgcactccagcctgggtgacagagcaggacctgtctctaaaaacaataaaataaaatcaaagttttaaaatggaaaaaaaatcatgagcacataactccagatgtatcctcaagatagcaaacccgggtgggcgcagtggctcatgcctgtaatcctggcactttgggaggccaaggtgggtggatcacctgaggtcaggagtttgagactagcctggccaacagccccatctgtactacaaatacaaaattagctgggcatggtggtgggcacctgtgatcccagctacttggaaggctgaggcaggagaattgcttgaacccaggaggcggaggttgcagtgagccaagatcacaccattgcactccagcctggagaaaaaaagcaaaactctgtctcaaaaaaaaaaaaaaaaagcaaacccagggccaggtctgtagccacatggccaccttcttccctgagcatggaggcagcctcagaaacctgccccacatcacatcagtgggcagttgattgggtcagcctgccagttgaaccctatttgccacagtcattctccatagtaaggggcattctagacataccccccttcccagggaagaataagccgtagctgcctgagcgttttatccagtggtgtgcatgtcttttcccaactctgtgtttagtgatgtcctgtttgtagcttgaaatttgccacagtgggtgtgtttacaccacaggaattggcaaacactacatatcaggccttacctcctgctccctactagggtaggttgttttttttttgttgtttttgttttttgtttctttttttttttgagacggagtctcgctctgtcgcccaggctggcgtggagtgatgcgatctccgctcactgcaagctccgcctccctggttcacaccattctcctgcctgagcttccagaatagctgggactacaggcgcccgccaccacacccggctaattttttgtatttttagtagagacggggtttcaccgtgttagccaggatggtctcgatctcctgacctcgcaatctgccctcctcggcctcccaaaatgctggcattatgccactgcgcccggcctagggtaggttgttagaaatgtaccagcctgccagtttcagccttgtttgtctttcatcctttttttttttttttttttttttgagacggggtctctctctgttgccccccaggctggagtgcagtggtgtgatcctggctcactgcaacctctgcctcctgggatcaagtgattctcctgcctcagcctcccaagtagctgggattacaggtgcccaccaccacgtccagctaaattttgtatttttagtagagatggggtttcaccacattggccaggctggtatcgaactccttacctaaggtgatccacccgccttggcctcccaaagtgctgggattacaggcgtgagccaccgcactgggcctctttcgttctttcttaatgaaaatcttcctgaaagatttgcctactgatgtctgtgtcaataggtactgcctgcgggacagagcctgccctccttttgaaggtctttctctgtctgggtgaccatctgcatgtcactccctgctgctcagaactaaagatgtagctatgcctggggtaggttgggaaaacctgtgggaatcacagagcttgctgtcatgctgtgttctggatacctgaagcttggcaggcaggtgggatcgagggtgggcattaggaaagtgatgtggctctataggaaggggacataggtcctgagattttaggtccccaattggacaaagctgttttttttttctggataaatgttctagcttattcataatcgagtggtcagttttcttttcttttcttttctttttttttttgagatggagtctcgctctttcgcccaggctggagtgcagtggcgctatctcggctcactgcaagctccgcctcccaggttcacgccattctcccgcctcagcctccggagtagctgggactacaggcgcctgccaccgcgtccggctaattttttgtatttttagtagagacagggtttcaccgtgttagccaggatggtctcgatctcttgacctcgtgatccgcccgcctcggcctcccaaagtgctgggattacaggcgtgagccaccgcgcccggccaagtggtcagttttctcagctgccgggtcttgcacaccttgctggctctggagaccatatgcaccatgtagaccccatttgtttcctaccctcagtgttgggggaggggccaagggcctgtcgatgtgttgacacctggccattcactggccttgaatgtccacattcacctccttgaaatcgatgccccgtatcggaggctccatgtggatttgggggcagaggcctgtactccagatggtggggtggccttcaccaatcaggcagattccctgccctgccctgccctttgggctctgtagctccagatgtgtgctcaagatctgtggccacatggatgggacaagccacagagactcagactccgtggtccctgtgaccagagtagccgtggccctgtctgggaatgttcccaccctgttgctgaaggtgagaaatttctctgtgctggagaacagctgtgctgagaagttggcccatctggcttgcaggactgctggggcaagggaggtctgctgccggtctcttccttcctcctctgactgggtgctccttgtctaggttccttgcagcaaaagaattctctaatttattttgttcccttattgagtctctactccatgaagcccacctcctaatcccagctgactggctcccacctcctcaagaggaaggccaggggcagacgaggctgaaggaggctgactcccctgtgccttcgcagtctgagctgatgctgctgtatgttcacagggctccttcagcttttaaaaaggcttcaacacgttcgtcacacgcttgtggctctcctggatgccacactaactcagtaaggcctgagttagaggctgttcctgaggctgtgaaaatagaagaagggtccagaggagaatcccttcatctgacgatcccaggaaggcttcctagaagaagcagcctctgagctgagacctgaagacagatcaggcctgagtcaggccagggagggtgtgaggggcccaccaggcagagggaacaggatagggcaggcacagaggtctggcacctggcttgtggggaagtgtgagcccctgggcatgaccaaggcggggagaagtggcgtgagaggaggcagatgtggctggcaggagatcggcggccccggccttgctgagctccactctgtatgcaccaggtgacagaggctgcccaggacggtgggcagggaagtgacaggtcacatggtcatcccaccaacagccgggagtccagcttggggggacccaagaccctggggaaggcacgagtcaggggcctgctagagccaggagctagtgggagaaggaaacagtgttgcttatgaattataaacagacactcccgcaactttctctgacgtgatacaatctcaaagtgggccacccagaggtgggaaggtgacttctggctctccaggccttgggcctgtcttttttttttttttttttttttttttgagatggagtctcactctgttgcccaggctggagtgcagtggtgtaatcttggctcactaccacctctgcctcctgcgttcaagcaatcctcctgcctcagcctcctgagtagctgggattacaggcacctgccaccacacccggctaatttttgtatttttagtagagatggtgtttcaccatgttggccaggctggtctcgaattcctgacctcaggtgatccgcccaccttggcctcccaaagtgctgggattacaggcatgagccactgtgcccagccgagcccatcttcaagttctccctggccctcagtgtttctgtattagttcacccttttggctccctgcttttaagagtctcccttaagactgtccccaagtggacaggtccccagaaccaaggagcagccttaggagtccccagttacagacactccagggggtccgtgtggccctcagcctctggcctggttccggcagccttggtcctttgtgctgtctctcacatagcctggccagagctggccaggtcccttggctgggccgagtcatcgtggccagtgactcatgcagggggagaaaagtgaggagggggaacagagtgcgagggggactgtgttaataacaaacccattaggtccctgaggtcacttcacaggagggacaaatggttcatttaggttgatctggctgccggctggcttccagagacactcagggtggggaagatttcattatctggggaaagcaataccagattgtctggaggggcccagccagcgcaccccgcgcttcctgtctgcctcccacgcagagcgttctgttcccaaggcggcaggccaagagcgcgagccgaggctcaggtgcaaagaggggtgcggcatgggggcactgcagggcacggggtgcatgcatttttatttatttttttactgagtgttagggtaatttgttaatggggtatatttggtgacataaaaccttctgtcgattcatggcagtctggaacggagtggaagcgtcccactcctggggaacccccacacacatttggctgtgaacgtcggtgcctttgcactggagcctctttggagtgtgctgggcagagcggagaggttcctcttctctcttctccatcatcctgtggaggtgtcaacatgtagccagagatggtcagtggcagtgaggagaggggggcaggaagagaccagggctgggggcttgccagcccacagttctacccctgaacacccatggcctccctgttcaggtcagcgaggctgggggcagagacgggcaggggtcccccaatgttgggcatctccccgctccctcatactctggatttgccctctggagaaagctctggagcacccagaagtcctggggctgctggctgaggtggggagcagagcccagctgtgcctggaggctccccacttccactcagcttccagggacagtctcagctgtgcaggcccaggccgctgaggctggctccagaaatttcttcacaaccaccactggatggaaaaccagttctctaaagggccccagagccagttttgtttcttcttccacaggttcccatagttagagcatcgggtctttgttagagatgcagaagagacgatgtccccagcccttatgtggttcggtctccactgtggatgttggtgatcttagtctccttctcaaaaccaagagggctgatgccccacattccaggcccccagaaagagccgccacccacccacaccgctacatcttctttccacttttctgttccggaaagagtagagtggatatgcgctcctgtagaaatccatctacagcctgactgcagatgtattttgctcccttattgagtctctgctccatgaagcctgccttgtttgtacctctttctctctctttctctctttcttccctctcttccttcccttccgttcccttcctttttctttccttcctgtcttattctttcctctttctttctttcctctctctctctttccccctttctctgtctttcctatcttttctttctctctctttcctcttttttgaacagccaaagatagaatgaatggcataggtaggtactgagctccctgtaactggaggtgttcaagtgtagggtggatgggcatttatagggcaggcattgaggaaggatctccctgggattgtggatggcaggacaggccctgtggagccttctgagcgggtgcagaagagggagggcatgttcctgctccctgcccttcccgggttgccaggccgccactcccaacctccaccctctttccttccacctgctgggccttacgggatgggcagaggcattgttagaacatggagccgcggtccacagagggccagcagggaggagagctccctggggaccacgtcgcctcagtcactgtggtgactttgaaaataaatgctttcttctctgcttgagtccctgttgttcctgctgacgtggaactagggcaggctggtgactcagccctcatccctgcactgcatcggtggcaagttgcctccagcctcagaccccacagagcagggtgccttcttcagaaaaacagtagggaggccaggacaccaagggccccagggacagcctgtttctcctggctggcatgagttctagccaagcctcctggtaccctgggggtgaggaggtaccagctgtgtgctttagtcactggctgctttgaggctgggtcggtgccaggctggccactccttcttgtcccctagtgtgactttgcagagctcccggaagggtcagagggtttttttccatcactggtgtccatgggatactgtgtccccatctcatttttgtactccagtctcagacgggtgctaggaagttggagactttagccatttcacgactgtgtcttgcggggctggagtaggaacaggagtaggaggaacgctctggtcatgggactgtgtgaagagagaaggatcaggaagaaaacatgagctatcatgtctgggttatacctcagcagagccgctggtggcctcccaggcatctgaatttactaatcacaaagctcaccaggtgtgcaaataaacaaatgctgttcaggaggcacagccagggttctgctggagagggatcatcttggaggggtcatactttccacccagtccttcagtccttctgtcctgtgtgtgtgcagcccctgaccaccaccatccctgcccctgccacttgctcccagggttccatcaggttggatgttattgcaataaaatgtagcaacagaaggtccaggcagtgctgcagtccctggtggtatcatcagagccagcaggcagcagggctggggaactccaagctgattcagtcccaagtgccggagcggggagctcggatgaggtgggggtggggaaccggggagccatggagcagagcatttgctgtgctgaaggccaggagcctccttgggagatcatgaatttagaacactaatactttgtttaaaaagtcccctgccttggagataagagctcaggccgctgtggtcaggttttgctgtaaatgttctgcacaaagcaggctggggggatcactgggaagtctggggaacagattggtcatgtgcttctttgagtgaaaccttatggttgcattgaagcggccaggcagagggtgtgatggggtgtggtagctgcacaccggctcagtcaggctgaatggggaaatgcaaactcaggtggcctgaaagagacttagtggtccacagcctggtggctgctcccagtacaggtgatgtaaagagagaaggggttccgggggcttggcccaggtggaaaccatgcactgtctgtgatcctgggcatgtcgaggctggagcaggtctgcttggtggctggcagaacgcacatgaagaatccatgtgtgttctgaacgtcccctctgcccctttgggctcatgccccatcaggagtctcccgactctgccattctgcaaaggaaactgcgctttgtcattgcacaggatcgaacaggtgtgtgtggagtccctaaagccactgtctcaaggggtctcatgggacaatgggagagttgctgtgatgtttaagactaaagtgatggctgggcgcagtggctcacgtctgtaatcccagcactttgggaggctgaggaggatggatcacttgaggccaggagttcgagactaccctggccaacacggtgaaaccccatctctactaaaaaaacaaaaattagccgggcatggtagcgggtgcctgtaatcccagctactcgggaggctgaggcaggagaattgctccgatctgggaggcggaggttgcagtgagccgagatcacgccactacactacagcccgggcgacagagtgagactgtctaaaataataataatgctaataataaataaaataataataataaaataataaaagcaaggacttgaacaaatatttgcacacccatgtttgtagcagctttactctcaattgctcaaatgtggaaggaatggatatacaaagtgtgtgtacacacagtggaatatcattcagccttcaaaaggaacggaattctgtcactacatgtgaaccttgaataatgaaccttgaagacctcatgctacgtaagcctgtctcacaaggacaaatattgtatgatttcacttatgtgaagtcaaattcatagagaaattggaatgacggttgccagcagctaggggaaggaaggatggggagttattgtttaatgaggacagagtttcagtttgggaagttggaagaagtttcggaggtggatggtgttgatgggtgtacaatgtgaatgtacttaatgtcactaacatggaaacttggttaaaatggtaaatttgtcttttttgtttttgttttttttttttttgagacggagtctcgctctgtcgcccaggctggagtgcactggcgtgatcttggctcactgtaacctccgcctcccaggttcaggcgattctcgtgcctcagcctcccagagagctgggattataggcgtttgccaccacgcccggctgatttttgtatttttagtagagacagggtttcaccatgttggccaggctggtcttgaactcctgacctcaggtgatccacccaccttggccttccaaagtgctgggattacaggcgtgagccatggtggctggccaaaaatggtaaattttatattacatatattttatcacagtaaaaatgcattgctctattagaaaaatgatagatttttacaatatgaattaaattacaagttatgaaggaaaaattaagcaaaacattaaaaaattacttataagtaattatatttaaaacaaaagataataaatacacaactttcatcacctcttaggttttttgcaacatttaactattgtctgtcctgttgcggttatgttcttgaggttgtatttgtatgatagaaacactatattcgtggtgactaaacatctcttctcagtctcacctccaatgatgtcatacagataacttgaaattggccggctgggcacgatggctcatgcctgtaatcccagcactttgggaggccaaggcaggcagatcatctgagttcaaaaccagcctggccagcagggtgaatcctcatctctagtaaaaatacaaaaattagccaggagtggtggcgggtgcctgtaatccgagctacttgggaggctgaggcaggagaatcacttgaacctgggaggtggagtttgcagtgagccaggattgccccactgcactccagaccgggtgacagagtgagaccctgtcaaaaaagaaaagaaaagaaagaaattggccaaggcaggaatattgacaccacaggaataggcaagcgctacaaatcgggaaactgagtgttgttgcttttgctggccccaggtggccggttgttgaccgttaactggcacactactggaggagggaggttcagactgattcgcagagagactagaggtagaaacgcaccatggtttggatgctgagggtgagggaaagagaggagtcaacagtggtgcccggagacttggcttgagcaactaggtggatggtagcaccgtttcctaagatgaggggctgtgggaacttgaggggctgtggaaggctctgccactgacggacccagggctcggcagctctgggaggcctactttgtgtcaggccacgcagagataagaccatctgggccctgcccttgggaagtctctgtctatgaggacacagcctgccacctaatggggtgtcccgtctggagcctcagtgttgctgggagaaagcccctcaccttccttcgctctccgagcctcttttgcttccctgccagctgagcctctccatggaggctgtgcctggaggggggtcatggatatggatgtgtgcgccaaacgctgcttcctcgtggatttcctccccactccgttcccacgctttgtaagcttcatttccccggggcctgacctgtggggtttctctccagacctgctccttcccatttccagaaaggcgtgcaggggtttcctatggctctcttccctgtccccatcccccttcccttgggacagtgatctgctggacgggtgggctacccacagggtttgtgattgcttagacatctttgctgtatgaagctttgacctcaaggcatgatgcagatgggaataaggcacgagtttctcctggctgctgtaacaactgtcgaaactgggtggcttatagcaaggggaatgtgtcctctcacagttctggaggccagaagtctgaaatcaaggtgccagcagggccagcttcctctgaagactccaggggaaaacctttctttgcctcttccagcttctggtggccccaggtgttccttggcctgtggctgcatcactccggtctctgcctctgtcttcacaaggcctttttctgtgtctctgtactttcttttctgtctcttagaaggacacagcattgaatttagggcccaccttatcttgagatccttgcctaaattctttctgcagagacccttaaacagaatcaggtcacatttgaggttccaagtgggcatatctttgttttgggggggatcaccggcccactgtaggtctcgttgtgcactgaagacgcaggcggtccctttggccaggcctgcagtcggtcttgccttcttttgtgaccgtggaagaatgcaccttgctggatgcacaggcctttatagttcttttgttcttgccaaatttcagctcagtttcctctctgctgccggcgtgcatcttctctgcccagtgccccttctgggactgtgtgtccaggccctgaggccctagaaaaggggggtggagggcctcctcactatcctgtagcaatgaggcctcattaaaatcctggagccccagactggacccagcccttagctatgatcaaaggacagctcgggatatgattaaagggctagagaaagatgatttaggctgagaaagaggaggccaaggagcaactggattgtccttgaatgtggaaaaggtaattatgacttgaagggtggtgcccagctgtttcccatctcctctgaggacaggaaaaaaaaggaaataaatgatgtacaattagagcagttggttagatacgagggtgaacttcctggctgggagtatggccaagccctgatttgggtttcctgaaagagctcggggaacctccttacctggaggtttctaggcctggtcatgtggctctgagtgattacattgaaggggcagtggctggggctggagccggtgggctctgagcacagtcacgaaggcatgcgcactttctggctgctctcctgccattgtcccttgggttcccattttggtgaggcgtgcaccctggcggcgctccccagggaactaaatatgtttgctgcactgtgcgtggagatggagaatgtacaattggctgaccctgtgctaatctggtggaactccatgccagccctgggaaagaacaattgcatgggtgtgtccacactcaccaggtgctttttagaaaaacactcgagaataatgctgtggcttaggatggctgttgtgccggacccggcatcttcccaggggggctgtgttgttgggctgagtttcttaggtactggacccccaaatccccaaatacggcgtggacaggtggcccagtaggggctggactatccgataggcccaggtgctggagttcagacaagacataccctggcctggcgtggaagatacggggtgctattaatggcagcaatggctgcatttctgaaacccgggctcccaggccgacgagggtgtgcacgcatctgaaatgtctgtggttttgcagttcccatgtccacaaactcacttggttgaaaatagttcaaaatatccaaagcatgagggagggagtgcctgcttttcttaaaaaggaaggacttgatttcatctacttaaaaagccacccaaacctagaacattttccgcaagagaccccctgccccccgcctctccagaatggctggagagtctcagcactcctgcacatttgggatatttcagagggggtggggaggggcaagtgggcagcgagcgacctcagacccaggatgagctgtcaggcgctccccggccacacattcaagggaccggagtgcagttgtagcgttgcggcctgctgcttcgggggtgggggtgttgttccatgctgtgaattctcacatggcccctgactctgggcagaggccgagggtctaagggacggggtgacagggagagcatgcaggagtgggtttctggctttccagggcgagtggaagaagcgcctctctctcttgtaggtgacagacctggggggcccttcttgaggatgagagcctgttgcttctcaagttctgtgtctaacccaggtccccaggtctaccccagcccctcggccctgcctgccttgtggatgatatagtttaagggtagagaccgctggcctggagggaaggctaggcctcaggttagggcccagaagggagggagaagcccttggggcagctccctttctgctcactcactgcctagctccttccttcacaccttccttcggaaacgtctgctcctgacaaggtctacttcctgctctcaggaggcccttattgtggaggaagggaggcgtcgcccgtccctggcttctctgacagccgtgttccatccccgccctgtgccccttctcccggacagtgccttctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgaggggagacgggagtgcgctgaggggagacgggacccctaatccaggcgccctcccgctgagagcgccgcgcgcccccggccccgtgcccgcgccgcctacgtgggggaccctgttaggggcacccgcgtagaccctgcgcgccctcacaggaccctgtgctcgttctgcgcactgccgcctgggtttccttccttttattgttgtttgtgtttgccaagcgacagcgacctcctcgagggctcgcgaggctgcctcggaactctccaggacgcacagtttcactctgggaaatccatcggtcccctccctttggctctccccggcggctctcgggccccgcttggacccggcaacgggatagggaggtcgttcctcacctccgactgagtggacagccgcgtcctgctcgggtggacagccctcccctcccccacgccagtttcggggccgccaagttgtgcagcccgtgggccgggagcaccgaacggacacagcccaggtcgtggcagggtctagagtgggatgtcccatggcccccatccaggcctggggatatcctcatccgcctcccagaatcgggccgtgggggacagaaggggcctgcgtgcgggcagggagagtattttggctctctcctgtcttcggggtttacaaagtgtgttgggacttgcggggctgctctgtccaagcctgggtctggcgtccgcgtctctgagcctgtgagtgcgtgcgctttcctgcgtcctcttgactgccggtgctggggctctgcgtcctgcgtccgcgggagtaaatacagcaggcgaaggggaagctcacacaatggtctccagcgctctggggcagggcttctgaggggcgggcctgcctctgccgggacctggagcccccgcccctcggagaggctcctaggctgacttgggcagagccctctggtgggccgggagggggaaaggctgtgttgaaatgagcaaactgtccaggtgtcaggccaagctgggaggtgaccagcctgaggtcctccccgctccatggccagaaccagggctgacatctgggtgtcctgagcccagctgcccacacggcccacctggggtcagccctatctgagtgggggaggcggggcctcctgggggaccagaactttggctggacgccaagcagagtgccagtggctgttcttcagggctgggcctgaggagggtgtggggcggcgaagggacgggagggggttgtgatccagtggccactggcgctgtgcagagtgtgagctggaaacatcgtagttactttgtcagcttagtggtgaaagccctttttcaggctctatccctttgcatccctgcttcccagagggaggggaggtctgggtctgcagagctgggagggcttgctgttcccgcccccctcccccacaacacctcctcatctggacatctttgggcacatgctcatactggggtctccctaggtccactgtgttccgttgagcctcctgcagtccccgagtgaatgtgacctccctgcccctgcctctttgcaactcctccctgcgaccgctcctccaggggccttccttgtcccaaatgtccaagtggcacgacttagccggtctgaccactttccagtaagcccttatggagagaggccctgtgttgtgcagagctctcctcctgcctgcgggatcgaggtctctgctctcagttcctaacagaaagtgtcgggcccccagtgggatttctggggaagaactctcgtgtctcaacgggagccctgtggcgggaggggaggccagggtttggggttgtgttcgttgtacagctgtcaccatttgcactatgaaagttgttagtgccccttccttgggtctctgggtgtaactccacccttgcccccatgtgcctccatctggagctgcttctgcggctgtctcccaagccagttttgtgaccctgtaatttagtccaagacaatgggctcattgagaccatcctggtgcagcagttggcaatcctttggctctgggggaaggtttctcagtctcggggagtggggcctcaatctgctggttccctgtgtttatcagtctcccccttgtgtgtcctgaatggttttgctgggaattctggtcttagagccatcaggtggcccgagtcgataggcgtgagagagtgtgtgtgtgcatgagtgcgcatgtgcatgggggctgacctggggtatggaaaggtggccctccctggtgcccaaggagcctggagtatagttggagggtgtgggggtgtgtatatgggagttggacaaccttgggtggacagacagacgtggggaagggatgattgaaggaggtggaggagagagtgtgattcagcccagccaggggtgatgtggacaggcagcttccgaatcagggtagagaaaagtcaccactagctagcaggggagaagtcagtatggaggaggcggaccttgagggagagtaggaattggattgcaagaggaaggagagccttctggccagcagcagccagcagcagtgggggaggctggaatgagctggctggagagggggctggggcataaggaggggcctgcctgtgaagatcatatgggccaggctgcggagggccaggcatgcccgccgggagtgcagctggtccacgggaagcatctggagtggctgggaatgggcgcaggagcagcgccgtgggagcacaggtctctttcccggggcggctcacctggtgtcttggttcctgcaaggtaggccgaaagggtggggaggaaactgccagctccttacagcgctgggatggtggccccagggttcctgaggccagcggatgtgggtgcctgtcaccatgtgggttgctgaggggcggagactccaggggccaccccaaagcaggacgagctctgagccacggcatctctgggggcagttttccaatcgagcagacgtctaggcctggaatcctgtaacagaggccacagggccctgatcagggtgttctgggaggcttagaactagtggcagtatacagggtagacggcaagtgacctggcatggggaaagaggcaggtgcccaggccggcacagcacacccgtaaggaacaggtagacgggaagccgtccgtgggcctgtgtgtgtgctcggagttaaaattctgccaatgtcccatgtcctgggcacatctaccccctccctggggagcacctttctcttcaccttttccttccccgcctgtccccttcacccagggccttccccatccctcccgtcttggggaccgagggcaccatggctttatgttccatcaccgatgagttgcacagggattcagtccttccgctgttcaggccgggtccttcaggctcagggttcccaggaatggagagggtatcagtgtcttccatggactcaaacttcccgcatcccgcctttgctcccccttcaagataggtctccgagcttcaaggttttagggctctgtggaggccgccacgtagcagcaaggagaatgttttgtatttggctgatgagatttttagagtctcattttctacttttccactgtacaaacgggcctccaggcgactgcagcacccgccactgcccgtaatagggtgacaagagggatgaccctttcctctttctcccttctggttggtggaggcacggggctggcggacggcatgtgctttcgtgaattcaggccaaatctgttatcgcaaacacgattacaactcgggtctttgtgtaacaaaagcctttccaagtaccagctgttggcctgctttgctcagcggtgtttgctgtaaccagatttgcacaccgagaaagaatccaaaagtccttgatgtttgttgaaacaatctggcccaggacccacgtgctcagatcccagagctgtgtggcatctgagcttctcccgagcccccactgtcgcccgaggaggacccccagatctgtgttctggaggcagagcaggctgtgggacgggcttctgggtgggaaggaccatgtggatatgccttcttgtctgagagtcccaacacctccgggacgtgggagctggcgcgctggcaggattcaggtgcctctttcctctctagagaaaaaggccccgttgcttggtaataggtgcagacctgtccctaattaatgccagtaggcctcttgcgtgatgaaccctgcctttcagccaagactcaaggcatcctgtgaatactgcctctctgcagtttgagcttttgtggtgggaggcaggagccatggggagtgggggcaggcctcttacacgggtcccacagccactggcagcactgacttgatgctctttgagttcagagcccagggccagacagacccactgtcccgactacgagttggttcatttagaggggggcggacacagcacccaggcagcagatgcactgtgatcagccttgcagcggggctgtgggttctctgggctggatgtccgggaagaggcaggtggaggtaaacgccaggacacccctgcagtgactgggtgactgcaggctggaaatgctttctgtgggctgtggctgtccaggaaggttttgaatggggctagtggacagagtttgcatccagaggggcagtgctttggaggagtgaggggtatggcagtgtagggatgcccaggccgccctcactctgccattggaaagctgggcggcttcggtttcttcagtttcttcgcctgtttccctgcctgcaaagtggggttagaaacagctctctttgagggttgctgggggactctgagatgcagcccatggcgctgagcacgggtcctgcctcctacgggtgtggtgggtgtcgcggctggtgtggcatctgggcgggaaaagggggcatttgcaaaggacaggtaggtttggatgcttaaatatgcagatctggggatgggaggtctcaggcaagggcctgtgtgatgccactgtatgaatgaggccggacagcatggtcaccactaattatggaaagcacggcagacactagtgccagtagcgcccgcctgggggtccctctgagcccgacaggtactcaggctcccagtgcagccatgggaccccccttttcctgcctggctgacattctggaggctggcgtcatgttggctgcaggttcctcttactgggaggttgtcctggtcttccctgccaccatctacccccacccccaccctggagtgtcacagatgggtggaccatatgcccatctgcagggccaagcgctgacaatgaggtgagcacttgctggatgaccggaccatgaggacagcgggggcgctggcagcctgcgttcggctctgcaggctggcctttccctgaaaagcggttgtggcagagtgtgcatcccagggagtggtgcctgctgccctgaacattctcatccagcaggcctctgcaagggcccagtcaagtgtggtgcagagctgggctggcagctggaacagtctcatcttgtctagtggtgagaccaagggctgatgggccaaggctgcgtgctgcttgcccagcccgtggacccatccactgagcacccccatacccctacactgggcccggggtgtcaggaggtggaggggggactgggtgcctggaaaaacaagcccaccgagagcctgagcccccaggggtcagtatcaggcagtcaccacggtgcccggtacacagtggccacctggtctcgtcggctgtcttggtggtggagagcgtgcatggtggccgtacgtgatgggcatcacccagggtaatacagatatgcagactgtgcatttgtctgtaggagccagggacttctcagcctggcaacctgtgacctctgcctacccgttgggagagaggtgctgttccctgatagcctggtgccgggagagcagaactagggtctcctcctcctttctccacctcccatttcttacatgcccaggcatcaggggaggtcacactcagggatgagtcttggccactgggttcagggcctcactgttgccatctcttccctttgccagccagccaaatgcccgtccatcatcgtgccggggatggggctggcctgctcctctgaagtctccttggtgtatagcctaggctggagccccggacgattccgccaccccctcccccgactttttctttttattttgattcatcccagaaacccagccaaaaaccaagttcctgtgctctcccttgacaaagccactgaggaaaaatggtcaaacactgcctttctttccaaagccctcttggtttttcccaaatttggaggctctgagttgcttatgagaccaaagggtccggaactctctggaacacagtcccagaagtgggaggatttgtcatctctccagccaaacagacccaccagttggcccctagacacccccaggcgcctggggcatttctgggctcaggctgtttaatttggtctgcagagccccgaggctccgtttagactgggccagcagacagttctagagacttcaagtttgttgtcgtttttaaaagtcctgccaatgcccagaaacttagagggacaagaagatgacctcgatgtcagccgggaccataaacagtgaggcccgcccccccccccacccatgcctgcctccactgctcccgtagctgggtctccaggggattgcccgtggccatgggggaggccgggaatgcggggctcagactctactgggcttctcgtatttttttgtttttccttgtccatcttctttctcggaaatttctgaatatccccctacagcctttggcattctgtcactcctggcatctctgggccaactgggaaagccatcatttgtccaatatccagaaaatcaaggggcctggccttaaatacattgcagtgccctcctccccacatggcatcgaatttcctgtgtcctcaaagccaggagcctgtgccttggatgtgggcgatggagccttgcagacacctggagcggctttcctgggagagtctccctcgccttcccatccacccgcttcccctcccctgccccaagctctggtcacagcctcggaggggtcatctgagtgtaggttgcctccaggtgtacagttggaggggggcagttaccccacatccccctgtctgctaggggcacccccagggactcaggtcttgagggacagcggaagggtggggtggggagtaggccgttgtctcgtgccacctgggtgttatgtagactctgaatgggcagttcctgggagctggtttttccttctcaccccttctacagtgctgcccctctgaggggctggagctctctggagccctttgcagcctgtggcaggtctttctgattctgtgcctggtttcgcagcctccaacccatagccagtggcatgaagaacattcctggctgtctctacctgtggcctttgcaggcagcagttccctggggcagggcctgggggtcctggcacctccttgtgggaccccttgggtatgagggagggagccacctgggccacagatagacccccttcctgtatccaggaggttcaggatggacctgtctcatctttctttctggtgggaagagagcattcctggccatggggaatgtggcctggacagagccacctagcctctcccctcccccaggcagggccctgaaagatggagatggctctgctcctgccaggtcaacagccagcagtctggtggatttccatgcagtccaggcaggatctccttctgtccccaccccccaccccatgtgcaggaagctggttccaagcagggacccttggccccgctttccacgtgggtgggcagtttccctgcgaggggcaggccaggcccctgccctatgtcccccagagaccgatgttatctacagtaagagcatacaagtctttttggctccaaaccaggcctggaggggtggtcttctcctctgtcctctgcctcttgccccccattaaaggtcagggaatggagtgctctgtatgtttgctggggttgggttttttcctttggtttaaaatgaagggctggaatccctggtgcagactgcacggtgagaggtgctccttgggatccactcgaggagcattactgctgaatgccctgccaggccaggagcatcgctgggggtgggagaggcagttggcttatttgtttatccaacagccatccatgggtaccccaagggccagctctgttctaggcactgggggtctaggcatgggctcaggagaaggggtagaacgggagggcttcctggaggaaggcttcctaaccagagaccggggtaggagtttgccaggcaggtgatgctggccagcttctcttgccattttccttttctttttttctttttctttctttctttttttttgagacagagtttcgctcttgttgcccaggctgcagtgcagtggcgtgatctcggctcactgcatcctccgcctcctgggttcaagcgattctcctgcctcagcctcctgagtagctgagactccaggcacgcaccaccacgcccagctaattttttgtatttttagtagagacaaggtttcatcctgttggccaggctggtctcaaactccttacctcaggtgatccgcccaccttggcttcccaaagtgctgggattacaggtgtgagccactgcgctcggccttctcttgccatttctgcagactcatagtgtgtgtggaagactgtatgtctgtgcctggcacagctgccctcggcactcaggtgggaggtgggggagagggctgttggtgccagcacaggtcatggcatgagacaggctcccgcagccaagcggggtgcaccgcagcattggaggggccctgctgcgcacgagatccaggctctgcatctgtcctcctccccaggaggcctggagggctgggagggaccagggtggtgaaataacccaggtgggagagaggcactgttggagaggcagagggagctgcaggtttgtagcagcgagctttaaaccctgggcctccaccagaaaacctcagaaagggctgctttgcttttttttctaaactacaaaagaaacccttggccgcctgggccccttggggtcgggtgggggaggagatccttcattcgcacctttgcaggcccagtactgtgcagagggaggagggtggaggcaaaggcgagggaggagggtggaagcaaaggcggggtccctccctagccccgctgccctgcctggttgctgctctcagacccctactcctggcccggaaacatggaatcttgggacagctggggtagggggcacagaacggagaccctggtgagggaggaactctttctccagccctggctgtggccacagcaaggccaggctgggaggacctcactcaaatatttacatctctcctaatatttaaatgatgaagcaggctcctgcacacagctgccctggagccagctgttgcctgccctaccctccctctctccctccctctttctttccctccctctttctctccctccctccttctctccctccctccctcttgcattctttgtctctgacccaagtccaggcccttccagctgttctctccttacccacaggcacctcctgtgactgagcttctccttgttatttttcataaccatttcctttaattgagcacctcctaggtgccaggccctgggctggtactttgtatacaaggtgtcttttaatccccacgagagcccaacaaggtagattgggctgctgaggctccagcgctggaaggccggcccgggtcctcccagtccgcacctgcatccatccatcactcccccactgtggagacctgttccctggcccctggctgagcacgatggaaatctctgtctactagtccttggagagtggggatggctgagggtcccgaccctggggtctgacgggggctgcctctgccccacttcagcctggctgctcttccactcaatgactgagtttgcaaaaccagaataacagtgctacctggctggtactttgggtggctgggaggcgtgggagagggtgcacggaggggctgagcgaggtgtcagcatcgtggggatctccgagggtagccttcccaggcccagggcggagtgtaggcagagggcgcgatggcccagcgtgccggctcacatctggccttgcccttgcccacacggcaatgtgggggagtcatcagcctctcagtgcctcagtttcccatctgtgcaatggggacaagagtaaatcactgtcttcaggtatggtaagcactcatacacattgactattgcagaatgaacacagtgagcccttcttaggcttctactacatgccaggcagggtgccaggccctagtggagaggggacaatgatgggcaagctggctcctgccctcaagggctgtcgagcagggaggaaggcggcggctgccctgactgtgacccggagtggggtgattcgcaaagaggctggcgggaggctggctgggggctggctgggggctgctccctctcctgcctgtgttccgtggcagggtattaaactggcttttttcatggatttccgaggccctgactgtgggacctcgggcaggttttgggaccttgtgactttgttcccgcttgtcattcaggcctttgtcctcagcagtgcccagcacacggcgacttctgcatgtccttcagtgtgtgactgaccctggagctgagacttggcagctgaggctggacattgtccttggataactcccggggaggtgggggcagggtggggctgtgagctggcaactccgagtccctagcagcctccgaatggaggctttcctcttgtaggattctcggggaggaaggaggggatgggggagatgaggcttgtgagtcttcaggagggcagaggttcacacctgcagcgccccagaaacactccggggtgcccaggcttacccagccctcctgagccagaaccaccaagagttggggaccagcagtccattttttagcaagatccagaaatgattctcctgaacagtccgagccaagaatgacatatctggaatcagaacatcagaactacagaggaatcgagagaacgggcccaaaatgtgtagggacctcagccacatggcgccacatggaggaaagcacccaacatcatcactgtatgaacctgtttaaacacacacacacacacacacacacacacacacacacacacacacactccccagtaaagagtggaaagacatttgtcagaatattgatggaagttacctgggttgtgggtttatagattttttccctttgtttttgtgcattttgcaaattttcggctttgtgcctaaattccttttacagtcaggaacaaagcaatagatgttattttttaaagttcatgggctcgtgcccgtaatcccaacactctgggaggctgaggcaggaggattccttaagcccaggagtttgagaccagcctgggcaacatagggagacccccacctttttttttttttttttttgacagagtttcactgtgtcccaggctgaagtggcggtggcacgttcttggttcactgcaacctctgcctcccaggttcaggtgattctcatgcctcagcctcctgagtagctggattacagacactcatatttgtaggatttgagaatcctacaagaggaaagcctccattcggaggctgctggggacttggagttgccagctcacatattttttagtagagacagggtttcaccatgttgaccaggctggtctcaaactcctgtcctcaagtgatccatccatctcggcctcccaaggttccaggattacaggcgtgagccactgcgcccggccatgggagaccccctcttaaaacaagaataaaaataaaaataaataaaagtttactgtcaaaaagaaaaacacatcacccaacctaatctccccctaggattgagagatgaggaagcagaggccggaaagtgtcacattccctggtcgctggcagtcaggggacctgaggcctgggctggttttctcgtgctccaggcctggggtgtcaggtggagcccctgctttgcccaaaggtctaggtgcctctgccagcactgcttgcttctgcatttttggccacaaggaatgtgggccaaaggcagggtccttgacctctgcccaggagggtgaagtgggctggtcctccttgtccctgctccaaggcccctgcggctgtgcctttggaaactgctggcccgagctagtgtgcggagctgggacagacctcaccgtggccctcgtggggtcattccatgtccgggctggaagggatctttcggtccagcccttcctgttcctcatcaggaaactgagaccagagaggtcatctgcctggcccggggtggggtgtagatggcgcttgtgactcctgcatgccacgtgcagacagtccctcagctgtgggcttcccacgcaagcagccatgctggggataacttggctgaaacctgcgatttaatgaagagaagaatgactcctcctgcagccctgtgccccacaggctccctcctgcccccacccctcctgcagaggggcctcatgctggtgggtgggtccctgttgctgcaatgggcccaggcagtttctgggcagtggaggcttggctgtcttcctgcccaatgtcccctgtagcccacgctgtccgggaagggcggggaagcactcagccactggggacttcacaagatgggtatctgggagatgctgattggcaggccaggctcccgtggcccacaggcaggtcagaggtcacagtgctgagctgggctgagttggcagctcagggcagtgggggtgggggtaccttgctcagccatgggcctctctggcacaagggtttggagtttactgtaaacaactccttcagtttttccttctctcataggccaccagcagaattgaggggccctctgttgatgaggtgtggcctgggaggggctagttgtctgtccacctgatccttgcggacaggtgaccacaggcttcctgccccagggggctgggggaaagatcggggaggcctctctggcttccccacttggaaggaaaatacgggcataggggagacactttacagggacacatttcagccagtaccctctggctgtgctgggggcacagtgcctgccctgcccacaagaggggtcagttctctccaggatttaacttcagccttcagtgcagggcagatgagcactcagaggcccagaggactcatatcacgagagagaagctgtgaccacacaggcactgaaggttaagcagaagagtgggacacacgggtgacctgaaagtcccagggtcagtgtggttagccccagatagctggggagctttgggtaccaggcttagcaggggaggagggcccccgtgacagtttgctggggctgctgcaacaaagccccacgaactttgggggctgaagatggttctagaggccagaagtccaaaatcaaggtgtcgaccaggctgatcctttggggcctctgcgggaggctccggcccaggcctctctcccagcttctggtggctcccgggtgctcctgggcatgtagatgcgtcacgccactccctgctccgtcttcacatggccttttctctgtgtctctgtgtctcgtaaggatgcttgtcattgcatttagagcccaccctaaatccaggatactctcctcttgagatcctttattgcatctgcaaagaccctattccaactcctgtcacattcacaggtccgagggctagggctctggcatgtcttttgggggtcactattcagtccactgcggcagctgatcttaggggaagcagaatgttctaagcttggggtgagcggagggaacgctgctgggtggggagtgggagaccaggctcggagacaccgcggatctcctctgtctgatgagggcgtgatgaggttctcatctcaggtcctctgaatggcggctgcttctgaggagaccctttcccctggatctgcccctccagaaacctccacttaggtccaggtcccaaggtggatggtaagaggcggctgtccctgccacacttgatgggtgagtgtgtgaacggggctgggagcaggacacttgtcacttctgtggacagattccagaggctcatgaatctgctgctggggaaggtgcctgatctagcctgaccctccacccccacctcccccttcccgccccccttcaccagccctgttcccagagcttcacttccccaaaggcaggcgccgtttcctggacttctcagcagctaccccctaccccagacccctctcttgtaggcccctctggtctcagcgcctactcctccctgggcttctgcccctctaccgtgaggcttctgggcagaagtgtggggccccctcgctgtgtctggctctcgcggtataccaggggtcctcccaggggcccgccctgcccgctaggtttccagggagcttttcaagttcttagatgggcttgatggagtttcccaatgcgttgtctcagagcaggaggggccccggctgagtccgagagtcccctcagtcacaccctgggctgtttggggcagccaggcagcccgtcttctggaggtgctgcctctctctggttaccccttctggaatcttctgcgtccagttgcggcccctcctacacagcacacccaccacccccttttacctgtgactcttctttgtcaacctcttcatgtctttgagaatggagaccaggtcctcctcaccctggagttcagcagaacctaaaccaggcagatccgtgtaggttcacgtgggggctctgtggccactgtggctctgccgtcacctccagcccagcttggcgcgctttggatcatgtcattcagtgccggtcctccaaacctctcccctggctctgcaggtctgggaagcagctggctcctgggtgcagctgtgaccggagcctgaactctgctccctggggtcaccgtcccctgtaattaggctgcagctcatattggctcgggcagaggccatcggctgcccgccttggggccacaacacagagagccccgtgattaatggaggctccacctgggccaagtggcccctggtgttaggcgcttttttttttttttttttttttttgcattttttaagtgcttgtaacatttcccctaatggacaatgagacgaggagggagggaggggtggcttctctgcccaggcagatcaggaatggtcaccgcctgtgtgtgcagtgacaggtctgggaacagacaagggagagcttgtccgggaggctggaccctcacaccgatgctgcctgtgcctggcagctctgtcccgggcctcagaacagacactgaccaacacgctcctcagggtctccaggtccgggtcctggtccccggcagagcttcccatccatgggaagaagcaccgagcagccttgctggctcctcgcagggagctgggatgcatttctaagagcagcatgcgtgaagcccggggtctgggcaaaggagtgtttggggaagagtctgctgttgttggagggtcggaagtagaggggaaggaggggcacgcggtaggctgaggaggtggctggcgaccctgtggtggggacgagggggctatgagcagaccaggagccagcatcacgtttctctgtctccagaatcgaggacggagagctgccagagaggccctggcggggtgtctggggccacctaaagggcgtgggtggattaaagctgaggaaagcctcattttgggggactccgtacttaacctttgaggccctcagagctgcagcctgtggtttttcgaagtcaatcacctcccagggcctcgctcctgccttcagcgacagccatttatcagggagtctttgacccaaggagacctgaaaggtcatctggtccctctcctacccccaggcaggccacacctagaccctcccacacagatccgtcccacccttctgctgccttccaccagggacggagggtgggcggccctcccacccaggccctggcggccccaccccagccaggaaattcttcctctttatctgcctcacatctcttcccctgcggcttccgcccatttcccctcaatctgctcctagtggagcagccagcagctggtttagaacccgggggtggggggagcgctagaccagtgcagcacatctgagagtgtgccagaggtgctcccattcccatagctgatttagtaaagaaaagaggaagtccagcaacttagcgccactttaaagtccgcctggaatgaccctgtggctgccggaaccaggggcacgcggtagatgacgggagcaggcacagagaggccttcgtcccggatcagtcgctgttgccctcttggaggctgggctgcctttcaagaagaggacccaaggccctgtgagcggtggcctcctctggagcctttactgtggtcctggttctgctctgcgtaaagagagatggcttgaagcagaagctgctacgtggctgtcccaggcaggcgcccgtagtcccagctactcgggaggcggaggcaggagaatggcatgaacccgggaggcggagcttgcagtgagcagagatggcaccactgcaccgcagcctgggcgacagagcaagactccgtcttaaaaaaaaaaaaaaaaaaaaggagtagagaaatctttcccagaaggcctgcagtcacctccccttcatgtttcagaggtaaaaaaaaaaaaaactgcacatttcgctttttttttttttttttgagacggagtctcgctctgtcgcccaggctggagtgcagtggcgcgatctcggctcgctgcaagctccgcctcccgggttcacgccattctcctgcctcagcctcccgagtagctgggactacaggcgcccgccaccacgcccggctaattttttgtgtttttagtagagacggggtttcactgtgttagccaggatggtctcgatctcctgacctcgtgatctgcccgcctctgcctcccaaagtgctgggattacaggcgtgagccgccgcgcccggccacacgtttctgttcttgaacaggtggctccctgaccctgggtgtggttactccaagaccttgctctggtggggcacaattctggccccaggtagggcgaccgtataacttactgtcccttgggggacacgttagtgaaagggacccttgaatgactacggtgggacaacagatgtgagctgggtttgtcccaggaaggctggatgtatgggcctcttgagccagaggagacaacagcagaaagctctgcggctgatgggaccgagcaggagaagggccggcggaggctggggcaacaacgcacttgcccactgtgaagggcctgtgtgagctgatggctgatgagagggcagtggggcgaggctgcctcctgccaggctagaccagctccaggacacccatatctccttttcagaaccggtgactcagtggctagaaggggcttcagaattgacgggacactgagggagtcgaatggaatggctggagtggccacagcaggctctaggcctcctcccgtttcttttctgtgttctgttcctggggtctatatcctggggttgctgtaacagagtgccacaacctgggggcttacaaacatagcttccggcggctcctggagattcctggcgttccttggcctgcagacgcatcaccatcatctctgatctctggcccctgtctccacgtggctttctccccctgtctgtgtgtctttctccttttctgtcttttataaagatgctcaccattggatttagggcccactaaattcagaatgatctcaccttgagacccttaccttaattacatctgcaaagatccgttttccaaatgtgatcatgttcgcaggttccaggagttaggacttaagacatatcgttttgggggacactgttgaacccactacatttaataaacccagagttggtgccaatgtcccctgcggacaccatagcagattctggaggttccttgtaaaggaatccgtaggacttcttttcccttctggagggatgagactgtagctgggctggggaaagctgctggttcaagctggggctggttcagctggtgctggcttgccaggttgttagagagctttatccagggagaaattaacatcacaaagttgggggataagagaaggtttggaatcccaagggctggctgttgaggtcagctgcccacccctttgtgttccatcttacagggacccaggcctgccagtgctccgtttctggaaggaatgctgtgggctgctgtgccccataggcagggtggagggtccccttgcagccagcgagctgctcttcctgtagcgtgcagagggaaggaggaggcttgtttatttctcttggcctcagccgaaaatccaaccacaggctctggcactaggcagacctgctcattctcacatcatcattgcagagtgagccaggcctcttgggtggggctgtgatgagcaggaaggacctccggagtgcctgggacttcttgggcccagggttgccagaggcagagagaaagaagcctcctcctaacacttgagcaaagatagtcatcagaatccatcagagtggcctcctgtggctcttccctgggtgctgacccccctggtgcatttgaagttttcagggatactattgacgctccctgcacctccatccaggggttagtggaaatggttcttttcctccttgtccagaggtactgtggatgatgaccccaggtcccagacctcagtcattgggccacgtgtgcagataagcctgggcagtcagtaacctttggccaccaagctggcctcctgcggactgggccggcactggaggcgggtcttagctgctagcactgtggcccagccaggcctggccttgggaaggcagagggggaggggactgggaaagggattgagctgggggtggggtggtaccctggttcttccctcccagacctttggcaggtttgaactatctggctgcggctctctaaggagggagcgcctcctccgccttgatgtggactttgccttctgttcacgttgtccctgtccctaaacaaatgtggctctctgtggggagcctgggggccgccctccactgacactgctgtttcctggcttccctttgcaggctccgctcagcttcactgcgcctatttttaagcctttccttttggacggttttgcttcctgagaacacacccctccccatcaccccaactgtgtcctcctccctatccggagcctgctccacctgccccaggagccacctccctcctccaccaagcagcccaggccaattctggagggctaatttgtgtccctccagaagcaggtcctgagacagggatttcagtgggaggggacaccaggggatgcctgagtgtgggaatgggccaggcagggaatccagccaataaagggtgcctcaccagctcattgtgaccacaggtggctgcccagcccccataccgggcagcatggggagactgcagaccgtgcccccagccttgtcccacctggggttgggtaagggagctggggtttttatacttcagttcttggccaaggactgcactgctcactccttccagccttccgagggcttgggcactaggaaaggctctgggtggagacacggaaataggccatgtgaagtcagtgggcgtgattggtagcagtaaggccaggacagccttggtcaccagcaaggtgaccacacatttcagcatgcacagcccccacagacacacacccaggagatggtaattacaccagcaacagtcacccctgccgcgtgccatgcctgcacccagggaatcttattttttatttatttatttatttttatttgagatggagttgcgctcttgttgcccaggatagagtgcaatggcacaatctcggctcaccacaacctccgcctcctgggttcaagctattctgcctcagcctcccgagtagctgggattacaggcatgcaccaccacgcctgactatttttgtatttttagtagagatggggtttctccattttggtcaggctggtctcgaactcctgacctcaggtgatccacccacctcagcctcccaaagtgttaggattacaggcatgagccaccgcgcctggcctcaggggcaccttattaccccatcacctcctacagcaggtgacactgaggacactgaggctcagagtagactgtggttatgtcactctcctgtttggttctcctgctctcagccctgaaataaagagcacggtccctgtgcaggcccatacgtcctgtctccagccctggagcagtccttaagctccttgaaggcacaccaggcctttgggcctcgtcccccaagtcctggataaataggaggtgaaggagcctttgcaactggaccccactctgccagcgccaaggccctgcctgactacccaccccaccctacacagatcagggacctgtgccaaggtccagtgtcacaggagagtgaagacaaggaggtgcccatggcgtacatgctgctggactcactctgtagatcctaagggttatggggagttatctgccaggtgaggttttcccgtggctttttcctgcaggctcagggtagcatacagggaggtgcttccctactccttggcaccatctgtccggcttccctgagccctgaccctggctcctagatagccagtgtttcttcagggacagaacctgctttgctgctgctcagaggagacccagtttgaccagggctagcgttcctggaacctgagcctggaattccaccctgccctgggcagaggccacgttgctccctcctacgagagctgagctgcgcatgagattattctgaccttgggctctaccatttctttgcatgacatttgtcccaggctggagcagggctctgtggctcgcttggtgttccctccccagactgaggcctgatatgtacaccaggaagtgcttgatctggtttcaggagctgggagcggtttgccaggcagcctgtggtcagagcaggggccttaacaatggtcccttgtgcggcacattcctctctaaataggcccaggtccaggctgctcctgtttcgaccccgccatgggcctggaggggaaagtttgcatctggagggtggcccactgtggcctctttttgtgtagcagctgagaccgtaggtgcttgagaataggagaagccctgtgcccatcctgggctgtgagatgtttttccagaggtggggatggggatgggccagcatgcagttacccacaccctccagcttgttggcatcaaggtctgtgtatgtgtgtgtttttttttttttaattttgtttttccaacatggagtcttgccatttgcccaggctggtctcggactcctggctcaagcgatcctctagcctcaggttcccaaagtgctgggattataggtgtgagccaccatgcccagccagtaccaaggtgtgttttttaagagcaatattggccgggtgcagtggctcacgcctgtaatcgcagcactttgggaggccgaggcaggcggatcatgaggtcagcagattgagaccatcctggctaacacggtgaaatcgtgtctctactaaaaatacaaaaaaattagccagacgtggtggccgggcacctgtagtcccagctactcgggaggctgaggcaggagaatggcgtgaacctgggaggtggagcttgcggtgagccgagattgcgccactgcactccagtctgggcgacagagcgagactgtctcaaaaaaaaaaaaaaaaaagaacaatatcgatggttttattccctgaacatgctaagtgatccccatgtagtataagcatctcagaaggcaggaaaatgtaatgaacaacacccaccgccattcattccatccagagatcgttattttctgcccgggtgtgagtgtgtgtgtgcgtgcaaactgcacatgtgtgtatgaaatggaattaggatctttgtatacatcttgtgtcctgctatttttacttaatattctcggcatttctcatcttcaaaaatgtgattttaatgatggtgcaggcctttgacatatgggtttagaaaatctgcggaaacccggactgtttccaggttttgtcagtttaatgctgatgcaaatgtcctcgtacgtaaatctttctgtacttctgattatttccttgggataaattcccagaagtgggccaaagcacatgaacggtcttcaggcttttggagcaagttgagatcggtggggattggagaagggacccagggaggcttttgggagcttgcgagattggagtctggctttaggggacttgaattcacagatgaaggagatggctggcaaaggtgggaacctcctgctctatgggtgggggggtgacactgctttaccttccagtgacagcatggggatcctcccaacatgacctggctccgcatctttctgacactgtgcacggtccacagttgtgatgctcagctgggagcctcttctgtgtccttcagttgcattaactccttgcagacagaggaggaagctgtccggtgctcctccctgctgcgtgggtcctttgaatctgcccagttgggcctgtggatctgtgcagtcacgtacggggttctaaaatctgcaaaatgacaagctcacgaacactctcgcttctgtgggtgaatgtggataccccttggctgcgtctccctccacagggaagatggagacgtgtaaagtgacaaggacctgctacccctgggcaggttatgccggttccactgtgaggatggtggcagggggcttcccaggaggcctgcacattgggaagagaggggcgaccgtgtgtgactgcaggacccagggcgcagtcttaggactctgatgggggaggagatgctggggagccctgttctgccagcctggtgacagacatctcctaatgtttcccggctgggtacaactcacaatgtcctccgtggggaggcaattgcccatgaggcatccctggcagggatgatcttgtttcattgccacatatcccagcaatgaaacaagaatctagagtgatgtgattcctccgatgacttctccaaccatctggggtttttgtgcgactccaagaagggggaaggaggcagctctcgctcctctgggctcctgatgtggcagctctggaatggccacgtgtccgttggcccacagtgggccatttgtcgaatgtggttgtggtgggattggggctgggctggagagtgggtgaccacaccagctagcctcaccctgggccactgtgcagccaggggtttcatcttcccaggggtctcgttgtgagtgtcctggggctgctggaacaaattactggaaaccaagtggcccaacaaagattgattcgctcatggttctggaggccacaagtttgacatcaaggtattggcaggaccacactccctccgacagctcgaggggaggacccttccttgcctcctccagcttgcgttggcccaggcgctccttggctctggcagcatctgcagtctctgctctcatcacgtagccctccccaccgtgtctctttgtgtcccaagtccccttctgcctttctcctataaggacaccgagcactggatttagagcccatcccaaatccaggatagtctcatcccgggatccctaatcacatctgcaaagaccctttttccaaataaggtcacattcgtgggttcttggggttaggtattagacatgtctttttgggggtcactagtcaaccctctacagaacctcagacgaaagtgaatcttcacaggctgaaatgggggtgaaggtctagtgcgtccctcctccttgggagctccctcagggcttgtgcctatcctgtgatcctgtgatccagccttttttttgagatgaagtcttgctttgtcgcccaggctggagtactgtggcacgatctgggctcactgcaacctctgcctcccgaatttaagtgattcttctgcctcagccttccaagtagctgggattacaggcgcccacccccatgcctagctaattttttgtgtttttagtagagacagggttttaccatgttggccaggctggtttcgaactcctgacctcaggtgatccgcctgccttgggcctgccttggcctcccaaagtgctgggattacaggcatgagccaccacgcctggcatttagtaggttttggttgttttttttttttgagacagagtctcactctgtcatccaggctggagtgtagtggtgtgatcatggctcactgcagccttgatctcctggcctcaagtgatcctctcacctcagcctctcgagtagctgggattacaggcatatgccaccacccctggccaatttttgtattgtttagtggagtcggggctttgccatgttgcccaggtttgtcttgaactcctgggctcaagcgatctgtccaccttggcttcccaaagtgttggggttacaggcgtgagccaccacgcctggcttagtaggttttctagaagcgcctgaggcctggtgaaggcatggtgtcatggagtagagaacattcaactctgttcccggggagccggaacacacccctcgtagccaatctcaacagtcatgacgtggccaggatgacatggggagggggtggtgtggactgtgtgggaggccagctccccgggaagggggctggagtgggcttggctttgaggaggattcccaagaggaggaggaggcggtggcatgctcgtttggggggatggcgtgagccagggtgggcacctcttcatttaggtgtcaccttcttgacattccagccgggacatggtttccttggggaagatggacacccccagagtggggcatctcctggggaagatggacacctccggaatggggcgcctcctgttctcactgttcttctagcacacagttgtattctcttgcagttctggaggctgtgagatctcctggctgttatctagaacaaactcgcctttgagcagcgccgtcctgatggtggggtggcccctgcgggtggaacagcccctgctgtctcagagcttactgagagctagtgggcatgggagtggtgctggaccgaaacacccagagggatcatagagccaggcagtaagcacagaggccagctagtggggagggagggacccatccatgaaaagacaccaagcattgaaagagaggagaggatggttggggaccggcacacatgtgcattttgcgcagatggccaaggtggtgaggcgccagccacgcagacaactggaggaaggaggagtgccctaggggaggggccagctccggttctagaatgatccgcttgtgcacgtgggcctggctggaataaatcattgcatccgcaccgtagactcaatcgtaagctcacaccagggcagcctctgctttggtgcagtgtcttcgatcatgagttggccatggtgggggtgactccaaggggactcccaaggagggggttcaccggatctcccagggaaggtcatttgttttcttgggttggacctgggacaaggccttctcctgtctagtttctgttctccaacttgaccgcacggaaggatgctgaggacacctggaagccggcccctgctctacagcacccataggacagaggcacaccatgtggggacagtttggacagtgctcaggaggcagggagcagatcagaggaccgcgggaggccctgggaaccgcacgaggacccaggcattgagctctgcactttctggcatcagcccgatgtacagtctggctctgtgtctaccccgtacttcactttccccatctgtacgggggcggtaataatattctttacagcccaggtttaagcgggtgtagatgtgatgagcttggtaagcccatctcattacattcagttctgggcattgaaccctggactttctggctggtagaagtggacattcaacctttccttggggccctggggcttctgcagaatcagaacacagccagcagtttgcatgcagggtgcagagggacagagggacaccatgtcgggagcccacacctggcacacccctgactctggggctcagtgtcctgctgccctgcggccacgtgatcagctagaggtcatggctggacccataggcgaatacagcctgtggatttgattttgtttggccctgcggtgttttattttatttttagttttagtttgtggagacagagtctcgctctgtcagtcaggctgagtgcagtgacacgatctcagctctgcaacctctgcctcccgggttcaagcgattctcctgcctcagcctcctgagtagctgggactataggcgagtgtcaccatgcccagctaattttttatttttagtaaagatggggtttcaccacatcagccaggctgctcagtgttttaaaaagggcttgttttgctttgtgccagcatttaaagatcaggagatatcatataaagatccagatttctactctcttgagaagtgaacagctctggccacgccgggcccatatcctctagggcagtgacggagctgagacagggcctgtgacaactgagagttctctggagtccacacggctccttgcccagcttctggtggaggttgagcttagtgacccaggatttcgtctgtgtccaccaagaaggagaggtgcctgtggcttagagagggcgcccacaggagtgccttgcccaggaagctggcagctgaggcggccagggttagggggttgggcttcctcttcccctccccagtgcctgagtgcatttggaggaagagagacgggtgaggggaaggcactgaaattggtcctggagcgctattattgggggctggggaccagctgtcatcccttttcctgtgggcaggggaggcagtggtgggatcccatgagacccggactctgtggcctggtgaggcagggagcggctggggagacactgtgggtctccacaggggtgcgctgtgggtctggcctggggaaggagctggtgaatgtgcctgccatgtgggtccctccctgctctggccctgataaccaggagcggctggctctcatttggagtgcggttgtggggactgtggaggtggcagcttcccaggtaccatccccactgcctccgagggagcagaccctggtggagaggcaggatggctgcagggcgggagctggtggttggcatcactgcacgggcttgtagtagtggatgggaagatgcaggagaggctgatgactgagaaagttggttcctgtggactaagctgggggagccggacaaccaagtggttagaaccttgggctctggtatcagcctgatgtacagtctggctctgtgtctaccccgtgccccactttccccatctgtactgggggtactggtattctttacatcccagggttaagcggctgcagatgtgatgagctcggtaggcccggcgcctcgccggcactgaaagctccagtgtccgcccttagtgtcattgatggggttttgttcctgctgcggttctgattggttacagttgcggtcacttattattggaggcatgtcccccgctgtggctgatggtagaggtgtgtttgctggtggtgtcccagtgtgtgccttggctggaggtgaggagggataaaaacagccgcgacaagaaggaaatcaaggccgggcacggtggcgcacgcctgtaatcccagcactttgggaggccgaggcgggtggatcgcttgaggtcaggagtccgagaccagactgaccaacatggtgaaaccccatctctactaaaaatacaaaaattagccaggcatggtggcccgtgcctataatcccagctactggggaggctgaggtaggagaatcgcttgaacccgggaggtgccgctgcactccagccagggcaacagagcaagactccatctcaaaaaaaaaaagaaggaaataaaagtcttctctggaactagaacgttcctatgtagacgtagctggagggggaggctgtgtggtttgcgccgtggccatggcaagacacgacgggcagcatcttcccactccagcctgcatctctgccccagaactcatgatggttctcctaggatggggctgtcccttccgcttgctgagacatgaaggacgggaagagacccccggccctcaccgccgcatcgcctgccttcctctgctgctccttagcaggaaacatgccggagtgttccctagccatccattcaccaattgcatcccctctctttatttttcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggagggtgagtcgcagagcgctaggtcttggatgctgtggtaatggggggcctggttgctggctttgccacagaatcttggaggaagaagctggatatggggtggagggtgctaccctggagacccagaaagaccggaatgcatgggggtgggggtctgcaagctcaggagaggtggctctctctgtctgatgggaacatgccaagatgccccaagcgggacttgaatgagagtttggaaagattttctgggtttcaaggagcctcctttatgggtcaccgtgggccttgctgggacctctgtctgctgtgtgtccctggagggcctgggaggcttagagaatgaggagccacgcaggaaccagggcaggctcatgcaggggtgtaggacagggtggagttgagacccctagaagggctgtcacattctggtggctcctgcttgaggaattgcaggctgcctggatatgcccagcagaggccgagggcttggggaagggaggagggacgtatgcctcctgaggcttgcattggagcccatggtctggtcctcctcccccaggagggatggttgtggcagagggaggggaacatgaggagcaccttagcctgcaggacaaaattctcagggcactgggaaggggtgcctggaccagggggctgtgtgatagctgcacacggttttatttgggggtgcccttctggcgagaggagagaggccatggggctccagcagcgtcctgggagggctcaagcccacagccgtgctgacatggagcttacaggcaggggattggtgccagtcctgtgggacacagggcctgtttggaaatgccaggctgtgggacatggttgggtcccttctcagaagcgtgccccctggccccagcagggatcgtggctccatggggctatagtaaggtgccagctgggttagaagcccctcaagagccaggtctgattctgggcacaggatcagaactcagtaatgctcagtaagccttctttaggttggacaaacagcacagtctgggtttttgatttagctgctgcttcttatttctaaccgtggtgaaatacacaacatacaatgtgcaattttagccactttgcagtgtacgtttcagcggcattcagtacattcacggtgttgcgcagctgccaccgctgtccatctccggtacccttttcatcctcccaaactgagctccgtccccgttagaccaagctccccatgcccctcccccagctgctggcagccaccattctattttctgtctttattatgaatttatttgaccactctaggaaccttgtgtgtgtggaaaaatacaataactgcccattttgtgtctggctcatttcactcagcatgacgtcctaaaggttcatccgtcgtgctgtagcatggggcagaatttccttcctttcagaggctgaataatattctgttgtgcgatgcacttgtgttgtgtagctgttcctccatcggtggacccttgggttgcttccacatctctctaagtccctctttccatcttctttgacttttctttgacttttttgagacagggtcttgctctgtcctccaggctggcgtgcagtggtgtgatcactgcttactgcaacctctgccccctgggctcaagtgattccccagcctcagcctcccaagtacctaggaccacaggttgcgcgccaccatgcctggctaatttttaaattttttttgtagagacaggttctcactaggttgcccaggctggtctcaaactcctgggttcaaatgagcctcctgcctcggcctcccaaagtgttgggattataggcatgagccacccaacccctttttggtttttctttttgaatgagagttctccagtggtcagtgggcttgggggctgggaggatgtggggcctggagagggtgtgggtttggggggagaccagtgctcctcatgctttcatgggcatgtggagtgcacatttgtcttggcgggtctggggcctgggactctgcatttcctacagagggggcatcggaacacactgagtagccagaggctagtgggccttggaaggtcctttccggccctcagtgtgcgagtcccgtgttccctctcccatctctctaagcttgactctgaagagccaccctgccccagccacccagactcagtgacagtggttgctggtggcatggtgtcaggccaaaggcatgggcagtttgcagagtggcaggaggctgtttcctcccctgccttctgttggtgcaggacctttgtttgacgtgccggatacacccccatcctgggttgatgtgttcacactcagctgagtcaaacaggatgtggctggggaggcggttgtcaccgagccatctaaatctcggtgatggctggtgctggatgcacagggacgtggtcctggctctgggggacaggtagggggatgtccatggggatgtacaagaacattctcctccaggggcagacacagtttagcccctaaattgtgccagagactgtgccgggagccaggcccagggacacaacctgcgggctctgctttctggagctcaccgagccgtgagcaggatggctgggacacaaggagtgtccagggagcttccccagcagtggaagtacaatttcatcaggccaggaaggggagagaaaggcaggccacgtggaggcagcagcgttcagagctgccaggaacctggcgctctggggggacggtggctttctccatggaataggatgtacacgttggagccggggcatgggagaaaaccatcagcatcccagacccggccacccacggacagggacctgtgcaggtgggagtccagctcacgtggagaggtccgtgggctgggctgacagtcctgagggcctaagcaagtccaggtggaggaaatgcagggacagacgagggcagggccttcccaatggaggagtgctcttgaaatccgatgggagtggcttctcggggggcccaggcctgagccccactagttcttcctccgaggcaccacctgcttgcttctccgtcctccctctctgtgtcacgaccgttctggacacggatccagttctctccaactcagcttcctgcccatctttccttcaggcccatccccttctgcccctccatgtggggctgggctgggagttccctgagccccgacatgcacagctctgaccaatctctgcggcccctctgtcccccgagcaccagggatccagctggcaccatggggaaaggaatcatggagggagttccgtgccctctgagcagacgcccagccccttggcttctgcctgcgggagggcatctgtgctgtggtttgtctccaccccagagctgtgggtgcagggcagggtctcctggggccccagctgaattgctcccagactgacttccccaaagcacagcactgctgagatctcttcccgtgctgagccttctctgctcactcaccataggcccctccacggttgattcactctcctgctcagctcacacctctctccttcccagcttctcctgctttggtcttcccttggtctctcacacctttcctcacaacccctttgccctgacctcctgaaccctgacctctgcttctctttacatcactgccttggtgaactcctatgcatccctcaaaacctggtccaaatacctcgtgtttggcttgggatataaatgatttgtgtataaactttctttcctctgctagacttttttttttaaatgtgaaagtagtttttcagatcataaaaagtaatcgagtaccctttctttaaaatgcaggaagtacagaaatgagaaagaacctaaaattcacctgtaagccagcgatatccatgcttgaggttttgctgtatagtcttcaaaattcctttcatgcccccactagattctgagggtagggctgttgtctttgtttttttttgtgttttttttttgttttttgttttttgagatggagtctctctctatcacccaggctggagtgcagtggcatgatctcagcttactgcaacctctgcctcccaggttcaagcgattcttctgcctcagcctcccgagtagctgggactataggcgtgggctaccacgcctggctaacttttgtatttttagtagagacggggtttcaccatataggccaggctggtctcgaactcctgacctcgtgacccacccacctcagcttccctgacctcccaaagtgctgggatcatgccaccgtgcccagcctgtcttggtttttataaagaatcccataaggggccaggtgcagtggctcatgcctgtaaatccagcactttggaggccgaagcaggcagattgcttgagcccaggagtttgggactagcctgggcaacatagagaaaccctatctttacaaaaaatacaaaaaattagccaggcatgatagcatgcgcttgtagtcccagctactggggaggttgaggtgggaggaccacctaagcatgggaggttgaggctgcggtgagctgagattgtgccactgcactccagcctaggagacagagtgagaccctgtctcaaaaaaaaaaaaaaaaaaaaaaaaaatcccataagataccaagtaagtgacttggacataataggtgtgccatgaaattatgctgaaggagtgagccactggtggtgagttgggatggcttttttgtggttcttgtaggcagatgtagtgacccccatgggtcgtccctagagaccaagcagaaactttcctggtcaactttacccccaggacacctggtctctcctctggaggttgtgctggagggctcagtgggtgggtgttggcttcagtgtgggggttctggaaggagtcagcatttcaggagggagtgtgggcacctagatggttgaaggggagggagaggaagagaggcgctgcagagggcagaggcatccctgcctgctcctccgccccagggcctggtgaggtctgagctttatgctggtggggtggattctcggtttccgaggctctggccctgcccctggacttggcaccctccttgctgtcctcccacagaagggcgctcatcctttggggtcatccctggtcctctcaggctctgggtggggacggccttgcctcctctcctggatccctgctcttttcctgccccccaacatgggtgcctctgggtggagtggggtggggctgggctgcagcacccagtactgagcctgcaagggctggctgctggctcagagccccccccaccagagttacccccctccggctcctcagccacaccagccaagtttctccagagctgccttataaggcgggtgctcagcgctcgttcatgggtctggttctctgccttcttgggatgctcactgggggcaagagggaggccaggcccagtgcccagctcagttctgggcatgtcccagctctgccccatgagtcaactggttctgaactatcattccacccctcccagcctcaatttcttgatctgtcaaagaggcatctgcagaggtggctgggggctgagctctcatgtatccacccaccccaagaaccaagaagggagtccacagtggttctggggccacttgtgaacatggatgtgaaattggggcggggtagacatggcagcatgtctcagtagttttcctgtgacccagagggtctggaaatctttgtcatgtgggtggagcgttgagggagcagggggtcaggcccccccgagctgatgatggtgggcgtggctcttcgcatacttggtccgcaccgggccgtgtgttccaggggcagaacagggaggaatctcagcacagacagcagggctgccagtacagcgttgagtatagggttaatcaaagcacagggctccctggaaccacccaacacagagcagtgaagaggtggctttggggaaagtggggtcagagctgagcctgagtggggggtggggagggcgggcatcagcctgcaagggagggacacctactgggccccagaagttcctggtggggatcagggactgtgaagttggggagagggtgaccactgtgatttagggaggaagggccccatagacagcccagcttctggccccgtgtttacaggacaccccacataggctctgagcctatccctggactgtggactccctgaggcagggtgtgcaggttcgtccagtaccaggtgtaaggcagggggccttggtaagcgtcgagggactcactggtgtctgatgaagcagtgagtttggatcgtgtcatgcctcgggtcctgagcctgcaggatttttctgtggggctgtgtgcttctgcttctggaggtgtccagaaggcactgacgttcctgccgggatgccttactcggaaggtcccgctgctcccacctcctcccattttcctgagctgcttgcagagggcacccaggtccccttttactttgggattgggtctctttctctttccccttctaagaacaagtaccctccttctccgaactgtccctggagcctctcagacctaggtctagagtgggaagtcccgcatgtgctgggggaacaggaatcaatgcgggaggattggccaggcccggtgtgtctccttcgtggtgggacggggtggggccagagaacagagcctggctccagagcccaggaagagaacccctcccctcgccggcctgccaagcaccgtgcagtggtgagaggaaaggagggctggtccgggaatgcagcgggtgccgagcagctgtggaataccttaaatagagcgcagctgcggggaagggtggggccaggaggcaggcgctgggggcggtttctctgctccgccccctgcagctctgtggccctgaccacccagcctggccccaggatggagccccggcccccagacacatggcactgggtgaggccgcctctcagcacttgtcccaggaagtcagagcagctgccagaagagagaggagctgtgtctgtacccgccgcctcccaggcccgggacagctgccgggattgagggtctgcacaatggcgagcctgtccggaggggcgcgccgcggccagacagccatgctctgtgcggtgtggacagagggcacattcagccctggaggagcgcactcagactccccgcctcggggcccaaagtgtgggcagcccctaaccagaccctggattccagcagacagcctgggaggatgccatgtggtccaccctgacacactgtctcacctgtgacctcatttctgagagctgcagggaggcgcttcctcagttggactccacttcctctccggggttttctgtgggtgttataagtgactctgtctccttcagtccaaggggggctcctggggtatgggctgtaactgacaggctagagtagcccatggccagggctgagcttccttcccgttctctctgaacactgggcccaggaaggggttaaagtggagatgctctgattaaagttgagggaggcatggagctcccctgaccctgtccccccatcccactgctgctactgggtgtactctgtggagccccaggactcttaaagaacccagagtggagattcccggtctcatccagtgcaggtgagggggaaagtgatttgtccacagttacatggctaccatcagcacacctgggtcaagctcgattccactccacggcccctgtctgaaacctggaactggaaatggccctggaaatcactgattccatctgccgccttccaaaatggcccgcagaggttaagatatagactcctgtaatgccttgcccactcgtgtgtggggaaatggcagaggagcaccggctttgccctcacactgcctgggctgccgcccctgccctgcctagtggctttcctctctggtccgttttctcattgtggaagtgggcacaattcttcctgtgcagcgtggttagagtggacagtgatgattcgtgaagcagggtggagcgcctgggggattcgtgttaaacaagcacataaacaaaagccaacacaacccttacttaatcagcaagcaggccttgtctgaagcccctgggcagcacctcatgccatccctaggttccaggccggtggtgtcgccccgtgtctctctcacccgcaagctggtgtttagaagccctgctctgtgttctggctcccattctccctgtgacctttccctttcttcatcctaaaaagcaatgcacgacggggcgtggtggcgggcacctgtagtcccagctgcttgggaggctgaggcaggagaatcacttgaacccaggaggcggaggttgcagtgagctgagattgtgccagtgcagtccagcctgggcaacagaacaagactcccatctgggaaaaaaaaaaaaaagcgatgcccagtcattcttagatagaaaatgaagatcacatgaaatttggaaagaagtttttctctcccattccccaactctctcccaaggggtggccatgttgacagctgggtgtggcattctcctgaattttattcctgcagagtcattcagggcttgtgtaaaaaaagtcaatgtgtaaatatagacttttcaagaacacaaaggaaatcagacttctgctaccagcttttattttttccatttaacaacactgttgccacttgtagatgtagcacgttcctttttctttttctttttttttttttttgacagagcgtggcccaggctggagtgcagtggtgcgatctcagctcactgtggctcactgtaacctccacctttcgccttccgctttcaagcgattctcctgcctcagcctcccaagtagctgaaatcacaggtgcttgccaccacacctggctaatttttgtatttttagtagagacggggtttcaccatgttggccaggctgctcttgaactcctgaccttgagatccgcccacctcggcctcccaaagtagcacgttccttttaatggttgtgtcatcagctgtcccatggccctgccaggcttgtccagcttcccactgtgattgagaggctgcaacagatgttctcgcacttgtacatgtgcacacatgactgaaggatgagctcttagtgaatttctgtgtcaaggatgtgtgcatttaagttttgatctgctgggcacagtggctcacacctgtaatcccagcactttgggaggccaaggcgggctgatcacttgaggtcaggagttcaagaccagcctggccaacatggtgaaaccccatctctactaaaaatacaaaaattagctgggcatggtggcttgtgcctgtagtcccagttactcaggaggctaaggcaggagacttgcttgaacccagcaggcagaggttgcagtgagccaagatcgtgccattgcactccagcctgggtgacagagcgagactccctatcaaaaaaaaaaaaaaaaaaaaaaaattgatccttgttcctgaattggcctctaaagtggttactagaattttttaggacccctcccctcgtcgacctgctcagctgtctgctgggccctgtgcagtgatggtccagcagggaggtcctatgccccttacccctggctgagggccaaatgctctccaattggtgttttattttgtgcatctcggtcaagcgagagggattatctcttcgtatgttataggccagggccctgtgttctcttttcatttggaaggtgtatccttttcttgttgaaattttttaaaaagagttctttgtaagccaggcgtgatggctaacacctataatcccagcactttgggaggctgaagtgggcggattgcttgagcttaggagttcgagaccagcctaggcaacatggcaaaaccgcatctctgcaaaaattagctgggtgaggtggtgcgcctgtagtcccggctactcgggaggctgatgtgggaggatcatttgagtctgggagtttgaggctgctgtgagctgtggtcataccactgcactccagcctgggtgacagagtgagatcctgtctaaaaaaaaaaaagagttatttgtacatctttatcacagcaggtacgagtatcttgtccccagctgcctacttttgattttgtttctgggatgttcttctacacagaacattttaatcctgatattgtcaagtctctgctttcccttttagcttttggaattcacatcctgtttagaggtctcctgcgttctgaaattataggaaagaatttcacccacgttttcttctagtacttctgtggtttcatttttacatgttgaaatcatgaatccattggaatgtattttggtttcagcagcgaggtaggggtagatggtattgcttggatacacagcagcgagcttggtctggagcgggtggggcgtgtgtgtgtgtgtgtgtgtgtgtgtgtgtgtgtgctatttttatcagttttggtgtctgcattgtgctggcttagcaaaaacaatttggatgcatttcttttaccctctgccttctggaacattttaagcagcaacataataatctctctgttaaaacttttcaagaattcactcgtgaaaccatctgagcctgatacttttgggggagtctagcactttaaaaacttaaactttttccatgggtctgtgagtttgggagtttttctttcttcttaaaattcattactatttttttcctagaaaagtgtcttttagcttatttaaaatccgtcagcttattccgagggggttgctttagctcgcttagtgaggacagtgtgcagcgcggtgattgacatgattgatcagcagagcacgatcgatcagtcggtgtgcaaacatgactgactgtggccagcgtcctgggatgctccatgttgaggcacatgtgtgcagtgcagggtgatgtgtattctgagaggggatgaagccacaggacccctgcacccttaggagagagcccccctccccaaggctgcagtcttgagtaggtagtgacgggactgggtctagggggctgagtggtcccagcaggccaagggcttcaggaattatgagaagtttggagttgcccagagagcagctttcaaaaccagtctggactgcagcctccagaaagacatgcgattgacaccacgaaccaggacacacctatatatggggtgggggtggggatgggatgtattaatgaaaccaaatttccgtgatggaattcttacctttaccatgcgtgtgctacactcagtattttctttttttttttttttttcccctctctctttttttctttttgtttgtttgttttggagagagggaaggctttttttcatttttttttaaacagctttattgagatccaagtaagctactatacaatccaccaatttatttatttatttatttttttgagacggagtttcactcttgtcgcctaggctggagtgcagtggcgccatctcggctgactgcaacctccgcctcctgggttcaaccaattctcctgcctcagcctcccgagtagctgagattacagacatgtaccactacgcccggctaattttgtatttttagtagagacggggtttctccatgttgaggctggtctcgaactcctgacctcaggtgatccacccgcctcagcctcccaaagtgctgggattacaggcatgagtcaccgcgtggcccaatccacccatttaaagtgcataattccatggttttcagtctattcagagagtagtgcaaccatcgtcaccacaaccaattttagaaaattgaaaatttgagaaatttagaaaatttttttcttaagaagaaaccccgtagcctttagctatcaatcctgccctcctcctccatatttccttcctatctgtgtggattctttttttttttttttttttttttgagatagggtctcactctgtcacccaggctggggtgcaatggctcaatctctgctcactgcaacctccacctcccaggctcaagccatcctcccaccatggcctcccgagtagctgagactacaggcctgtgccaccatgcccggctaatttttgtattttttgtagagatggggtttcaccatgttgcccaggctggtcttgaactcctgggctcaaatgatcctcctgccttggcctcccaaagttctggaattacaggcgtgagctactgcgcctggccgattctagacatttcttgtacagagaattgcacgtttggcctttgtgtctggcttctccacttggtgtcatgtttccaaggtccatccacattgtggcaggtgccagtgcgtccctgagtaatattccaccatggcatggaccattccattgtggacagacatgttgccttcatcagctgagggacattgggttgctgccaccgctggtgagtgtattcttttcaaattaaaaaaaaaatgctggtcaccacccactagatcgttttcttggcccacagggtgggacaagccggcctgggtgagggccaggaggtggccaggtggaggcggctggagcggccctgggttgcctctgggcgcagcaggcagaggtgcaatggcagagtctgagcaggttccctgggcggatctccatgccggtaatgtttgtttattcaagaagtctcggccaggcgtggtgcctcacacctgtaatcccagcactttgggaagttgaggcaggcagatcacctgaggtcaggagttcgagaccagcctggccaacatggcaaaaccccgtctctactaaaaatataaaaattagctgggtgtggtggcgtgtacctgtagtcccagctactcggtaggctgaggcaggagaatctgcttgattccaggaggcagagcttgaacctaggaggtggaggttgcagtgagccaaaattgcgccactgcactccagcctgggtgacagagtgagactatgtctcaaaaaaaaaaaaaaaaagaaaaaaaaagaaatctccagtgctgccctgtgcccggcaccgaagccgagggaaggcagcattagtatgagctcccagcccaccgggctcctgtctggagctgacgtgcgaccaaggcacacgagggaagcatggcgaggtggacggtgcggaggcataaggagcaaaataaggcagatgcagtggctcagtggctcctggtggctgcgaggagcgtgggcaggacagccccaggagggcacctggagagcagggccggctggggcaaggtgtgtcaggcacttgtcaggagcaaaatgtaaggggacaccaaagagctcaggaatcaacacagatagtatttaatgcagtatttttcaatatcgaaatgatgcatagtaatctctatgatgaacaaatgttggaattttaaattaagacaggcccagccctgcacgtgcacagccctgtcagagtttgttcagcgtggaatttgatttgtttaaaatgttgcttcaaaatattgtttgattcctggattttttggcactgccttaacttttgcacctggacgaaggcctcaccctaatcccagctggagagggtcaagggctggtgaatttggctttggacctgcagagcttgtggtacctgagaggtggggccaggaacaggaaggagctggtgagaacggcacccggtatgggatggggccagatcagagcagcactgtggctctttccaacccgtggttttgctgctggatgcttggcgttggtgctgagcccccggccctctgaacggagtgtgatgaataacggggccggggagctcttgggcccctccctgaagcagcagtgaagccagggacatgccggcagcaggcagggagagggacgtctggtctgtgcctggagccagctgccccatggaggagctgggtgaggatgcggtgggaggaagaccttcccagtcctgcatcctccgaagcataactgagtgcttgtgtggcttgggggtcactctggtccgaggacagtcttgctttgcttagccaggctttgaagagccaccgggatacggacagcagccctgctgggtggcaggttgtccaccctcgcccactcaacgctggaactggatgcagagcacctggatggccagtcccagagtgtctctgacactcccagtcacctcatcccttagaccaggataagatgcgggatcccaacctcgagcctcccatgggctccattccatgtgctcccataagccactgggcccacctcctggctccagggctgtctggccatttggcatcttggtttcctcatctgtacaatgaaaataatagtcccagccttctcgaggagttacaagatgcctttcgtgtgaaaaactgggatttggtaccagactatctggatttgaattttggccctacccctcctaacctgtggctttgggccaatctggcctccctgtcctcagtttccccatttatagagccatctcattgagttgctgggaggatgaacataaggaagtgtactcatgtgcccagagcattgtgattttacttattattaccaaacgaggcacacaataagtgcctaatagatgctcagtgtcatttcacggattctgtgtgccttgtgtgtctccagcagccaagctctggaggtggggaagctgttgacgagttgcacgaggtaattagaaagaggaggccacaggtgcaagggtttgggtgacacctgtggacagagagaggccgatggaccctggcagaggggaagggggcccttgcacatagaaaatgtttcctgcatccaagatccttgtgactctggaacagaggcagcagaggtctgcaaattccaaatcataaacccagaaagcatagaacattcgtagagaggaccagaaacatcatatatcttagtgtgtatagaattttccacatagccaaacaaaagcacgtttctaactgaagctgttggagagttcctgaggactttataccagacaagggccggtaagtggaagttcaatacgcaggagccattccttttgttcacaaatgtttgccgtcttttctgtctatatccgcattcatgtgagggcactcataggtccaccgtccagccccatgctttgtttgctaccaaaaaatttcttaagaattcctcagctgcaaatcctcctaccggagggggggttccaggaacccagccttgctcggggttggggcacctcagcacctgctgcacaggcgttggtcattaaaggtcatgtgccgtatccgtgggccctcggggtctggtggcacctgggcacacagtccagtggcggcctcctacctgccagacactgggagtggggggctcctcattcctgttccctggcggtggggggagtgccccgagctgtcacacatcagaacccaccgactcacacgttgcggcaccttacagccccttgacagcctctcagcctgagagaccatcaaactgagttcctggagagggtggctgttgaggcctggacacaggtgtggacaggatagccctgcctcatctcggagtcccgctccggttcagcctcttgtgggtctgaagctcaggctgggccagtccctgcccctcagatggccggaaaggcagcccagccccacggcctccttgtcaggctctgagagccgcctggcctccagctctgctctttttttttcttaagatggagttttactctgttgcccaggctggagtgcagtggtgccatcttggctcactgcaatctccacctcctgggttcaagcaattctcctgcctcagcctcctgagtagctgggactacaggcgcgtgtcaccatggcaggctagtttttgtatttttagcagggaccggttttcaccatgttggccaggctggtcttgaactcctgacctcaagtgatctgcccacctcggcttcccaaagtgctgggattacaggtgtgagccgccacgcccagcctccagctctgccttgattttctcttaaggccgtgaggatgtccacgcctcctcctttcctcacggcccattgatgtctccagatgctctgcaaagccaccctcccctcgggagctccccagctggtgacgggggaccttttggggatcactgcccaggtagtcatgtaggtctgtgggccgtgcttccaggctggaccgagacccggtgcatggggtgcttctggtctgagctgaggcccctggaagccacagccaggaggcagcaagggacggctgtcatgtcccctctcccctgtctcccagggtccctgcgggacagatttccctgcctgagcctcctggttgcccataccctggcctcccaaagcccagcctgaagccttaggcaccctacaacctgcttcctctagcagcctgccctgtctcttctctgccgatgttcctgaaactttcctgcctctccttacctcttggccagagagagactggagaccctgtgggaacccccgaggggagggagaaggccgctgtttgaacggaggtggtctttccctctgcccctccccaggcgggtcacacttgcaggcccagcctcctgctgtggcagcgcttggggtgtcggctgcctcctgggcacgagttgggagctgagggaggcgctttcaggaccggagtggcaacccagctggaggaggagtaacaggcccgtggtcagcagcagccgccgcagggaccccggcgctgtacctgtgccccagctgacccctcccgcttccctagggtgggccggggatggtggtctgttgcccagcccaggaagaagaggggccgtaatcagcagcagccacctcaggggaccccagcgctgtacctgcgacccagctgacccctcccccttccccagggctggctgggaatggtggtctgttgcccagcctaggaggaagaggggctgtggcttccactctagaggtctctctcccggtccctcccccggtgctggtctaactgcaggcctgccttaggccgtgccggcacctgctgactgacgcttagcggatgctgataggagagggctgggatggggaagcagcaagtcccggtcactgtgggctcgggttacagatggttgaggcacctcctggccatccccaggaagcaaggccccacgcagcctccgactcacccactgcccgtgtgtatttcaggaggctgcatcccccaaggcccccaccaggtaacttcattgggctgggtgtcgctgcaaaaccacccattgggtgcggtggtcttctggtggggggcatggctggggaggatgcggtggaggagaagccagctccgtggttggggggagggcggactatccgtttcctgtctgtcccctgaactggagctcatggtccctcccccaggtgcctgggccatggaagaggtcacagccctgccttattcctgtggcagcctaggggagccctggccagtcccgtgtctcctgggagggcgacagcctggtcaggctgcagggcaggactggaatgcagacccctgcttggccatgctgttgcctggctgctctgtctggggaccttctgttcaggaagagagaagcgggccggacagcccggctcagtgattggaagctcagctccccatgttcagtccagcaggaagtttgcctcctcggaacacttgcgtgcttctgcatgtgtcttcttggctggtggttctgcgaggcccctactgggctgcgtcatgtcctctggccaccctggccttggtgcctggcccctgtgaaacagagatacctgggcagtcccccacttgtgcttgcaagcctgtgtggcttcagtgatggctgattctgctccacccagaggacctgggaatcctcagcccaactgtccagaggagtctttctcagtggggagagcctgagctgtcctcctggtggacagtcctttagatctcaggcggacttccctgccggccgttcctcctgctgcccctgctcctctgtcccccatctgtctcccaccctctcccctgcagcagccagctggcacggggacctccccttccctctgggattgtgaatgagacgactttcctggtccttctgggtctagatctttctggcaacagtcagtgaaacccttgtctcaggtgggaggagaaggctcagtatgtggtcacaacaacggtcctaaccacatcactctcaaacgctggctttcacttaccccttgccctgcccaacagttactttcatcatcccattttccagattaggaaatcaaggcgcagagagcttcagccacttgcctgaggcccccacagttaagtgtctggatttgaaccctggagcagcctggctgctgagctgtcctggagacggggtactgtgcagtggtcggggtaggggtggagctctgccgtcgctgactcccgggctacctggagtgataacacagcccagtgtctgggcccctgcctgagactttggctggatgccaggagcccgagaccttccagctctttcctgtgtaaggcgccatggggtgaaatgaaagaaaaccccagttagaaggtgtccccctcttccttcagtccctcagctgccctggattttgaaataagacaccgcccgtctgtggggtgagcaggaacagattggaaccgcatttctctccccccagtcacagctgccaggagctcatctttctctgtctcctccccctgccgcctctccccacaagactgggctggatgctgctgggaaagtcaacaggaagtcttttggctgcggtggaggtgggggtctgtgcttccctggggaccgagatgagggctccaggttggctccggcaagagcagggaggctcacgtctctgcctgctggttttgcttcctgtcctgggagaaggtatccacatgtcccagaatgcaccctctgcgtgtacagggatggcttttgggccattcacctgaggtttattgatctttctctttggaactggagtggctcctccacggtggattgggctgagctctctgcctcggccgacgtctttccccaggcacttcctctcaccgtgccagggtgcaggttgctagtggatgggtcttcaccctcggggattggcagctgccacgctcatttcacagtcgagacaccctggccgaaggttctgctaagctccatggagtgtagggattttttttgagacggtctctctctgtcgcccaggctggagttcaatggcccaatgtcccgctcactgtgatctcgacctcctaggctcagcagtcctcccatctcagcctaccaagtagctgggactacaggtgtgtgccaccatgcctggttaattttttaattttaatttttttttgtagaaatggagtcttactatatttcccaggctgaactccaactcctgggcttaaatgatcctcctgccttggcctgccaaagtgctgggattccaggcatgagccattgtgctcagctggggttttcctttaacccttcctggcccttcccaggtgcaggacccgggcctcagccttatgtgttcttgaacagctctgggctctgtcctgtacctcctgggcgcgtggtcaggcctctcgtgacatcagcaggagactcaggtgaagaagcaggcagaacggaatgcttgctcacccagcctcggggccaggcggggcggccaggacagtagcagtggctggtgtggcttcctgggaggtcagcccattggcgtggccagcgaatggggaggggagcttctccccttgtctcccctcatttctggtctctgggcctccagggccaggtctccagagttctaggtggaggatggaggtcagggaagctggggtaagagcgggctgggggtgggtggtcaggcggatcctggaaaaccatcctctgcaggtcccgctttccccagggagcactcagggctggtcccggggagccgggctaatggtcacctcggatggtgcaggggtccatccccatgaaaccgggcccatccccatgaaactgggcccacagaagcttttggttccggttctgttctgccccctggctcttgcttccaaagtaggactcaggatagctctgaattccctgccgaaatgcagcttcctgggccctaacccagccctccagaaccagagtctctggggtgggccctctgcttgtctagcagcctccaggggacacttgtgcctgccagagcaagtctaataagcactgctgtaaacccctcgtccccacagccttctggttcgtctcccttttcctgctgggatctgcatcaggattaaatgccaacatcagggatcaggttatacttgtgaaccctgagacaatacctgcatctttttttttcttgaggctgtcttgctcgctctgtcatccaggctgaagtacaatggtgtgatatccactcatggcaacctccacctccagggttcaagcaattctcctgtctcagcctcctgagtagctgggactacaggctcacaccaccacacctggctaatttttgtatttttagtagagatggagtttcaccatgttggccaggctggtctcgaactcctggcctcaagcgatccgcccgcctcagcctcccaaagtgctgggactacaggcgtgagccactgcgcccggcctgatacctatatcttgaccaagctgctgtggaaacattgagttccccttgatagttttgtccacagagtgaatgtttaggaaccggcgaggcatctctcacccccacccagatggcggcctggaggcagcgtttctgaccctgtgatgggatttgtctctcttgtccaagagactttagagatgtggcccctgaatgtgggggcccctgttggggtgggaacgggagctggccctggccattgtccagtgaccccatctcagtgcctcgatcctagcaccctcgatctcagcgcctccccttccccggctccgcgcggagatcacgtggcttgcgctgagcaatcctccactgcccccgtcgcgttcctgctgcagggaagcctttccagggagccagctgacacatttggcctccattatttgtttttgaacaggaatgaaaggagagagtgagtaagaaagtggcaggaggtgggggttgcagagtaggggaaggtcagagagaggggaggaaagatctggaaagtccaggcatgtgctctggaagcaggtgccagcgatgagctcatctggagggtggccgcccgccctgagccctgcctggggccagcagggaacactctgccagggcatgtcgctgggagcctgtccttggctcactttctgctgctttgagcgctgagcagatttgtttccattttagggacaacgcaaggaggctgtcattccacccctcaccttattaatatttcatgaatcataagtgaccacttactgcgtcctgacgtactccaggcgctgggctcgaagctttatgcgcttcatgggatgtatctgcactatcgccgtagaaaacggttcctgttactactgcagagaaggcaccgaggcacagagaggttgaggaactggcctcaggccacacagctagaagcggctgaccctggctgtgaacacagggctgcttgactccaaagcctgagctggtttgcagcgaggctcatggtttctgtgccactgtttgagcctctggtcgagccccttggctcagtggggggcccagtgacctaccagctgttccattatatgttgtggacacctccacggcccacctgggtgggagggaaggggcttcaggaggtgggaggggtacagggaacacagtccagcctgcttgggcccaataccttgaccttcaaggtaccccttgagggtagcatgaggctaagctcttgttctcctccaggactctgttcctgtgagggcctcggggtcccttgcttttttctgggggccttgctggtcaggatcacagagaagctctttgctgttgatctttctgcctctgtatcttttggcaagccattttatgactcagttgctttgtctgtaaaatgggttgaataacattgtcctgcctcggagggtttttgggaggatcaaatgagacctgttgcacagaagccctttgtaagccatgctgactggcggtcgccgggcccccaagtgaatgggcatccgggcactgagtgtgtggactcagtactcggaaggaggggctggggggtacctagaactcctgggaggcttggacccctgctctgctcagattctgagcttctccttggccagtttaattcccatcagtagggtgagggtaaccaggacttacgcatagttgggcgaagtcgagtgaccacatgtggaagtctagcgtccttcatgcaaagtgggcaggcggccaaagtgagctctgctccagtccccccacccccggggctgttcctggcgccctgccctcccccagagccccactgacctgcaccatgtgacccgggcctgggaagatgggcccagctgtgggaggtcgtgcgggctggggactgagagtgccggaggagggcctcccaggaaaacccagctgcacaggaagccgggccagcggcctccggaagcctctgggctttgcaagctggactccccagatctgtggctgtggggccctctcctgcctgcagctgagagcccttgacccgcacctgagggcttcagaggtccgggagggggatgtgaccgtgtccccagggtgaagcccacccgagtgtcactctggatacagccctcacctcttcctggccccctctctggtcatggggacgctgcctggggggggttcccttacatggaaggagctgcagctgagctggcgggcctcgcacacccccaaggccgcctgacttccagcctccaagtggggttgcattcaccactcaggacctggagcctcagccagagagggaccctccactgcctctttctctgtctcttgggaaaggtagggtctttgtgccccctcccacccagggacctggcatgttgggaggctaagaggaagctgccccccgctcatctaccccccaaccctcccagccagcagagttttacctgtgtgcttagaatctgtgcgtggagccagaagtcacaaggttggcccagctgtgtctgaccctggttgtgcggtcttggacagtcccagccctcctggagctgagcatcctgatctgtagaggagaggctgctgtgccggccccgcagggccctgtgcagaggggagtgtgtgcggctgtgagttcaggccatgccctcagactggaggataggatcggaacagtgggtcaggatggccagagggtcccagcctcaggaggaggcctccacacctcccagcacctccacaccaggaaatgcagccaggcccccaggcctcccatgtcaggaagcagcaccccgccccccacctctggttgcctgggcctgagaagttgagcactcctcccgaatccgagtgccctctgacccctgcttgggtagttgtccctcctgaactgaccgcctgtcctacacagtcccctgtggtttgcccgacagggtggccagcgagtcccctgcacagcacacctcccccaggagtgctgcctgtgatgatggtgtaaagggtgcccccccgagcccccggaggcatgcagtggcgcaacagcgtgagcccaggagccccggtgagctcctggatggagaatctgttcagatcactccccagcctaaaccttccctgggtgtctgctgtgcttggggcgctgactcatcgtggggcggcctgtgagaccctacgtcacctggccactcccctcagcccctgttcactgcaccggtcccctggcctggctgctcctggaacatgagggctcatcctcacggaagaatattcacttgttccctcctggaaagtccctccctagacctcctggccgcctcattcaggtcttgctgaagcgctgccatcttggagaggcctccctgtcacccgcagttaaaacagccctcccatgcctgtgggtggctttctatggggcatggatgagtattggagagtcttgccgtttatttgttcatatgccctctgggagggcaggggacactgacttgtgttgtgggtgccttgcatgtcacgggtgctcagtgaatgcctgttaagcattaggggagcacaaaggagggaagcctctgtccaactggagcagtcagggaagacttcctggaggaagtggtatctggtctgcttagaatgtggcgatttgtctgtatgcagacattagattagagggcaaaggccattatcataacttagcagacagctacaagcagctaaggaattgctatgacatggactgctcgtgattggagctaagaaggagtcagagacagaggtccctgtgctctggcgtgagtccttgggggaggctgagctcccagaatgtggggccgcctgtgcagaggccggaggtgggagacacacctgtgagtgccggtgagtgtggggtgagccactggggctggatcagaagatgggaatccctaaacccaccaaccagccttggtgccctgggagtgacaggagacggggcttctgggggactaacccagcacaagtggacgagatgggatgcaggggaaaggacaaagctctctgaggctttgggaagctgagttagggtagagccatgacagggtgagttccagaagcaacacaagaaaaaatagctagactgggttttcccttcactgtgggagatgccccacctcacttcccccgtcctccgggctctggcaatgggctgggcacagtgaatgggttccatctgcaggagtggtcacaccccttgggcacagctgcctcatacactgtattgagatgggatccgaggccgggaagaacagcttcttctgtaggttgacattgtcagccttcggggagggaaggacggcagggggcctggagcatctccttttgccatccacactctgtgcctgcctgcagggtcttgagccctgtctgttctgcctcagtcctggtcaggaacttgttggagcccataggggcagtcaggctggaacaggaggagaccaggccggcaggggagccgagagggggccctggacagcacccagggctgagtcatcctgggcctgcccgacttgctatttggagctgttcccgcttgctcatcatgtgcaaggtcctgatccactcgggtctgtttaaccagcgcccctccccaggcccagttagcctggttttcgttcgattcatttattgtcatcagtgccatccttgcaccacgtaactagcctttgcagcatgccagccaccaagctcagggccctctgtgcatctcctgtaaccctcacagcaacccgggaggcacagagaggctgagtcgctggcccatagtcacacagcaggtatggggcattgccaggatttagccggatctctgactccagggcctttccagggccttgggtgggacactggcaaggaagcaaggtatgaacactggccctgccttggacagagctcggggacggtggcctggcaggcccagctgacacagtgaccctggtgcaggttcaaccattggcaaagtgttcaagtacacacagaatctcaactggggagacaggcgaagcggtcaagggagggctgtgagtgacaggtggacactgtacctactggcagatcagctgaccttggtgccttctggagcctttcaacttccttatccagaaaaagaggaactaacagttccacccccaaactgggtgggagtaccacattcgaaattgaagcaaagctggtcgtgtcacaggctcggcagatgttagctgtgcaggcaacttagtgaccatttgaagtaggctgtgcggcggcatcctcatcttgcagatgtagtccagagaggttagggcactaaccctgggtcacacagcgacagctcaggctacagagagcagtgctggatgggagggtgttggcagcttcaggcacaggctgggagggctgtggggtcagcagagggagggcacacttcccagctggtggggttcccttgtgcctcagtactcatgtgggcccaaaggagctggaaggagggaggttagagccacccatgggttcagaagctgataagcaggttattgactctgaatttgcctcatcgtatgtaaattggggacaaatttggggatttaatgatataatgtaagaagcagacatgtcacagccctggttatacagtcagtgtataataagtggtaagccgtcagaggaggcagccggtgagaatgggagcatctcagcagccctccgccccctgctcctggttgcagatgtacctgttcttggctatttgtgccccagctccgtgtcctccggtgtgtgtgaggccaagctcctggggtggggacttgggggtgtgtctgcagctcctgaggccaagaccaaggctgaggccgaggctgaggctgaggccaccttggtgaggaggaaattgcaggtggagaagctcgttgaccgtgaccttgatctgaccgtaattttgatggtgccgatgccgtcagcacgcaggcctcctgccctcgccacgactggctcctgcagcccacctggctgagaggtgtgctggctctcgcaggttgcaaaatggggacatcaccgtccgcctgggctacagcgtgctcgccgattgcatttggggagggactgagggctgattgtgttgtggggatgttggcagagaatcagagagggcatccaaaaaggccaacagttcggtggggagaggaggcgcaaggctggttcctgttttctgggctttgatcgaaagggaacaggggacacatctggggacagtctccttcctggaggaagaagggcttagggtgctggtgtggagtttgcacagatggggataatgagctggagggtgctgggcaggagctggccagtaataggctgacgagggaggccctgctggctgggcctggttttcaagtgagcatcctgagctgcggggacccagggggtcttagagacctcagagctgagactcgggaccacagaggggtgggctgtgctcagggcaacacagcggatggggcagatgttgcgaaacctgtctctctgcctctctttctcctgctacagaactggatcctcccagctcatggctgtcaaatcctttagatgcttctgggttccatgggcgccttacactggcttccctgtaggacagcagaccctgggggttggctctgatggtattcaccatggggtaccccatgcaagcacagtgctttcacgcccagcctcccagcctgtggagtaggcctgtgtctggccagcctcactttgtggccagaggagggagacagtggttctggagacaggagctggcctggggctgccctcccagcccctgttctcccagctcatctccttgccttgcgggtgctggccaccctccccccgccagctccatccccagctttctctgcccgagccgtgacctgtcagtagggggcagtggaggccttgaaagtccttggagaggactttgaagcagtttttacaaatctgtccctggaaagtctctcctgtcacacccccagcggctccctccctcctaacatttttcctggggttgtcatgcagcggggggtggaggaacccactaggccgtggatagagcagagccatgttgacacaaaccctggctgaacccacatgctccctacagccagcggccgatcactggaaccagggaagtgacctcatagcaagggcccgcagagcagccatcacgcattcccgatcttggtttctggacccagctctggaaaagaagccagatcctagccacttggagctgcctagggaagaccccagcctggtgccggctgacagctcactggaacttttcatctgcttggccaggtgatgccaaggggcagaggttagaagtgctaagaagcaggccgagggtggtggctcacgcatgtaatcccaacactttgggaggccaaggcgggtgaatcccttaaggtcaggagttcaagaccaggctggtcaacatggcgaaaccccatctctactgaaaatacaaaaattagccaggtatggtggtgcacgcttgtaatcccagctactctggaggctgaggcaggagaatctcttgaacccgggaggcagaggttgcagtgagccgagactgtgctactgcactccagcctgggcaacagagcaatactccgtatcaaaaaaaaaaaaaagaagaagaacaagaagtgctaagaagcatctgtcttcctgattgaaaagcaatctttgctgggcgtggtggctcacgcctgtaatcccagctttgggaggctgcggtgggagagtcgcttgaggccaggcgttcgagaccagtctgggcaacagaggtgctaggggtagtggcgcttgcctgtagtcccagctcctcaggaggctcaggtaggaggattgcttgagttaggagtttgaggctgcagtgagctatgaccacaccactgtactccagctcctgggtgacaggatgagaccctgtctcaaaaaacaaaacacaaacaaaaaaccaacgtttatcttttgtgattttaaaaatcacacctacttgtgacaaaataattaaattagaaaatgtaaaggaaatgatcaataataattgcgtcctccagacaaacactgttaacatgttcacgtttccttctagtctttttctacatagacactcaatacttattaatttgttttgaactaaagatggttttctctgctttgtatgagaaccacctcagccaggcacggtggttcacgtctataatcccagaaagctgaggcaggcagattgcttgagcccacgagtttgagaccagcctgggcaacatggcgaaactccatctctacaaaaaaacacaaaaattagcctggtgtggtggcacatgcctgtgctcccagctcctcaggaggctgaggcaggagaatagcttgagcccgggaggtagaggttgcagtgagccaagatcgtgccactgcattccagcctaggcaacgggagtgaaatgctgtctcaaaaaaaaaaaaaaaaaaaaaaaagttgccacgttgtcacctctctcagggattttcatcctttctacttttcgcccaagacttgccctgtaaaaggatgaggccaaatagccatgggagggtggtactggatgttcaaaaaaatgtttcgtggctggcgggacttagaaacaggttggggaggtttcagcagagggtggaccccagctgggggtggggggcagcaggggggcccctcacatgctctctctgcgtgtttcatggggctgcctgtgaggccgtgtgaaccagagcccggctgggaagccacatgctacctggactctgacctttcctggcagcatgaccttagccaatacgctcaactatgttcccctctgtaaaatgggctaatagaaatgtccactcgagacatgatgagaaacaaaggtgttcatagagcaaagtgcttagaacggtcctggcatgacaggagcccacatgtcagtgctgccgttggcatcgtcatcatcacggcggcattggctgctttgtttctcccttgtccctgtcaccttcttccctcagcaggctctcattcacttgttcatttattcatggccgaggccccgtctgtgtcaggcctggtgctgagaacgggggtagagagatgggggctgtgccctgctccctgacccaagggttccctttgcaatgtgaagttcttggagactggaccctcaggctgttccaccagcccctcctcaggccagcttaacccttccgtgctcgttttctgagctgttagaggaagagagcgggaggaaggatggagtggggtttttgtggggactgagcggggggtgtgtgaggccctggaaatggtgcctgcggcactcacgcagcattagcttttgctgcagttgctgtttggagaatattcttggatttcaggacactgatgacagaaggtggaacgctttttctggaagccatcaagaggggaccaccgcggcggctgagcagagttgctgacttgtgagctgtggcctgaccacagtcactgttctcatgagcgaggccccctgtggtccccctcccaggaatttctggccccttggcaggggacagttcagggctgggggtgggtagtggtgtctgcaggccctcttggagtcagagaatcccctgtcgccgtggcggggctgttccctcctgcccctcccctcccgctgtgctctcagctgctccgacaggatgcttttggcctgagagacagaaaccccaactctgaatggcttcagccctcaagagaatttggagcttttttgtgcaaaatgagatgttctgagcatcgaggatgctgtgggggatcctccatcccaccatctccagccgtggtgtccctctcggtcacaggatgctgcagccacgttgcagggaaggagagcctcccttcctgtgagcctagggagcccctccatgcagccccttcactggccattgcctgagacccgacctggtggctcctgccccaaggagcagaaagggggttcgctaggtcagggtggggctgggtgcgaggaccccccccggccaacagggtctgcttaggtgtccgtcctgttggggcagcagggaagggacccacatgtggcactgggacacggagaggcttttgtgcctgtgacggccaaaagggatggcgccccagccacgttcccacccaccccgaggcccagcatggccatgccggaaatagcagcatcgtccccctcactgtcctggcttgctttcaataggccagaggggtggggctggagcgggcgtctgacctgtggctggatctagctgcccgtggacaggctgtgagtgaatctgcagaggaagggagatgggaatgccgggaccttctcctgcacctcccgaacccccgttccctgtgagttagatggggagtgcacccctgccctcccctcctgggtatcccctgcgccccccgccccaggcacttgatgttgcctgttcattttccctctctgcccctcccgctggcccttcccatatggtcctaattaggaccttccgcccgttggtggatgggcagagaggggagcttgctgtggggcctcccccgatcgggggacttcccagcacagagctttctggcctctgcagggacgctgtgtgtgcctgtgtgagtctggcgtgttagaagcgctaagctgcagctgttctgtgcgtttttcacatttctcacttctcaaaggccctgggtttggtgtctgtgggctggggatctgtgttggggtctccaggaggcccttggtgggagaggcagggccccttcccctttaatctgggcaaccttgctttggcctgctgtctgcggaaagtgccctaggatacggtggcaggactggctggggttctggctccaggcccagccccagcccctgtcagacttaccctccttgtgcctccgttcaccctgtccacccgcagggcctgcaggagcatcctgagagttggtagggtggcctgcccggcgtccgcacagggtctgctggtgggtggctgaggctgcggtgaggtctccatggctccctcgtcctgcacatccttcccttgttgtgttgtctcgctagcatatgagcccgtactgcctctgagtctgcagcctgttttccttaccaggtggctaagcagggtggcagccagggtggcagagtcccattggcctgcaggggaccctctgtgggctgcaggtagtcccctgtggttgaaggtgccctggcaggacctgcaccatgacccccgtcaaagctcacgtccaaggcatttgtgggcacccccgccccagacgtgagggttggcatcttctcttgcacgtgaagcaaaggcctgtttgaaggagcgtgtggaagcctgggtgtgatgaaggcaaggaccggtggctcacccctcttgcacctggaccttgggtggcaggcctggggccttcagtccttaattcaggagggtagccagtcgctggaactaagagtgaacttcagctgttgttgccatagctggagggaagaggggaaaggaggcgctgcaggggagcagagacctcacccttcctctgccgacatcaggctgccggtgctggacggggccctggcaaccgtggcaggagtggtgatgtccgatgatggtaacaagggcttcctgaggaccccgagctgtcttaagggctctttacctggagtaagtatcccctttaatcctcccaacaacactgtgaaattgattctgttgttattcccatttcaccgatgaggaacccacagcccagagatgttaagtaacctgcccaagcctccctctgagcatggcagagggagggtccgaatgcggaaagtctggcttcagtgcccccatccctaaccactgtcatttacctcttcggccagccctctgattgcaaaacctgaggcccagaggagtgcagtgacttggccagcttcgcacggcaggttagtggcagagctgagcagtgtctcccatgccctgattctgtggcttcttgaggtggctcacccctaaacacgccccccatggtggctctgtttcctcctctcctctgaacctgccagcctgtgctcaggcagggggagaagtagagcaaccatgccgggcgggtcgtcgtgccccagtgccgcctgccctacacctgattggcagcagagtggcccctccttggtgtggtctggaggtgccagtggtcactcatcagcacagcccagtctcacacatgtcactcccaaaggatgttgacacagaatgaagcagctaggggaggcggacgctttggcacgagggtggcgtttctggtaatccgtagtgctgttgtctgtggctgcctttggctggcatctcacctcctcctggctgtcctgcagccacctgagggaggtcagcatgtcgccttcatcccaggacagtgtgaatgcagcagcgcaagcttgccagcgccgcactgcgggatctggaggcctttgctcctgagccctgcctctgtgtaatccctaaagcacggacttcttaggggcttccattcctccacctggaaaaaccttacaccgtttagggcttgaggcagggctagagcatggagacgttgctggaggaccaagggagaactgagcgcgtgttctcttggcctcagcctcgtgtgtgtgtttatgcatgggtactttgccatccacactggcttccacggctgggtgggagttgagttgagctcggcggctgcctttccaccctgcgggcctggttggggagtgtgaggatgcctgctggaagccaacgtgcacgaaagagttaatggtggatcccatttcctcagccccctctccagctttcccagggaaagggcaggaacagagaggccttatcttcagaggaaggggtgggcggggacacagcgctgttcggcacagtcccctctgagccaccctgcatgtttcattccaccgacttctgcagcccagctgttcagagcggatccagaaggtggagagagggtttccaataagcagaggatggagtgaatgtgagattcattactgggatttggcaaagcaaagagcctcactttctccccgcagatgggacgggggcggggctggagccagcggggtgggggtatccagcaagagctccttcccatcctcccacttcctttgccatgggccccctcctccacgcagaccctcagcctggaatgatcagtgtccagcttttctcgcccctctcctgccccgctggagggagtgacctggcccctggccccggccacctacacctcctgttttgctgcactagcctcgtggtaggggctgcggcggaggtgggcaaaagccgcttccgggcagccagcccccatcctgggagtgactgaaagtccttgggggttcctgcagggtgagctgcccattctggccctggtaaggacacccaggagagggccagggtgcctgtatttggggcacagcataaagaacagccgtaagtgtttctcaggcaggagggtgccgaagcattgggaagctgggatttagaagcattgtttggggtggtgagtggaagatgcaggacacagattcacgcgattgtgcagatcacctggcctcactccctcggtttacagtggaggaaactagaggccgagagaggtgaagtgagttccctggggtcacacagcctagccaggcccagggcgccgacctcctgctctgccttcccgtgcccattcggttggcatcagcatccctgccttgacacccccgtgtggcagctgctgtgattctgtgactcctcctcaccccaccccagtggggccctgcgagggaaagaagaatgccctatgcagaagtggttggaaagcaagaagcctggagagaagtgaggcctctgtggtttggcctgagtccaggactcatggcctggttcccagggatggagcaccgacccctcccttctacacccccaccccacgcccccaggagctccctatggggaagccggaatggacctgggctcagagattgtaaattcatcttgctggatgtgtggctgcctttatgtaaccaactctctcacggagaagccaggggatggctctcagtactctcgggggtctctcagtgaggtgggaggacctcgagaggtcaggaggctgctcaagaccttctgcccctcagggaccaggtgagggcttgtcgactgctctgacctcctgatgcttctggtggggagacctcagaggggcctgccgtcaccatcgccagtggccctggcctgcccagtcatccttctggggtggccaaactccatgctgcaaaagcccaagtgaaccccagtagtggcctgggagaatcatctgtcacgagccaaggatggagtttctggggaggactttctgctgccccccaacccctttcgggtacattctcctgtagccccactccctgtaagaaagtcaggtgcctcccgaagcttctccctggccccaggccagaggtgacagtgggggccccttgcttgcgctggtgactgtggctggttgttggtgcctggccctgccctgcactgtgcacccattgaaggcggcatcatccgggcctctccggtggccatgcatgggtgagcagcccacgacacatctgcttccagcatcgtgtgggccggggctttcagaggggctgagggcttggatggccctgcaggggggtgctcctggccttgtgaccgaaaggagctgaaggtttggagaagccgttgggccgaggtcagttcttatagatttggcgaggagggaacagatgctcacggagctgctccaggcactgcacacactgcctcactctgcgctgacagccaagaggctggttccccgccgacccccattttacagataatgtgctcccccagttccttagtggtggagccaggattcgaacccacgcaggcagcctcctgggcctgtagtcctacccttcatctccctccaggacctatgtcttggggttggcaggataatgactcccagagttgagcacatcctaatccccagcacctgggactacgttaggtgacatggcagggccagctaaggtcactaatcagctggtcttaaaatagggagatgatcctggatgatccacacgggcccgctgtcatcacaagagtttttaaaagcgcaatagaccatctgaggggtgcagtgggagaggcttggaaggaggaaggaggccacaagccaagaaatgcaggtgaacagaaaatgcaggaaaacgcagtctcccctgcagcctcgggagggtgcgcagccctgtggacaccttccctgtagcctagtgaggtggagtgtgggactaatctgtgttgtttgacatcacaagtgtgtggtcatttgctacagcagtgatgggaattgaatgccattaggcagcagtgcttctatcccggaagaattaggataaattcccctgtggatctcaagctctgggagattctgggctcctctggactgctccagttctgcaatcataggaaaggtctcccatgtctgtttgggagaagaaaaccccgtagcaaatccatttccccttttgacaaatgaaggcgagggtgtgggctggacacatgtttcctttttgtggattttttttgttttaacacttagaattctgtagctgaaggagactttggggggttgtctgcctgatttgcaagtgaagaaatggaggcccagggaagttaagtgactggcccagggtcatgcagagtcatgctggaatatcaagctagatagcccagttcctgctccaaagtgctttcctccctggttggggaggagggttggagggagtggaccccgagcaacagcagcattggcaggggttggaagagtagctactgtatccaggtgctggagcctctggccacttcctgcaggaaccaggtgacccaccatggcacaggcctctccctgtctatctgcagccctgggggccccagggaccagaggacactctggcctgagggctggggcctgagagaagagatggaagtacccctagtctggcctgcccccgtggcgtcctgcaggcatatccggcagcccaggggtcctagagaacttggctggtgggcgtccccaccttgccgcagctgcaccctgtggccagcagcttgcaggacttgggctgttgcctgtggccctgaaacagtcattttctgagctgagtggggatcaggtgagcagatccccacaccttaactgctgtgatctttctgtcctggaggctggtgggcagcctggttggtgcttcatggcactttatgaccggccctgtcaccaggctcgtgagttgctcccctcctttcgggcatcctgaacggcttccctgagagccccgccctgggccttcgcctctgcaggcccccgctgcctggggcgcctccttcccctggaagctgggcctctttggggactcattaagaagggccttgccgagtgctgccaaattgccccatctggtccccatttgttccacttaccaccctattttaacttttatgtctcctccttggctctaagatctgagcaggcagggcctgtgaggcaccccaggtcccctgatgctgccagcacccaggggactgttagtacatatgcagggagggaaggaatgaaggaagagatgacttggggagtcctccagttcccatttgtaactggcacattgcgacaaaacactcatggcattttacctttttcatataccttttttttaaatttatttttatttgagatggagtctcgctccgtcacctaggctggagtgcagtagcacaatcttggctcactgcaacctccacctctcgggttcaagcgagtctcctgcctcagcctcctaagtagctgggattataggcgcccaccaccacgcccggcgaatttttgtatttttagtagagatggggtttcaccaagttggccaggctggtctcgaactcccgacttcaggtgatccgcctgccttcgcctcccaaagtgttgggattacaggcgtgagccactgcacctggctttcgtatatctataaaagagaatttgcccagaaaatctttcagatgcacctttagggttttaaggcacagatacatgaagcttgtcagtgagcagctgctgcttattcctttttctcttccaattcagagcggcctgcgtcccaagcggacagctgctcccttcctcttggctccctgctgcccacgctcccacagaagcagggagaagaggcaggaaggtgacgcgtgatcatccgctgggcgcccgcacagtgccgtctgcacaggtgccatctcctttacttgtcactctcctcgctgagccctttcccctttttgcagatgagagagcattgcctcccagaggttaagaaatgggcccagagtcactcagctgatcagcgtgcagccagatttgaaccacatcctgctgatctccatgcctgcaggcctggcctgatgagatggacagctgggtggtggagaccttgagaccctggatggctcccaaatagggcctgtagctcctggacagggagagtctggcacaaagggtttgtggagtgagctgggggagaaggtggcttagggtccctgtctctgaacaaacagatggaggggctattccagcgttttctcagcctctggtgtgctgggctcctggttctgggaggagagaatggagctggcctccattctgggctgggctggtttgggcccaattcagacaagcttcttagtttgccatgagtgacacttttgcctgccctggtgtctctgccaaaaatatgaagggtttcagaacccccaccccggcctgcttccctcccagacttggagtgggtctggggctgacaacagtctcatgccagatagcctgagcagccaccagtgccatcaggtctgacactgcggcccctgccccggagggaaaaacaaggccctctctgggggattttctgccagcttgtgaaaacaggcctggagtcagccagcgcccccatgcttagacacttcgtgtggttttcaaagtgcttttatgttgctagctcatatgatcttccccaaaaccccataagggagggcaggaagtttgagcaacagcctgtcaagcacccatacagcaggtggtttcattgccctccatttacagacaagtaaactgagcttcagggtggctaccgcttgtctcccaagccacccagccatttagccacggaagaggtcatgactttttacaccccagtgaagctgaagatttttctttccgtttttaaaaatgtttactccccagggcagtgaacacctggtgcctctgtctagcgcaagaggtgaacgtttgccacttccgtttctttcctcctaccagacctgaccctccttttgtgacgggaacatcctgcaggcagtctgtcctgctttcatagactttgagaaacggggtccaaattgccggctgtgggtgggacaggcgacactgcagtgaagaggtggagtatttttgtagcggggaagaaatacatttcctctaccctcttaggttcagtgtttgggggtctgtgaattaaactcactcaagataaattaatgagagaaaagacagatttaatcacatacgtatgggatttcactgaaaaacgtgactcaaaagagcaggtagaaggtggggcccgtgactggtccgaaggtagtgagttatctcagttgattgttcacagtcagttacagattagactccttgttccactgtctcccctcttcccacttgttttgttttttttgagtcagagtcttgcactgttgcctgggctggagtgcaatggcacgatctcggctcactctaacctccgcctcccgggttcaagcgattcccctgcctcagcctcccgagtagctaggattacaggcacccaccaccacgcctggctaattttttgtatttttagtagagacagggtttcactatgttggccaggctggtctcaaactcctgacctcgtgatctgcctacctcggcctcccaaagtggtgggattacaggcatgagccactgcacccagccaactagtcttaaaaaaaaaaaaaaaaaaaaaagaacttagggcccgtatactatcttaataggaaaaaaggaaggggtgaaagcacatattatgggccgggtgcgatggctcacgcctgtaatcccggcacttcgggaggccgaggcaggtggatcacctgaggtcgggaattcaagaccagcctggccaacatggtgaaaccccgtctctactaaaaatacaaaaattagccgggtatggtggtgcacacctgtaatcccagctacttgggaagctgaggcaggagaattgcttgaacccacgaggcggaggttgcagtgagctgagatcataccattgcattccagtctgggcaacagagtgagactgtgtcttaaaaaaacaaataaaaaaaaaaaagcacatattatggcaaaacaaatgagtttttggaaagataaataggcccttaggagctgagatgggagatgtgaagtcttgtgacaatgtcttcttaggtgtggtgtggaaactactcacatcttccagggaagagtcagttgctcccagggagcagatttgggcctgtataccatcttaataggggaaatggaaggggcaaaagcacatattatgggctgggtgcaatgtgcccagtgcaggaggcagacgtggtttatggttgctgttgaaaccagtgcagggcccgattgctttgtattgagtgttgaggatcctggttttgtatcagccatgagtttgcagctctgggacacacttgatgttggctcaaggggaaatgaggttggaggggcagggtggttggattggatgtgggcctggggccattgctgatctacaaagtggtcatcacacgggaataatagagctggctacagaccacaaccagcaatattatttaaaagtaaggtcacacttttaataataagtcacattttaagttattatcaatttataaaacacactgttggtataatgatagcttttcaagaaggatataaaaaggcatgttgggctgggtgcagtgactcacgcctataatcccagcactttgagaggctgaggtcggcggatcacttcaagccaggagtttgagaccagcctggccaacatggtgaaaccctgtctctgctaaaaatacaaaaaaaaattagcttggcgtggcggcgcatgcttgtaatcccagctacgggggaggctgtggcagaagaatcacttaaaacctgggaggtggaggttgcagtgagctgagatcgcgccactacactccagcctgggcaacagagccagactccgtctcaaaaaaaaagaaaaaaaagaaaaaaagtaaaaaggcatgttgaaggtacctgcttgtggaaagttgcaacttgacgggaggtagggcgagcacttcttagaaaggtggaaatgggccctcctgctacagagacccacaaacatagactgaggcctgcagcctaggagactcaaaagaggcaaaggtgaataagagtcaaggtctccaagtcagggtctgactctgggggtgggggtcacatatgatggaggatgtcaggagggcttcctggaggtggtgacatttaccaggggggattttaggtggggtttgcgagacagtaggacctggctgaagagcgtaggctccttagacaggagtgggaattcaggcttgaaaatgagttggccagattgcaggggtcctcgaatgcaagggaagaatttcaactttaacagaggagcctgggaagctgtttgggaaaaggagtgataaagcgggaggggtcctccagcagagccctgcatgggcaggagggagcgagatgggaggtgggtgttggtaagggatgatcccagtggtccaggggagcagtcatagggtggaaactaaccttgtggggtctgggcaggaagggactgatttgagacaccgggaagaaacagccagtaggactttggtgagagggctgggggtcggggaggggggtgtggagagtgggagcttgagtctctgaaaacagacagtgttccaagggggagacctgaggcaagatgtggagaggcagctgagctgggaagctggaacggaggtgtggtcactccaggagactaagtcagggggcgaggggacccttgggagctatctagaccccagcactagggaatacggaggggagaaggaggggagaagaaccagctggtgcgtgtcaggcactgccctcgaggtcagatggggtggggctggatactggccatgaggattttttcaagagctgggttaatagtgagacgggcggacaccagatggctcgggctaagaagtaagtgggcggtgggaagctagaagccgtggtgtagacctactttgagaggttgggctgttcagacagggagaaagttcacagtttgaggaggtagataggtcaaaggaagagggtttgcttgtttttgagattggggcatcctgaacgttctcccaggccaagtgagaagaaaccagaagaggaacatgtcacccaaatgtgctgaaacagcccagcagctgcgctgcctcacagaaaatgtgcagaggcccctctgtcccaccatgcctgcctggggacggccttcactcgggctactcagggtttccccagcctgccaacccaagggtggcaggagctgtgggtgctcccagccccttctcaaggttggtctgtgggtagaaatgtgggctgcctcggggcgtcacagctacaaatgcataccagccctcagaaccacattcctgctccccagccctttcctccgcacccccatgcagaagcgcggccgccagctcacaaaggatagggagggatattgctcttggcatttgatgggaagcatctgctgcatcccattggggtgttgcccaggatggattggaaaagagttggcaggaaggctgagctctgtgctcacaacctggcttggtggtggccgaggagcttggcaggagcagagtgcaggacctgggaactgggggttggtgcatgtgtgcacgcacgtgtgtgtgtgtgtgcgtgcgtgctgggtgggtagggaggaagctgtgaaaccacatcccctcctctctgctgctgtgttgctgtgtgtttcagcagcacgtgggtgtcaccacacttcctagcaggtgtcaacctccaagactgttctgggctcttctcccagttggctgagttggaggtgggagtcccaactgtcccctgtggcttccagagtgggaccttgctgtgggataggctggccaatggtgctccctcccctgtgacccttctgttgggtgggtcacgaggaaggactgtgggtgttgcccacagacaggtggacatgtggcaaggacaccttgggaccttctttctgacgccccttgaagggggcactttctcagctttgagatgagtctctgtggatgtgggaagttcactatctcaagagcagcagccttggaaaatccaacacagaaccccgagtaggggcgggaaggggtcctgtcccgctcactggctgcctggcagagttctgcacaaggaagcgcctgtgttgctgtgggcggaggaatggactgagggctacattcgcttcctgttgccgctgtaactgcttatcacaaactcagtggcttaaagcaacagaggctccttcctttacagtgctaagggtcagaagccgatcagtctcaccggactaaagtcaaggtgttggcagaatccattcctgcctcttccagctttgggtgggaggctctgctggagttccttggcttgcggctgcatccctccagcctctgcctccatcctcctacagcctcctccttctctgcagtcagatctccctctgccttcctcttttttttttttgagacggagtcacccaggctggagtgcagtggcacaatcttggctcactgcagcctccgcctcctgggttcaagcgattctcctgcctcagcttcccgagtagctgggattacaggcatgtgctactacacctggctaatttttgtatttttagtagagacagggttttgccatgttggccaggctggtcttgaactcctgacctcaggtgatctgcctgcctcagcctcccaaagtgctgggattgcagccatgagccatcacacctggcctgcctccctcttaaaggacgcttgtgatttggggcccacctgggtaatctcttcatctcaacatcttcagttacatctacagagtccctgttgccacatgaggtaacacagtttgggaagggagagttattcagcctaccctaggggcctgtggtgtatctcagggcccttctgattttaagatataaagcaagaaaacaaactggctcaaggggaaaaaaggacacgttgaattctgttgctttaaatgtatatttttttattgtgctaaaatgcacagaacataaaatttgccattagtaacactgagtacattcacagtgtcgtgcaaccatcagcactgtctagcgccagaactttttcatcaccccaaagggaaaccccgtatccatgaaggactcactccccattcgccctctccagcccttggcagccaccagaatgctttctgtctccataaattcatttttaataagtgcaattctgtgtgactttaaaataaataaacatgagcacgatgagttgcttattggaaggatatccatgcggggaggccggcgtgtggagtgcgtaggcctccggacgggcaggagttgaaggggcgtggatgtgccgccctctcctccccttgctctttccttggggtcactgcctgagtatccctctttgcaaatggccccaaataatgtctcagcccccacgtctgcatcgcctcctagcttcaggaccctccaccaaaaaacattccaagcttcagactcactcctgggaaaattccaatggcctcactctcccttttgagccagccagatcccatggcctgtggcgggctgcctttgagtcctgagcacctgtgagctagggaagcaggacaggcacacccagggaaggggaagagtcgtcgtcagtcacagtaattgatatctttggaatcgtctaagagatacttagcgtgtgcctaaaacattcatttctttttttgtttgttttttgagacgaagtctcgctctgtcgcccaggctggagtgcagtggcgtgatctcagctcaccgcaacctcctcctcccgggttcaagcgattctcctgcctcaacctcctgagtggctgggactacaggcacacactaccacgcctggcgaatttttgtatttttagtagtgactgggtttcaccatgttggtcaggctggtcttgaactcctgacctcaggcaatgtgctcgccttggcctcccaaagtgctgggatgacaggtgtgagccaacacacctggccacattcatttcttaggagaagctctgcattttctgaaagtgaaatgtccccaggcgggtgacactgatggtgggatctgtggcctcaccagtgtcttatgagagatgccgctgtgtgtttcaccaagctgtatcctattgtcctctaaatgtggcttgtagacatggtgccgagaatgatctgggaggttcaaatcataatatggtccaaatcaacagctctctgatgacctggtattatcctaggatcaaattgagactatccgaggatgggcgtggtggctcacgcgtgtaatctcagcacttcaggaggctgaggcgggcggatcaattgaggtctgtagtttgagaccagcctggccaacatggtgaaaccccatctctactaaaaatacaaaaagtagccgccggacatggtggtgtacgcctgtagtcccagctacttgggaggctgaggcgggagaattgcttgaactcaggagacggaggttgcagtgagccaagatcacgccattgcgctccagcctgggtgacagagcaagactctgttccccggcaaccaaaaaaaaaaaaaaaaattgagactctccgagctgcactgtccagcatgatagccactggctgcacggggccatttgaacacctgaaatgtggtgattccaagtggagaggtgccgtgtgtgtgaagtgcactctgggtttcagagtcctagcaagggggaaagaaaagaatatcaaatatctgtcatttttacattgattacatgttgaattgataatattttgggctctgttaagtgaatgatattaaaattaatatcacctgttcttacattttttaatgatttcctttttcttttcttttctttttttttttaaatatggggtctcacactgttgcccaggctggagtgcagtggcacgatctcggctcactgcaacctttgcctcccaggtttgagcgattctcctgcctcagcctcccaagtagctgggattacaggtggctgctaccatgcctggctaatttttgtatttttagtagagacagggttttgccatgttggccaggctggttttgaactcctgacctcaggtgatctgcccacctcagcctcccaaagtgctggtatgacaggcgtgagccactgtgcctggcttgttcttacattttttattgtaggtgctggaaaatgtaaggttgcgtctgtggcccatgtgccgtttctgctggagggttggaccgagggccagccgagaaggctctggggctgctctacctgaatgctgagtgtgtgctgagcggtagagaactttgagaagtgctgaaggacagaggctttgtgtgggggatgcagccccaggccggagatgccttctctgtgctctggagaccctcatttggtgacagcaagaggaaccactgcaagaggggcggccacctcagcaaagcacccaggatgctggcctcccagctcaggaatccagaggcagaggaggggaggaggctgggcttggaggagagcagggtcttgggccctgggaaaagcctggggggccagaaagctgggggacagattgaggccagaggcaaagagaagaaggttcggagaggagggccaaggaagaagggttctgcccacggggagggagaggcccacggggcaggggcgtggtgggagctgcatcctcgaggctttctgttgaccctgacacctggccagaaaggagttccttctggcatcctttgtcagcggtttctggagctgccctttaggggccagtgatgagggtgccctgggctgggctgcagacagtggaaaagacaggctcttctcactcccagtgctggggaaattagcttcttggaggaagggggagctgtattttctgagtggccgcacttcctggcctagacgtgtgtgtcttgctgtaattttggcgactggtgttggtggtgcccattttatggatggggaaggtcaaattccacagatattgagtgacaggcccagggccttggatttcagtgtttgactcagaacccaggtctctgatctgccaccagcctccctcccattcagatgggaacagggactccgggcatgcagtcttctcccagacactcccccggctctggcctggcgcccggagaccagtagcagcagctccccacggccgttcactgtgagggtggggagggccgtgggaccaggaggccttagggggaaagttggccatgaggagtgggaagcgacgggtcagatgccagtgactgctggctggggagccgctggacgtggctggcctgtttggccagtgtggcgggtgccccggggcttcagtcacccccagccacgtgtgggggtgcgggatgggaaaggtaagagtgtgtggagcccagtcagcactcaacatgaggtcccgtgggggctgcctgagggcgtagcttccagaattcagcccctggccctcagaaggtgtcaccaaaggcttctttccatttgagtgaatccctcccagcccccagcaagccctcggaacgagcccactcccaggcgctctctcctagtgtgggagtggccacgcccctgctgggagtgactcacttgggttcagaggtcgtggcactgagatgggtctggcagatcccagcgtccaggcccagcccctatagtgtcagctccctcctctggggacccccttgcttgtgcccctctgggtcccagcacatcccaggcctgcagggagggggagaggaagagactgactcactggccaggtcccccaggggctggagaggctggagaggcaggagctggatcagatctgaatccagaggctctcggaggaagagctcagggtgagctgcgcccccatcccctgcccctcctctcctgctccttctcccttccatggtcccagccagcaagcacctggggtagaggggacaaacccaggtggctgtgttccagccctggctgcaggtctgaatggctttctggggtggctggccatgctccctgagagcccagctgtggcgatgtctgagcaggtaggtgggggagcacctaggaagcaggggtgtcaggcagagcacaaggagagagggtgtccaggtcagtttcaggacctggctgagaggagggggctcctcacgggcaccgcctctggcaagcacagggacaagggcaaggacggcatggccagaggtccctgggagcctcttcccctctcttcttcctagcagctccccctcactcttcccagggaccctgtcactttcctttagcgtgtggcagctccttggcgtccctcccgtgccttcaggttgcttctgcgccgggcctgccgctgggcgcccctatctctgcctgccccctcctcctgctcccctcgccctgcccccttggagcaattccccaccgagcctcccttcccaggcagtcgaggtccctccctacctctgccccgcgctctgggaggctccttgttccgcgaccacaaagcccctttgatcctctgctcggctctgagccatgtgacccggtgggcgggccgcggctctcggcgcgtccagcgcagcccgacgttccgctgctggggtgagtcctgctcctttgttcttcccagccttgcaccactggctcgggggctctcaggtggcgcggccgcgaggcggaccctgatggccatggtggcggtgccgggagccacgctgtccctgggccccggcccgaggccggcaggaccgagcggggtccccaggagaggggtggcggggagctcgatctccacgcggggaccagattttcggcctcaaaatagaagaatagggctttgtgtggtcacagctatctctttgtaaatatttggccaactaagctgagtggctaagttctcctgctgcccggagcttcttggaacatgtttccttttcgcaaggggtttccctggcttccaggagggccaggaagaaattcgaattggccaccgctttctctaaaatcactccgctcaagttatcacccctctgggctcccgaagaccggctggctggaggctggagatagtctcaatgctcgaaatgccgtaaccgaagctccccgcggcgccggcactgggatccagggagctgctgctacagcgcagctctggattcctggatgtgttggatatgtgcagggcgttcctgggaggagcggggagggagggtgctgctggcggggctggtctgcgtgtgctttgcttctctacaatggcatgctgcgtgtcggccatgcagaggcatgtcagtgagcaggggctgagggatctccctaacggacctgctttcagagggtcttttcatgctgggagaaccccagagactaaatcatgcagccaacggggtggtccccggcctcaaagcagggaggggcgaggagctttgtaggcaatgccatctgctcctgaaacgccgtcccagtgactctggggactgactcagcctccagcctgctgcacttcatccctggcccctctctctttgctttttcatgtgaaatctgctgtgttttggtcagaggtttggggaacagctctctgctcatctaagataagtttgtaattcctttcctggagaaaaatatgccacccggaagcaggttgagcagtggttttctggcaggtctgttcggggctgtggagacagcacctgctggatcaggatggagttggaatttggtttggatcccacatgagaaaacccgttggaagaggaggaagcagaaaaaggccccattccctaataatgctgtgggttttcctcctccattcattgccaccttgccttgaaacttaatggggccacgtgtgtttccatgaatgtcattctctttggccaactcccccggcagccccaggagctccttttcaggaaaaggaagaaggtgtttgcttagcatctagtatacgagtccttgttggaaaggtgggattcttgtttctccttgggtctcttttaggctgagatgtggtcaaggaaggcctgtggtgtggctcgccttttttaatgctcgtctctggagacctgagttgctgctgactcccagcttgccccttctgtcccctggccatttctgtgtcggggtggctgagacactattgcattggccactttgtgttcccactagcccccgcccctgtaggctgtcattgtgatggtgatggggccaattcagctgcggtggggaggacccactgtgtgcgcctggggggtggcgtggggcactctgggatgagaagatgcgacttctgccctgagagccctgctttaatggaaggcgggggcatagttgcaggcagaagccatcaagcactgtggtcagaccagcattccatgtcaaaaatggccttgttggccgggcgcagtggctcatgcctgtaatcccaacacttcaggaggccaaggcaggcagatcacctgaggtcaagagttcgagaccagcctggccaacatggtgaaaccctgtctctactaaaaatactggctaatccgggcatggtggcgcgtgcctgtaatggcagctactcgggaggctgagacaggagaatcacttgaacctgggaggtggaggttgcagtgagctgagattgtgctactgcactccagtctgggcaacaagagtgaaactctgtctcaaaaaaaaaaaaaaaaagccttatctgggcctgggatctgtcctccgaacactgggtccactgtgctccacaaggactttcaccccggaagccctagacccacttgggcaaccagagtctctgggttgaccactccccagccctggccagcctcctgggccaccgtattctcccaacttcctgttgtgccacggctggtccaagctgctcttatcagacaatgcgaggcacttccacaggaggggacaaccccgtccttaggagccccttctccctgcccccaggcctggtgcagtgtgtggcttccctgccggtgtcaaaggtctcaaggcccctttaagaagcctgtcaccaccaccagcagcttccgttatctggttcttctgtacatgtaagcctttcccatacaccccggatgtttagggcttccgccctctctccctggccgggagtgtgggaagagggctttatttcaatgcttgagagtagggtcaatggccagggtaagctgtgggggctcctccccgccggcccctctctgcagccctcaccttaacacagagcatcgataccacctgggctttgggaagacctggaggctgaccaccctggaggctcccagcgtcccacagccactctttggggaagaggcttcctgagggacttgtggcccttggctgggactctagtcccagagttctgccttccggcgccgagctttgatttgtttattgagtgccagcccggttcccggacaggtagggacctgttcccggagctcagcagagccttgggaagctttcccaggagggctcccgagggtggcggccatgcccagtccgctgtacgtgtgagtttgtttgatgaggaattggctgggaaggcgcgggtctaattacaggcccatgagggtccctctcgcccccacccaggaagcagcggagatcctggcacactcagcacctgggcctgtgcctgcccagctgctggtggaatcatgggagccttgctccggggcctgtagagcagcagtgggaaccttccccacctcagcccctcccagagttggctgttcaaactcgccgccgctcagcctcttcctcctctctttcatcaaccctgggaatcgcacactgcccaccccaccgggccccggagcgggtgcaggaagagagagcttaacacccagaggtctgggccttctgcaggcgcctgagctgctgtggcctgagctgggttccctgctggaaccatcacagtagacctaatgatctgcctgcaggagttgcttcatcccagccgactccggggctgcgggaaggggctgggccttggttttgctgggggtggggggtcagtgcaaagggcctgaaaagtggcagaggtgatggcccatctgtcctccccctggccggccggcctaaacgcgattggctctctttcttttttttttttccctcccttttccctataaataacactaaatgcgatttgtcaatgcattcatttgggttcagtagttggaccatgggcagaagcactccagatttgtcactttccctaagctaagggtggggaacaccctctgtgagatcttggctcctgagcgcccaagactgctcttggaaccccaactctgggtcggtctcaggggactgacgttgatggagttgctgacattgacctccggcctctgcatggccttcaggaagggggcccttcgctctctgtcccgtcgagcctggctggcagcactcccttctcaggcctgtgcccccggcagggcctgctgcccccgccctgctctgtgggtgccaggctccaagcaccaggtgactcggtcactgaatggtcactgaacagtcatccttgctggtgtccccagtggaatgtgcatggacgtcctccctcccccagatccttgtcttttatctctcagcctttgttccaggggccaccacaggaccaggaggtacgcagacgtgggtggcacatccactgggcagattcagccctgaacctgcacgccccctccaagggggcccccagcgggcggggttgatggtgccgtctctctctctgtcactagaacggacatgaggattgtgtcttgtcgatccacgtcctgagttcccagacgtcataggtgcttgctcaacgagtgtttgaatgaatggtcagcattgtgtgaccgcagattttcaacttttatccaaatagtttgtggtttctgtgaggctatcccgagacagtctcacaagaatctccattctccctgcacgctccgcacaaggtctccttggggggtttttcagaaaaagggccaaagagcagcatttcctcggggatttgaacacgatctcccccggggcaggggactgccctggaagattcccggcaccgcttcccatgcgccacgtgactaggagggtcttggggcaggatggtgtcttttgtgccttgtgtgctggggccggaggaaacactgcccgtggccggtgtcatctgccagccctgaagactaatgatgggctggacagtggccccattgagtgggagggagaatcgctgctgtctgtagctggggggccgggtgggtgggagccgaggccagggagaacagcgcagacctggcacggagaggcctggaggaggagcagggggtctcagccacccagggtgcagggacgccacacgaggagcaggtgtggtgtgcgtcctcctgcgggttctccacctcttggcttcgttacctgcactaggctttgtggtgagagggcacagagtggaggaaggtgccgtggctagggcaggccacacgctgtgctaatggattgctgttacctgtcgcctctgtggttttgctgtcaggatcctccagcaccaggtccccaccaccaggtatgggccccacaggcactactggctccccgaagccagggacagaccccatagacaatactgagtccctgcagccagggatgggcccccacggccagtaccagatctcagggaccagcaccgggtacccacagccagggacaggcctccatggccagtaccaggtctcagggaccagcaccgggtacccacagccagggacgggcccccatggccagtaccagatctcagggaccagcaccgggtacccacagccagggacgggtccccatggccagtaccaggtctcagggaccagcgctgggtccccacagccaaggacaagtccccacggccaataccagatcccagtgaccagcactagatgtccacagccagagatgggcccctatggccagtaccaggtctcagggaccagcgctgggaccctggatgactgaaggagggcacggttgactaaagctgcaggagccagcctggccatcctgaggcactaagccatcactgcggtctcaggggactcagactcctctacttgtcttcttgaattctggaatcagacacacctgggtccagcctttgcccccggggctgtgtgcctgggatggttgcctcacctccctgaagctcagtgagatggggacggctgcacagggcccggcacagatggcacccgatggcacagggtcacctgcttgcatccatacagcctcggccctcgctctggctgcgtaccgagagtcccatgcccagacctctgctgagtctccaagctcctggtcatgcctcaggcctcccgtgagaagcatcactgcatggaccatgcctcgggacctcaccttgggctgggaagcttgctccatctccccaagtctcccctagaggcgccccatgtcccatcactctcactgcttgaggggtcagataggggaacccagtgtgggaggcccagaggtgccggagcagacgttaagcgagttccgtgtttatgcgctgggccttggcagacaccctgaatgagcctcttccccaggaaggagattggggtcccagtccaagttgtggcctcaaaccctgtgaccaagagtggagaaaaggcaagacccctcctcccagtcttccagaacagccgatagtggtggaaacatggggttcacactgaatttccttgtaacttgttgaagagaatttagcccacattttcaggggtggaggtctggccgatttggcagtgtgcccgtccccctggccacagtttactctggaccgggcaccctggtgccctccctcagtgacgcagtgaagtcactatgacgtgtttagttggtgagaaagtgcctcctgtaatgttttactcttcttagagggtgaataagccttgtttattataaataattatttacagaatacatgaggtttaacctaactctgggccacggcagcgtcccctgggtaaacccacgcgccaccctagctagagcctgtgcccccacaggcttcctggactcaccctgaaggggggctggattttctgcctgtcccgatgagagggctgcaggacagtccccagcgagcccttctgagggctgtaacctcttcccctggtattttcctgctcgccaggaatgtttcaagcttccagcagaagcctacccaccatagtcgctttccaccctgctcaccatccctcctgccctcactcattcagcagaccccgtgcacagcccagtgcaggactcagggtgggaaggtgtcccgggtgggctggagcaaggttcccagccagggcggggtcccaaggtgggtccacagccaggactgtgatttgggaggcccctccctgccttgttccagccccggcaccgccgctgtccttgtgctcagtggagactcactggctccaggctctaaaacctcagcgaggtctgcagacagggaggagccccactcgagggtagagtgactgccgggtccatttgcctgttacgaaccacgtggcctcagacctgccattcctcctctcctagagctatggtcttttgtctgaaaaatggataatgatggttaccatgtcagggaccattttgaggacaaacggggatgaaactgaagaggctcagcacggaacctggacacagaagtgctaattgtgtgttaccagctgcggtggctgccaaggcccaaccacatggcagccacgggctgagtggcgggcgggaagtggggagcaggagcatgcaagatgggcattcctgaagtttctgatccagtgagataagtacacacccagctctaagatggagtgtcccaggaaggtggagactgcaaaggccttgtggcgcaggagtgtgagctgcacctctgggctctctagaatttcaccagagctcagggaggaggtcagctcagatataggggcaacgggagagatgggagtgagaaaatggcttggcgtctggaagtggagcctggaaaggtgggcgtggggacagaggagggccttgggggccatgggcccatgcgtccaggaggtggaggcagtgaacggggccacggtcggccccacacgtggcaccaccagccctgctgagcctgcacctgctcctcaggccccctgagtgccactaccacctggcaccccttggtctgattcctgcttcctgcccgcctgggaagagtgagaccacttgcctaaagtcccttagctgtccttaaccattctggctgcctcctggccctgtccagggttagccgttgacctgaactgcctggtgccacctccccagactcctggggccttgccctggcaccaacagccacctccatcttcatcattcactcgcacattcacccagcagtgctttttgggcatccactcagcaatatcaaggcgctgagatgcggctgtggttaagacccgggcccggtctgtgaggacctcgcagttgccatttccccagagcacagccccagccaggcacactgtggggtccagaaagagaaactaatacattgtgttcgtccattttgagttgctataaggaatagccgaggctggggggttatttgactcacggttctgcaggctgtacaagtggtgccagcatctgcttggcttctggggaggccccaggaagcttttcctcatggtagaaggtgaagggggagctggcacgtcacatggcgagagagagaactcccagactctttttttttttgaaatggagtctcgctgtgtcagccaggctggagtgcagtggcacaatcctcggctcactgcaacctcagcctcctgagtagctgggattacaggcgcatgccaccgcgcccggctaatttttttgtatttttactagagatggggtttcaccatgttggtcgggctggtcccaaactcctaaccttgtgatccacccaccttggcctcccaaagtgctgggattacaggtgtgagccacctcacccagccctcccagactctatagcaatcagatctcccggactttgtgaccgtggggagggcaccaaaccatccatgagggatccacccccatgacccaagccccaccccccccaggccttacctccaacatcagggatcacatttcagcatgagatttggaggggacaacgtccaaaccatatcacacgtgacctctctgtgcgtgcgtcagtttctacatctggttaagcagtagaagctccttctctgttccttgttgagagagcggtgggggagaaatgactcagggatgggaggctggtcccccgaggggccctggtgtttgtggagtgggagtgcgggaaggcccctacgttgtgtgtgccgtgctgggctggctcctcacagctcaccgtggtgctccccgaggactgctggggaggaaagagctaattaacttggggacccagctgctgaagttatcattaaacttgagcagtccaggggcccctctccttctgggtcctatgtcacccagcacagtggggcttaattgaattttttctcatcccccaaggctcctggctggcgtggctggggtttgggatacggggagcgagagggcttgggcctcttccagatttggagtgggttcaccagaaatggcccaggaaaccgcgggggccacccccagcagctgggggctcctgtggtcatttcctcttggtcctgttgagcagccctggcccctggagccctcagcaagggatgtgggggcctgccaggccagggtcctcactgctgccgctatgcacagctgcatcttgcatccggggagtggggtgccgagtggggtgtttgggaggcaggttttcccttgtcccttctgcccagagaccttggggatgagttgagtgagacccttccggcttctgactggctgtgtttctgttgccatcccccactccttttaagtggaggtttatgacttccttctttatttaaaagggtcatttagtgacttagcagatcccagtctgtgttacccagggcccttttaaaaatctgtggggaggctgggcttggtggctcacacctctaatcccagcactttgggaggctgaggcgggtggatcacctgaagtcaggagttcgagaccagcctggccaacatggagaaaccctacctctagtaaaaatacaaaaaattggctgggtgtggtggcacgtgcctgtaatcccagttactcgggaggctgaggcaggagaatcactcaaatccaggaggcggaggttgcagtgagccgagatcacaccactgcactccagcctggacgacagagtgagactctgtctcaaaaaaataaaaataaataaataaaaataaaaatccatggggggacctctgtgtccattggctggtgtgaggagagggtgaggagctgcagagaaggtaccaggctgaggaccgcccccacccttgggctacagaattgaaggaggggacacatgaaagatgttcctagactcgggctggaggctggggacatccgagggcaaggacgacgctgtccctgctcttgtttgcagaggagtgcacagggctcaccagcttcttgttgctgtttaagtgatagctttatggagatagaattcacatactgtgacgttgacctttttaaaatctacagttcaatggttttgctgtattcacaaagtgattgtattagggtcatccagagaaacagaaccaatagaaggtgtgtacgtgtgtttagataaagagatttattattatgaggagttggctcacctcattacagaggttggcaagtgccaagattggcagagtaaatcagcaggctggagacacgggagagcccatgttgcggctctggtgtccacctgaaggcccaagacccaggagagccaatggcgtcgttccagtcccgagacccaggaaaagcgcatgtgtcagtttgagtctgaagcaggaaaaatctgatgttccaggttgaaggcggttaagcgggaagaattctctctcactcaggccttgtgtcctcctattcagaccttcaggcctttgtcacaaaattacaaagacctgatcagaacaaaatctgagaaaaaaccctttccttctatcggttttggattcattggctgggaccctggaaattagactgacagagattaacaggaaacaagcataacaattcaagtaagttttacttgacaccgagccttcataaggaaatgaagacccagagaaaccgttagcctgagcggtttttgttttgttttgagacaaagtctcactctgtcgcacgtccaggctggagagcagtggcccgatcacggctcactgcagccttgacttcctgggctcaagctggggcccagctgccggccccgggagctgctctgaacccactcttaagtcccagctcagactcccaagtagctgggactacaggcatgtgccaccccgcctggctaattttttattttttgtagagacagggtcccactatgttgcccgggctggtctcaaactcctgggctcgagcaatcctcctgccttggcctcccaaagtgctggggttacaggtgtgagccactgtgcccggcctaggcctgaacagtttttatttgttttgcttgttttttaaatttgtttgttgcttgttttgagcagtttttttgtttatttcttttgcttgtcttttgcccaggctggagtgcagtggcatgatctctgctcactgcaacctctgtctcctgggttcaagccattctcatgcctcagcctcccaagtagctgcgactacaggcgtgtgccaccacacccggctgatttttgtatttttagtagggatggggttttaccatgttggccaggctgttcttcaactcctgacctcaagtgatctggccaccttggccttccaaagtgctgggattgtaggtgtgagctgctgtgcctagcctaggcctgagcgtttttatgctgggtttgatgaagagtggaaagtcgtgggaaactgtgacagagcaacaaaagatgagctgaacagtgagcccgtgggggtctcggcaagacctgtgtactggggcccctctcagatcctctgtctctggagatgaggctgttcctttccgctgggtgtagggagggcacctcttacgtgaggggcttatgatctacttcagagaaggggcaggtcagtgagttcttcttggacctgccatttcttaaattccttcagctgaaaatatttactatgccaaggcactgtatcttggagtgtgcgttccaagccctgttgccttcaactgatcgggtgaggcccacccccatcagagcacacagtctgctttacccaggctcctgattgcacccttttcctgtttgccccgagaatactcaccagcagtgcttgtggctgcagcgttcaccccaagataaatttgccgggaagtatcttgcttttattattattttcacatcactctagtatatcgactttggaaacaaaagacatcattctgtttatagcattccatttttagtagtggtatttcctttaaaaaaaaatggtaattctcagctgggtgtggtggctcatgcctgtaatcctagcacttgggaaagctgaggcaggctgatcacctgaggccaggagttggagaccagcctggccaacatggtgaaatcccatctctactaaaaatacaaaaattagccaggcgtggtggtaggcacctgtaatcccagctacttgggaggccgaggccggagaattgcttgaacccgggaggcagaggttgcagtgagccgagatcgcgccattgcattccagcctggacgacagagcaagattccatctcaaaaaataaataaataaataaaatttaaaaaaaaatagtaattctcgatcgctgaaaatgtcaaatcctagagaacacagcattcctacaagtgatgttaacattgttcttgatcagttgttggctgaagattcatttgatgaatctgatttttccagaatagacgactcagatgactctgttgttttgcttagaaataactgcaggaacaatttaaaaaattttttttctttttaatttttttgttttttgagacggactctctctgttgcccaggctggagtgcagtggcacgatctcggcttactgcaacctctgcctcctgggttcaagtgattctccagtcttagcctcctgagtttagctgggattacaaggtgcctgccaccacacgtggctaattttttgtatttttagtagagacggtgtttcaccaggttgaccaggctagtctcgaacccctgacctcaaataattggcccatgtcggcttcccaaagcgctgggattacaggcgtgagccaccacgcctggccagtttttatatttaattttcacacagagcatccagtcagatttgcttcagcctcaaagagcgtgtttatgtaaaattaagtgagtgctggcagtgagctgaactttctaaaaggtaaaagggttaaatattaaactcatccaaaaacaccttcacagacacactcagaataatgtttgaccggttacctaggtgccccatagcccagtccagttgacacagaaatttttttttttttttttgagacggagtctcgctctgtcgcccaggctggagtgcagtggcgcgatcttggctcactgcaagcttcgcctcccaggttcacgccattctcctgcctcagcctcccgagtagctgggactacaggtgcccaccaccacacccggctaatttttttttttgtatttttagtagagatggggtttcaccgtggtctcaatctcctgacctcgtgatccacccgcctcagcctcccaaagtgctgggattacaggcatgagccactgcgcccggctgacacaggaaattaaccatcacagttacacagccatcgccattaatcccagcacatttcatcatccccaaaagagaccctgcccccattagccaatccccattcccaactccgggctctcagcccctagccaccgctcatctgccttcgtctctatgaattcacctgttctagatagtttgtataagtggaatcgtacagtatgtggccttggtgtctggctcctttcacttggtagaatattttcaaggctcatccacattgtagcaggtgctggtgcttcattctttttcatggccgaataatattccatcgtggatagaccacactgtgtatctcttcatctgctgatggacatttgggttgtttctgctttttggcataattctgttgtgaagaattctgcagtgagtgctggtctacaggtttttgtgtgaacatgttttcatttctcttgggtaattgcaagatcatgtggtttagccaaccagcctttaagccatgtgtctgctgagggacccaggcctggtgggggtgcattgctgtgcttggccagccaggtgctgcgagtccgtgtcgcagccatttctctgtgctgtgctctgaggttgtctcgccggcaccgggcactgtgagccccaggaggccaaagccccctttgttttatcttgagtccaggcctcgctccatgaactaggatgaatggacattgaatcaacgcagggatgggtggggctggggtggggacgcagagtgaccccgggggcctgcagctgggtcctggctgctgacttccagtttcctttgcctgttggagcccagaacaagtcagaaaggggaaatgcaaagttcgagtgtcttttctgtggtagactggcaggcctgggtgggtgagccacttgcagctagttgcagcgtgagagaggaagtgggaggggagggagagggtgagtttggtgtaactcacccctggaaggaggctgggctgaggctgggggaagtgacttttatttttctgagaggattcttccctggggccaacttcaaaccaagggagacaagaccttcctgggggaggctggaagtgctggggcccccaggtgggcaggtctcccagggccaacgtcttggggaagctataagttaccatgtttctggactgtcacacacacacacacacacacacacacacacacacacacacacacacacacacgagtaaactgtaacacaaatgtgtgcccatgaaagtgcccactttaaaccaccacacagcctgtaaagcgaaggccctggcccgcatctgggcacccactgcccagccagccggtaggcagtttgcactgtagtctgttaccatccctcagagatgcagccgaggagcccagctggcttggagggcccagtgggcgcagcctcaggaaagtggtcaggcccgggccaggccccttccccctcccagccttgggagaaattaccatatgaatgtagctccttcccggagttcgggctggaagggcctgggaggggacaggctcccaccccaggagcttccaggttccggctgctgcctgtgttagctgcgtgagcgtgagcgagccaggggtcactactgggtggaaggaagaagcgggcatttcttccaggaggtcaccgttggagtcccacagtaggtcaaccccaggccctgggtcctcgggaggaggagaaagaagagaagcaggaggtgtggagggtaggccaggaccagaaggcacacagggtcggggcagtgtgggagaccctgggggctccctcatttaaccagctaacatcacagcgttcataagaacacgctattactgcagttttattactttgctctgatttcagaaggcacaactgatgactttagggaacggagaatctgaggaaggcctcgcaggagagggtcagatgcgatcgagtaaatgtgagccgtctgtaaactgtagagtgcacgcacagcaccggtcagccctggggtcagtgttcccctggtgctcagctcggcctctgcaccttttagtgctcggctgggctctgtgggggtcagggctgggtctggtacattagaggacttctaccaagcccctggcagtgtctcagttactaaatccagtttgccagttactaaatccgctctgccggttcccgaatcactcttccgctggggccggccatgtcacgtcaggcttttcatgcaggacggcagatggatagacgctgggaccaagtcatccttgggccgcgagacgtctgaccttctgctggtgtctcagaagatgctagctctccgtggcatgtcttccacgcggtgcttggggaccagtggcctctaaggggcccccctgcctcagcgtggggagtggcctggccaaggtctcagtgtctggttggagccaggcataggctcaggtgtactggctggaggcctcctgcccatgggctctgcctgtcctgtgtccctggtccttactgtgtcttctgtgttcctgggagagaccccaggggccctgagcccagcactggggttggggagtgggcggggaagagggtggggattagggtccctggctgcagaacagccaggccccaagtccccactccactcccctcccaccgggcgcctcatcccacactgaccatttcctgaagaaaatttcctgaaccggcctcccaccccggctgtcccaggaagcccatccatccttccgccttaatgctttgtggctccagaaggatggtggaagccggaaatcatgagtctcattcacaggcggccacacaccgaagccgcggagacgccgtgggaaaggactctggccagcgcggccggcacagagggagcggtgttaccggggtagacgggaaccgtggctgcccccatgctggtctgggagagacgaggggccggacgaaaggacagcagactggccattcattcatttattcattcactcattcacagcgtcttactgggtgcttcggacgtgtaaggttttgtgggtagtgaatgcgacagaccccagacagcaatcggagggccacgtgtgtaagaactgagggacctaggctgggcgtggtgtctcaagcctgtaatctcagcactttgggaggcagaggcgggcggattacgaggtcaggagatcgagaccatcctggctaacacggtgaaaccccgtttctactaaaaatataaaaaattagccgggcgtggtggcgggcgcctgtaatcccagctactcaggaggctgaggcaggagaatggcgtgaacccgggaggcagagcttgcagtgagcccagatagtgccactgcactccagcctgggcgacagagtgagactccatctcaaaaaaaacaaaacaaaacaaaacaaaacaaaaactgaggaacccagtgtagatgagctatcccgggaaaacaagtgggagttctaggaacagcatggggaagggatggtcccggcagggaggacctctgtgggtagccttgttggaagagctgaaaggcagccagagaggctgtgcgtggatggaagctgaagagtaggttaggggcgtgtgttttgttaacaaagacttcaagcatttactgaccaggcacaacactatgtgcttcataaataaatatctcatttgatccccagcattcttatgagacagatgttattatcccatttcacatgtaagaacattgaggcacagagtggttaagttacttgctcagggtcacacagcacgtcggtggtaggcaggattctggagccacaggaatctggtatatcccaggtgcaatggaaaccagtcacggcttcatagagggaaatcatcagattagtaaattttacacacgccccctggtgctttgaggaggagggattcggacaggggcagctaatggtggtggctgtgagatgtgttgggttaacattgatgagagtttgggatggatgagtggattcggagtaatggaaatggagggcccaggcccggcccctggagatctagctgcaatagctgttggctggagaggctgttcacttagatgggggatggggtgggaggcaggtgagatgagagctccagagttcagcctggggcacggtcattgggttcaagatgccttcagatgttggggcttgacagtgacagtggctgcagatacccaggacccagcagagggcctggcacagcggggcccagggacacgtctgtgagtcaggctggcactcaagtgtgaatctggacaaagaaggtggcattgttggcattgaatgctcaggggctgggtgaagtcagctagggagaggggctctcaaggcaccaggactgactccgtgggtgagggcggaggaggagacggcagaggctgagagaatagccagagacaggaggaaggtcagcagagccatgcacagaagcctggagaagatttgaggaaaggaagggctgggtggtcgtcattccctgcagctaggaggcaagggtgacccctgtgtgtttcattcttcagaggattggtggctccatctggtcagaaccccaagtccagagatgcatctgagcttcatgccatggtgcaggcagcaggagccatggagcaggcctgcggggtcacggcctgcctgctgcttcctggtgtctctaccctgagctcaggggttgcttggatgccctgtgctgcatccccccaggcggtgttccagagaggatgaaagtggctatctcaaggtgtgaccaggtagcggtccatgcacactgctttttcctggggagagtctgggatggaagggtatgtgtgtgtttctgagactccttgaataggctccatgtacctatccacccatcttaccacccacccacccatccactcactcacccatccacgcacccacccatccacccatccactcatccacctgtcaacccatctatccactcattcacccatccactcatccacctatctacagtcattcactcatccacccatccactcatttacccatctatccatccactcatccacctgcccatccactcacccacccatccactcatccacccatccacccatctatctatgcactcatccacccatccactcatccacctatccactcattcactcattcactcatccacccatccactcattcacccatctatccatccactcatccacccatccactcattcactcatctgtccatccactcatctacccatccactcattcacccatttatccatccactcaaccatccactcatccacccatccactcatcatccgtccactcacccatctatccacccatgtatccatccactcatccacccatccactcatctgtccatccacttatccacccatctactcacccacccatccactcacccatccatctacccatcctctcatctatccatccactcatctacccatccacttatccatccatccactcatccgtccatccactcatccacgcatccactcacccatccatctacccatccactcatccacccatccacttgtctactcatccactcacccacccatccactcatccacccattcactcatctactcatccactcatccatctatccactcatccaccaattcactcatccacctatctactcatccacccatccatccagtcattcatccatttgctcattcatccgccaacccatccattcacctgcctgttcatccacctacccatccattcatccatctgtccatccatccacccacccactcacccattcacacacccatacacccatccatttatccaaccatccatccccatccttacttcagaaagcatttgaagttgctggggtgtgcacttggaaaatgcgtcataagctttcataggcctctctttggcttcctcacttctttgattggtctttctttcggacatgcaggattctgagcagctcttctgggaggtgggtgcagtccaggtaggctgcctgcaaagctaggaccgagggagccacatccaaggcactgtgggttcccaaggcgatggcactgtgggcccactgcttccagacctcctcaactcccaggctcctgagcaggaggactcctggggcagggcctggagacgggaagagaaaacaattccagtctctcaactcttgtcagtccaggtgggtgctgcatggattgggggcacctggaacagttggccccttcacccctttcccccacctttccagcccctctggctataatcagacagttgtgtgcgatgtctttctccctcctgaaggggtcatttagtcaggctcctactcatggcccaggaatgtgcccctccctgcctgtcccctacccccaagcaggccgtgcctccagccccctgctgtctctgaagggcctgggcatggggcagcctctgcagcatccccagggcccgagctgatctgcacagcagaagggaattgggggaaagctttttttctacccagcacctggcagggggccaccctgttgcaccccagagacccttgtctaagttttgttatttcagatgatttcataagttgggggaggcggagccccagcccccacagcccctgttgttgcctcactgctgagctctgctgtgtatctgctgacaggtctgctgatagcagaaggggctggagagagggaagctctgggccctgccctccccaacccctgcttaggggacatccctgataagaggaaattccagcctgtgacagatggccagtgtccacccacccacgggggaacttttctttctctttgtaagtttgcagatttgccaggaactaaaggaatctctggttgacaggccactgtggacatggctggagggctggcacgggctggatcttggggttgctttgaggtaggggccgctcctgctggaaggttccttggggtggggaaggcatcagggccattccctgaccctccctctgcagtggatccacttcagagcctgagacaaggcaagggggcagcagaaaacagaatataaaatagccccccccaccacacaccgcaccagaagtcagaggattcatccttggcctgccctccctgcagcctaagttctgagagtggctctttaggaagtgaatggtgatggtttgcaggtcagagcttgctctggcccaagattgatgtctcaataggccgcggagcctgggtgaaaaaactcaggctagggaggtggtgggttgcaaatgaaagaacagaggagggcctcttccagaaagcggcgggtggtgtgaggagcccttggaccttgtccaaatttgactttaccgactggggccaattgaaaccgtgctggcagaaaggcaaaactgcttgagattccttcctccacaatagaggagaggtttgcttgaaagggtttggcgagggaaaagctggaggaaccttggccggcagtaaaagtggggacccccgccccctgcctcgggggcgcctcggcccctgaatgaatgaaagaggaggctggatggagacagactcacaccacctgtcccttccaggtcctgcaaaggagcacacagggttcttgttggctcttccaccttgttagtcaccaagaaggagaaaacaccaacaggggaactgtaaagctgcagttttgtttaagccccatagtggaaaccggaaagagctccagctcggagaaaaatgcagctctttgcctttgcaaatccgtgtctttctctgggaggccagagccattgtgctcgatttctaagcagggtttcagagtgtctcaggaggggaaggcagagtctcagatttccggcatcccaggtcctaaccaggctttgaggagacgcttcctgtcccatacaaagtgtgaagtgtaatttgatttggagttagttaacaaattagatgagctgtgtgcattttaaaaattcagtccttgatcccccacccacacacatttgcacaatttggtcatttatattcagtgtttccatctttagaagagaacaggaagtccccagtgacatttatggagtgtttgtagtagcttgggtaggtcagtaggaacacaatgcagtgaaaagcagagttgagatgggaaaatatcctgttttcagagccccccagggatgacattccttatcgtctctgtccacccgctctggagtccactccgcaaacagcaacttgttctcacttgagagcttcctcctgccggagctcagggatggagagcagctggcctcagtcttctcctcttacctctttgtttctcagactcatcttccaccttgaataattgtttttaacctgctctccctcttctctagctgtagaacccagaactttgtgtgtgtggtcaaaagtttagagagtgctgcaggtaatgctgagataaccctattaaattctgtaagttctcatcacaccaagtttgtttgttttttttaattctcattttattttatttcattttatagggatggggtctcgctacgttgcccaggctggtcttgaactcctgggctcaaacgatcctcccgcctcggcctcccagagtgccaagttatttttttaactgggatccacgggcctagggattctttgatgaaccgttcaaaatacgtgtgtgtctgtctgtctgtcttcaatgtatacttttctagggagagtctttacttttcaccagaggtttgtggcacacacatgtcctgtactactgtatcagattgtgaattccttacatgttaaagactgcttcaaatctgtccggaagtctcggctaataaacatttaaataaatgaacttcaaattcccatgtgccaccactgttttcattctgactactctcaagcctgtagtgtcatctttttgttactgtgaagtagacactcaataaatacttgtcaaatgaatcaatgttatggtcctggtccactaggaccccaggatcatcgtctaccattattgtctatagtttctttaccatcttgttccagagcagttctttctctgaggtctgctcacctctgcacgtgtgtctagtttccagccctgtcgccttaccattctctttcctttacctgcatttcctgaactgttaatagttaacaatagcttctccctccacccactcactcatacctgaagtgagaagtcatcattgaggtctctgtggattttgtcagcccaacctggggcggcctcctggaggtggagttttcagatgagggatggacattttggtgtctgctgggtagatctacctgggagctttggcaggggccccagggcagctctgcctctttattttggctgtgggacccctggtgcactagggtttctcaagtaagcatctgtgtcctgggagagccataggcaggcctgagagggcccctggaatctgggacccccagcccggcccagtagctggtaccatcatctttcttgcaagggaagttatggaaactaagatgctaatgtgctttgataggcctggggtggctctaagccctgggaagagccctggcaactttccctggctggcgggtagaatcttctcctggcagttcagggctctgcctccagctccctgggggagagcaactgagggaggagctggaggccaaggcctcagtgctgagctgcctgcaccgcagctgcaccttctgggtcctggctgcaggaaccccatacttctccagcctttccatggttcccgaagacctggcctggggagggggtcagcagcctggggctcacctacctggcttcaaatcctggctctaccgcttactcgctttgcgaccctcataattgacaaaagccctctcggtctcggtttccttatctgtgaaatgggacaataacagtggctaccttataggattgtgtgatgatccatcagttataatagctcctgagcagcgtttagagtaacacctggggctcggtgcagtggcttatgtctataatcccagcactttgggaggccaaggtgggaggatcgcttgaggccaggagtttgaaaccagcctgaccaacattagtgagacccactctctaaaaaaaaaaattagagtaacgcctggcacagagagcccccagtaaacctcggctgctgtgatgagctttgtttcttcatttgttcattcattcaccagactttttgccggggcttgccgtgagccctacgctgctctgaagaaagccgggctggggtgagcgtgatggatgaggtgtctggcttcacaaaccctgtgtgggggggttgtggtgagaggaaaccgcacacatcattattcagttaccatcgtggggagactgtctggacgcagagagcaggctctgtgtgggagcggggagggcaagccctggttgcgaggcagggcttccccaggattcagcagggatctgaaggactttgcaggcacccagggagataggagaggaggagggagcagccctggccggacactgtcctcctagcattgcctgcatcagggactcactcagctttaagaagcccctttgtgggggacagggagcatctgttagtttataggacctgaagtgcccccatgggctcaagtttctgggaaggcctgcaggtggccgtagggctgccgcaggggtgctggccccagggtctggattcaggggagcctgcagagggagggcagctggaggctgctccagtgtgcattgttacgaggcaaagtaaggagactgctgggcccacgctgggccggggtggatggaggcaaggaagtcttcgccggggcaagggcaccagctgtagatgccggcagctttctcctggacacgggcctggaaggctgacagggtgtggtgagtgccaccggctcccctgccgtggcctggtcagtggcttcacaggcctccgtgggcaggaggaggatgaccttgcattctgcttggccaccattggcagtgacagacaaggtgtgtggggatgtggccatttcggtccgtgctctgagagccaggtgtgggttgggtttggggaagacaggggaatggcattgacttgaccctgagcactttgtcctggggtgcaggcccggctgtcactcccctggagctgggaatggcattgggcggtggctcagggtcccttgccccagcggcaccatctctgcatttggccagcaaggctgatgggacttgtgtggacatttctgggacgtagaccaggcagcatgacacacagggaggggtaggcagagaagggcggcccctgggtcttggtttccaagtcaggctttgcaagcctgctgtgtcaagccctctctcggcaccaggccaggtgggccagggtcagccctggggctgtgatgagtgtgagtgcccctaaagtgtgtcatgtccaatagctgcctcctctctgggcactgcctcccagccagatatcctacagcccccgtcccagccacagacagcaatctgattccctcatcctcggcaggtcctggggttggggtaagaatttgtcactaagtgcagatgttcccagagggtgctggctcagggctgcgtggattacagccctttcatccctgccttagacccacctgcaactctggagaaaagatggcccagtggacgcctgcggggaggagggagctggtccccaggatgagcagatttgggggcagtccccatcacgggaccggtgacctactgccaccagcgccagtgaatggcagaggggccctggcataaggcctgggttcagaatgggaacctgcagagaaactgtcaaggtctcccgccacctgacacctccgcctggctgccaccctagaaacacccttgctgcaagaagatgggggagtttgtctggggcatggtctggcgacaccaacttgagaacctcaggcctaagtgttggcctctgggcctcagctgtcctctgagctgtaaagctggctcctgggcacttgtggaaaacactggactctttattttattttactttacattctgggatacatgtgcagaacgtgcaggtttgttacataggaatacaagtgccatagtggtttgctgcacccattggactcttcaatccagctccactagaaatgactgccttctttcccttcttccgtccctccctcctcccctcccttttttccttccttccctgtttccttccccctccctccttcccttctttcccttcctctcccgtcctcatggggatataatttccatattacaccatccgccgattcagaaagcacagttgagtggcattttttcacaaccttctataagcatcacctctaattccagaacgttttcctcaccccaaaaggaaacgccatcctcggtacacagtcactccccctcccccagcccctggaaatcaccaatctgcgctttgtccctacagatgtacttattctgaacatatgactagaaccctaaaagatgtgactttttgtgcttggtttcttgcagttggaatgttttcagagttcatctgtgttggcgcacgctcgtgcctttttatggctgagaaatagtccgctgtgttgactcagcacgttgggtttctccacgcatctgttggcggatgtgttagttatttctggagccgggtgtgttgtgctactcacgggctgcactaggagctggggatatcactgagtaagccacagcctcgggcacccaggagctcgcagagcaggagctgggagggaggtcaggaggtgcatggcctgtttgccaggctggagagacttgcaaaaagtcactttgagccagaaaccagagcctgaggcctctgactcccagctgcggagccgggagggaagctctgcattttgctttgactgtggggtgacgtgtcagttactgtccaaatcagaacctttctgagagtcgacgtgggtactgctgataattagtctggatacccgaaagaatggaaagcagggacccagacagatccttgcacaaccgtgttcgtagcagggcgaggcctggaggtgcgatggggatctcaacggggcagctgccgtcttgctggagcccacggtctttggggggggtcacaggtgttaaccgcatatcatacaagcaggagtgtgaaatttcagggttgccaaattcagtgagggtcttgtgctggcctggccacttacagtggcatttcaggaaaaaaaatcactctatggacctcagtttccccattagtaaagagtaggttggactggaattctgtaccatccagtatagttgccatttatgaaatgtggctatttaaatttaaataaaaatagaaattccgttcctcagttggactagctcagtgtcaagtgctcagaagtcacttgtgaacacactgtggcaattcctcaaaaaacgaaaactagaaccaccgtagcatcccataattccacttctgggtgtggattcaaaagaatgcacagcatcttaaagagctagagatatttgtacacccacattcatagcggctctgttcacagtagccagcgggtagaaacaacccgaatgcccgcggtcaaatgaatggagaaatcaaaggcgggacaggccgggcgtggtggctcacgcctgtaatctcagcactttgggaggccgaggcgggtggatcatctgaggtcacaagttcaagaccagcctgaccagcatggagaaaccccgtctctactaaaacaaaattagccgggcatggtggcgggtgcctgtaatcccagctacttgagaggctgaggcaggagaattgcttgaacctggggaggcagaggtttcggtgagccgagatcgcgccattgcactccagcctgggcaacaagagcaaaactctgtctaaaaaaaaaaaaaaaaagggtggaacatacaaggaatttgactcagccgtaaagaggaagttaggatacctgcaacagcaagggtgaacctttcgggtattacgctaagtgaaataatttggtcacaaaaggacaatcctgtaggattccacttataccaggtccgtagagtagtcagattcagaaaaacagcagaatggaggttgccagaggcttgggggatggggctggggagttgtttaatgaggacagtttgttttacaagatgaaaaagttctggagatttgttacacaacaatgcgaatgtacttaacaccactggactgcacacttcaaaatagtgaccgtggcaaacgttatgacaattaaaaggaaaagtcacgtggccagtggctaccacgctgagcagcgcaggcctcggacggtgtcgtggtcacagacaatggagtgggtgatctttaccattgtttccagctgtctgagcaccatggtgtcctggggccaggatgaaagtgtctctgggtatgggggtctctgcttttcccacttgggagtcctgaaggcagaccccaaagctcacctggccaggtaggagagcgaggcgggctcttgcattgctctctgcgtgcgtgcctgcctgcgggccagccggggcctgcaaggccgcctctcgagggaggggttgcaggaatggctctcacctgtgcagaaggcaagccactgccctacgtcaatggcaaagatggggctcggctgcgttgtattattatttctcaagcggggcccctggtgggcaggatgtttggtttgatttgagtttctgcagtgagtgctggtgcctgtggagggacccagctgcagctgagccggcccctccctcgctctgggctccaggggcgttgggggcgagaaaggagagttcagggggcagcgcctccccccaggtcctgctggggagggttgagggatgctggggggaggtgggggcgggtaggggctggtcccagtcccaggcaaaatggctctcagacccacaggcagatggaagcgattttcggtcacgtgggtggggactgaactgctgccccgcaaggcaaggccccatgtctggcttcaggaagcggccccaaagccacatggtccatggccagatgcagggctgtgtctttgtttatttaaaggtcctggaagcccaggggagagtatttctgaagggggagcaggagcaggagcaaagccctgaaggcttccaggctgcgtggcctgggtgggggccacgtgggggcacagagagaggagccctggcctccaggtccgcctgtgggtattgctctcagcagtggagatgtgtggacccccccttggcatttcccaacaaggaattatattgttcctttgttcccccaattccataagataggaattcctgtgccctgtggaggctgagaagacggggaggtgcctgtgaggataaaccagcccccagtttctggcttccagagtcttttcctctctcacctctgatgcctcaggcctggggagcctccctccgacaccctctgaccgctccagtgaaataggccgagagggatggcttgaatcggctggggatgcaggctgcagccagggggctcagtgggcatttcctgagttcggttcttgccccgcaagtggaagggcagttgaactgaagtctcccactgcccctcctggcctggaagcctgcctcccaccttctgggcagagtgaggagtgggcgtgggccgggagggctgcctcctgtctgggagggctgctcacttgcctgtcacgggggatgagccccctgcagcctcccgtgctgtggccctggctcccacgccggctccactcccctgtggctgcccctgctgggtgcccaccggtcccagggaaaagccactcccctcccggaggactggcgggaggggccctgcctgggagcgtgccgtgtggtccctgtcttagcgcaggatgcctgaggccagatcctccctgggaggcaggatggggcaaaagtctccccgcaggcagagcagggcctggatgggcccaagcagggacgggggcacagaacagcagccgcccagcctgcgtgggagctgagggccaccaagggcagctccagcctgtggggactagcagaggcaccacctctgtgaccagcgagttgtctgcacctgcatgcgcatgcaccagtgagtgtggcgagtctgaggtgtgctgggacctggcccgtgtaccagccagccctgatgggaaccagccccatcctgggtacccctggaaccccactgtgtgggagcacctgggtcctcagcaggcgtcttccgggcgtccgcccccagccccaggcctctgacccgtgtgtggtgtcttaacagcagccaggagcagggccatcgaagggacctacagacagaagaggctttagtgatttcgggaagttcagctccacgtgccccacatacccaagagtaaaacttggtcttggcctgtgggtgtgcagcccgtgggcgctggccaggcacacaagacggccgcctgggtcagtccagggggaggcagatgtggtgcaggggcccccctcctccatgagcccaggaacagctctgcatccaggcacccgccctgcacccagcacttttccttctcccaggactgctggctcgttctatgggattgaacacacaactccatggggaccgacgctggttctatccccctttcttacaagaccatccatggggatgtgggaggcggggacacacgctggttctatccccgtttcttacaagaccatccctcctgtgtcttggctcgtggatcggcttctaaggcctttgagtggcagcaggcggtacagcttatctgagtagaggtgaaggagagggccaggtccacctgggtggcccgaggcagtgtggagggccaggagaggagagcaccctccacccttgtctgagcagccctccagggtacggagacaggagttcagggtcagccctgccttggagcgcagggggcccccagcttggcacagctcctagaagaggagatgaaaaagcctggccttgggagtctggggatggagctttgctggggaggcagcgtggctgcaggatggcagctttttagaggacaccacggccagggacatccacccgggggaattctcaggggtcgcctgggcaagtcgcttagcctttctgagcctcagtgcctcagtttccccatccaaggatgggtgtgacaaccacctggcaggcgcctgtgtgtgagcccctgttccgctctaactcctctgctgttccttccccagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcggtgagtcctcaccttgcatgccactcaaccaatgccggaaaccagcctcagcccccagggcggcccacaagcctttgggcttggtcttcccttctgtaaaatggggcagcaaccctgacctcaaggacggattgccagtgacattgcgtgtgcatgcatgcgcctgggaggagcccacagcctccagcggctcctcagaggggcctgtcctgcacatccagggcccctgagatgactttggggagcccaggccggcctggagcaggtcctgatgagtggtcgctgcctctgagcaatgacgtcagcttgtgcagagggttctgtggcagctgtcccctcactgttgctccagcctggccctccaggctccccaccgcaccccaccgcaccccggccagaggcttcccagcagctcagcttcagctctgccctggaattggggcctcgtggcttccacaccccctggtggccccggagagctggaggtcaccacgggaggtcgtcgatcagcacgacctgggcagggtgagggggccaggctggagtctacagtgggccgcctgttgtttccaaagccccccaggtcccattcaaacctcacagggaccctgtgaagggggcgtcccgttttccaggcagaagcgaggctcagggaaggctgccaaggttccttagctcacagggcagagaaccgcagccaccgttttgactcccagaactgtgttctgcccactccacggggtccagggaggggtctggggaagtgcccccgccaggtcacaccctaaacaaaggtgagcttgcggggtttctgcaaggtgtctgggcacctctcaggccgggcctgtttctctgacctttgccagccgtgcacgtccttcctgcccagctctgtggacgcaaacccacacctgccagcccgacacctttctttcctcttctgcactgatctgggccctggctcccctggggtcttggtgtcctctctgcttcctgtagcctcatgggacccggctgctcatggccctgctgtgctcacagctgcctggaagctggcagcctgcttcaagggagggcggaggtgtggggtcccctcctacggcccccaccctgttctgcctgttgtgggggacgtgcttgtaccctgaggattcagggctgcctcccgggaagatggctggagagaaagagaggggagaggcccaaaggcagtggccaggctgggactcatctctgtgggctacggaggggctgccctgctccctagccagggacagggtgagaaggacctgggaacctctgcgtcccagccatggcacaggccttcttccggagctttggccccaaggagagggagaggcagcccagcagccctcgccttccgtggctgccactgtgacagccttgccctctgggaatggtgcgcaggaggccacttcacctgtctgggcctcttcgccctttcaaccctgagaagaacagtggtcctgattccccacaaaatcactccctcccagggatgccgagtgaggaacaagacgtggggcagctctgctctcctccctcctccctcccatggcagctgtgcccacctgcagaggtgcaggcaaggtggaggggcacctgtttggaggtccacagaccccggggagaatcccagctttgtcctaactcagcggggtgaggcttgtgtgtcttcccctgggctcctcctctgtgagccttagcttcctcgtccataaaatgggatcatcccataaagtgagatcaagcgagctaggccccgggcagggtccccaacaggttgtggttgttcgagaatttgcagcagtggtgatggtggttgtggtgatgaggatgatgggggtggtaatgacggtgatgatgatggggtgatggtgctagtggagatgatggggatgatggtgatggtggtggtgatagtggtgggatggtagtggtgatgtgggtgatggtgattgtgatggtggtggtggtggtgatggaggtgatggtgatagtgatcatgagggtgatggggatggtggtggtggtgatggtgacagtggtgggatggtagtgatgatgtgggtgatggtgatggtggtgatggtggtggtggtgattgtggtggtggtggtgatgatggtggtgatgatggtgattgtggtgatggtgatggtggtaattgtgatggtggtggtggtgatggtggtgatgatggtgattgtggtgatggtggttatgatggtggtaattgtgatggtggtggtgatggtggtgatggggatgatgatggtgattgtgatgggggtggtggtggtgattgtgatggtggtgatgtgggtggtggtggtgattgtgatggtggtgatgtgggtggtggtggtgattgtgatggtggtggtggtggttgtgatggtggtgatgtgggtggtggtggtgattgtgatggtggtgatgtgggtggtggtggtgattgtgatggtggtggcgatggtggttgtgatggtggtgatgtgggtggtggtgattgtgatggttgtgattgtgatggtggtggtggtgatggtgatgatggtggtgattgtgatggtggtgatgggagtgatgctggtgattgtggtggtgaagggggtgatggtggtgattgtgatggtggtgaagggggtgatggtggtgattgtgatggtggtgaagggggtgatggtggtgattgtggtggtggtaatggtgatggtggtaaaggggtgatggtggtgattgtggtgatgtgggtggtggtggtgatgtgggtggtggtggtgattgtgatgggggtgatgatggtaatgtgggtgatggtgattgtggtggtggtggtgatggtgatgattgtgatggtggtgaagggggtgatggtggtgattgtgatggtggtgattgtgatggtgatgtgggtgatggtggtgttgatgggggtgatgatgttagtagtggtggtgatagtgatggggatgatggtggtgttgatggtgatagtggtgggatggtagtggtgatgtggttgatgatggtgctggtgctgatgattgtgatgacagtggtggtggtgatgagggtgacggaagtggtgatgatggcgggagtgatgggatgatggtaatagcagtgatggtattgtgatgatggtgctgatggggatggtggtgatgataagggtgatgatgatggtgatgataataataaaagtaacaataataaagggatacaccttgcagtatcccagttggcatctcctagatctaaggtgtcgtggctggaacattgacataactcctgacctgaggttggccaggacacagacctggtggacagagagagatggacgaggagtgtccgtccttgggctactaaacagttcaggccagggattcccagcaccagcctctgtcctcccaggagcccacacttttcctagaaaggtgttatcaaagtcagaacatcagtgtaatttagggtgttttttgtgttgtgtttttttgagacagggtctcattgttgcccaggctggagtgcagtggcatggtcttgactcactgcagcctccacatcctgggttcaagtgattctcgtgcctcaggcatgtgccaccatacctggctaatttttgtgttttttggtagagacagggtttcaccatgttggccaagctggtctcgaactcctgacctcaagtaatccaccctcctcagcctcccaaagtgctgggattacaggcgtgagccatctcgcctggccgatttttgtttttttaaaagacagggtctctgtcactctggagtggcaatgatcctagctcactgcagcctcgcactcctgggcttgagcaattctcctacttcagcctcctgcgtagctgggactataggtgctcgccactacacctagccaatgtttacattttgatgtagagacagggtctctctgtgttgcccaggctggtcttgaactcctgggctcaagcaatcctcctgcctcagcctcccaaagtgctgggactacaggcatgagccaccacacctggcctagggtattttttttggtgtgttgctagcgtagcccaaggcagctctgtgcagggtaaagcaatggggctccgagtctggaggggtgtgtgtgtgtgtgtgtgtgtgtgtgtgtgtgtgcgcgcacgcgcgcgcgtgttatatgtgatttgtttgtgtgtgttgtgagagttgtgtgtgaggtatgtgtaagaggtatgtttgaggtgagttgtgtgtgtgttgtgagttgtgcatgtgaagtgtgtgtgttgtgaggtgtgtgtatgaggtgtatgtgagttgtgtgtgttgtgttgcatatgaatgctacttcctcatcctcgtttgtctcagtcacctgtggactggctgtctgcacacacggtcactgtccctcgagtggcaccaccctgcaggccagcgccccctagcacatggccccacagaccccatgggacatgcgtgagcctgcctgatgctcacaccagctccacgggggaaggactgtttatcccattttgcagatcaggaaactgagacacggtgaggtcaggtgacttgcccaggccctggccggtcagggaggagcagtttgaacacctgggctttggttgcaaccaccctggtgaactgcaggaatcccggccacctggtgcaccctgggcagccctgggctcctccgccagcccggcctctgtcctgtccaaaatctgagccaccaggagacctcctgtccagaaagcacaaggggcacaagagatgccgactctcccaggcccggctcacctctcaggagaggactgtggcctgggttgtgctggcatcagagcccggctgtgtgggtttacacagtcactggacacccggctcgagggtgaagtcctcgggggctgcttggcagggatattgccgggaggtagcccaggcactgctgaatctcagactggagagcctcgtgcctgggtgggaggggccccatgtgcagaccctgctggtctctccggagagacccctgaccggcctcccatcctctccccagggcagagcggcttgggtaaatccaccttaatcaacaccctcttcaaatccaaaatcagccggaagtcggtgcagcccacctcagaggagcgcatccccaagaccatcgagatcaagtccatcacgcacggtcagtggccgggagtgggctgggggtgcaggacgcccctgccttcctggagcacaggggttgggggtcaagaccatcacacacagtcagtggccaggggcgggctgggggtgcaggactcctctgccttcctggagcacagagtggggggtcaagaccatcacacacagtcagtggccgggagtgggctggggatgcaggacgcccctgccttcctggagcacaggggttgggggtcaagaccatcacacacggtcagtggctggggatgggctggggatgtgggatacccatgccttcctggagcactggtgcggtgtgagggtgcccgagtcaggcaatcccaggtccccaagacggggactcgctgtgcccaccatccccagcatgttgagcatgttggggctctggctgtgatgggtcagtgtcccggacccctgtgggccccgtcacactgagctccccacagacaactgagttttccaccaaaagtctgacaggcaaggggctcccaggggaaccgtcaccggcctgtgccggagttggctgaggaaggccattaatttcccggtgtctccttggttgtcatcgctgcctacctggggttgccccggggtcagtcaggtgtggggtgtctgtgagggtcttccgtctcccctctgactctgcgtccgtggctctgtgcagatattgaggagaaaggcgtccggatgaagctgacagtgattgacacaccagggttcggggaccacatcaacaacgagaactggtgaggcccctccagggggaggagcactagcgggggcttcagggctccctggaccccacccagagtcagccctagaggtttcccggcccgcgggggtgcagggcccacctcctgggacctgacatgctgccaaagccgcacgtctcaggggcctgaaaattctggaccaaagcagaattacctggggaatcttgctgtccccaactcatcacctgaggccagcccggggaggctggtttgggaggccgagggtaaggctgtggcatctccgctcagcaagccagacctcccagggcatgcatttcattggaaggtggggtgttgggctctgagtcctgggaatgcacgacctgcttggggagggcatctcatgtgcctgctgactcgtccccatcccccacgcagctggcagcccatcatgaagttcatcaatgaccagtacgagaaatacctgcaggaggaggtcaacatcaaccgcaagaagcgcatcccggacacccgcgtccactgctgcctctacttcatccccgccaccggccactcgtacgtccctgcagtgtcggcgtcctcatgccgggtgccctgggttccctctgtcccctgggactgcaagacggtgctgtctgccctgctgctgggtgcagaggggctgagtcaggggccatggccgccagctatgaagttgggggtgtgccatgtctgcacctccaaagcctcacactgacccctatgcaagtgtcctgcccagcccccatccttcagctgcgtcttggggagctgagggtcaggcaggccctgggctgttctggagcctggtggtctgtgtcctgccttctcaggccaggctctggcaggtggagtgggagcccccagccaagcacccgtagcggtgactgaccttctcatccgggccctgcctcatgggaccccttagagggtttggtgcgttcttagacgggaagcacagagatcagtgctggccccttccagggctggacggggctgctgttggtgttggtgagagccctttcctcccgccggctctgtccgcacctgacgtcgcccctagagatcagcaagggcgggaggctgcatgtaccctggcaggtggactcttcatggcctcacggaccctctgtcctcagctccctgtgcaccccctgccagacacctgtggctcaccctgagccagggctgggaggaggaggaccagaggccagcaggagtggctggtggaggcagccgtgggtggcttgtctgcatgggtgggtggagaaggtccttcgcacctgctgtcccagatgtacttccctgggcggaggaagcccaggggtttggggaaaccatactctgtgggcaccaggtgcaggaaggagcctggctggtgggcagcgggcctcacccagagtctgtgggaaaacccaagccggagttttcgagcccaccctctggcatcatcctctgtgggccagcaggagtcaggggcagggggccagcccgctgtccatgggcctctcctgaactgaacatctgccctcccaggcagaacggctcacctgcggtcctgtggcagctgttccagctgctccaagctttgcctcagctgaggctgatggcaggaggcagaagcctctcctgatgccagctgggcaagccgagggcgggcgggcggtctgtggcacttctgccactccccagcactgaccctttggctgggactccagctaggcatgttgcctggtcccgcccaaggcgtccagtcccatggggcaggggcgggccttggccatctctgcttaaacttctgcccggagcgggcttctccccagccatgtgtgtgaccgatttattctcactgtgggaaaagctcggctccagaactggggaagatggtgccccagttccagggccctgccagcccctgccacccacagctttccccacatcagaccccaggctcactggggccaagcaggcaaggggagcagcccgcctggtgcaggggagcagcccgcctggtgcaggggcaccgcacactggtgctagcttctatttctcttgcctctcccctcccagccaaagccccacagcaagacggctgctgagccaacgacagcccttctgtgtggacatgtaggggtgtggttgggaccccagaactcatggacgagggtgcttggagctggccctggcccgcctggcctgtgcagtggtgtcacctgtgtctgggacacacccgtgtccttcctctgccccacactcacagcgtggccgactcggcccggggccctgtccttgccagcagggacccccgtgagccccgagccagcacctgagagtgtcgacacctgcttgggggtgggtgcccccccactgccccgctcccccagatgagcctcacgcacatccctctgcttcagcctcaggcccctggacatcgagtttatgaaacgcctgagcaaggtggtcaacatcgtccctgtcatcgccaaggcggacacactcaccctggaggagagggtccacttcaaacagcgggtagggttccatctctacttgccccagcccttctgtgcaacctggagacgctgcaggcctggcaggggccaccccgtctaaaggagtcacactgtcagggagaccgaaccgctggtcactctccccagcgggtggctggcctggtggtccctggcccaggtggctgctgggggccgtccctgagatggcctctccagctcccccatatctcaaaagcagctttgtgggagtgccaattctccagcagagtctctgaggggggttttggagaagacctggaccaggcagatggtgaatctctcttccagggagtgaggccgagcaggggccgtgcgacatggcccaccttgttttatgccccccctttttttttttgagaaagggtctggctcagttgccaaggttgcaatgtagtggcacaatcatggctcactgcagcctccacctcccaggctcagtccccgagtagctggaattacagacgcacaccaccatgtctggctaatttttgtatttttagtagagacgaggttttgccatgttgcccaggctggtctctaacccttgggctcaagggatcctcctgcctcagcctcccaaagtgctggggttacaggcatgagccacctcacctcgccctgcctggtttttattagatggaagagaagctgggccaggtgtggtggctcacgcctgtaatcccagcactttgggaggccgaggcgggcagatcacttgaggtcaggagtttgaggccaacatgatgaaaccccatctctactaaaaatacaaaaatattagtcgggcatggtggcgggcgcctgtagtcccagctacttgggaggctgaggcaggagaatctcttgaacccgggaggcggaggcttcagtgagccgagattgagccactgcactccagcctgggtgacagagcgagactccatctcaaaaaaaaaaaaaaaaaaaaaagtttcaggagggatggtctctgccaccttcttctccgccaccgtctgaggcccctgctgtgggatagggaggggcatccaagcaagagggcagccctgggctcttcctcctgacagggcagcacatcagagccacatggggtgcctttcaaaatgaaaccgaggtgcctgggctgcggcaccacatctgcctcggtgggtgtgggtggggcctgtaacctactccgtcctggggccaggtgtcagggaccttcccagcatgtgcaggggaagacagtccacacaaagtgggtgtgtctgccggaggctacacacgggctgtggtctgtgcctgggcaggcgagcagccgctcactgggatgtttctgttgcacgtacccatgtcgggctgctggcagggagctgagaggttactgcaggcggggcccctgctggaactggggactgtgacgagggttttttaggaagggtttcaggaggggaggtctcggtaaccctgagtactttcttggggctgtgatgagcaggagaagagaggtgggaggtgctcaggacgatgaccttaagcccctggggagttgcagcgtcgctcaggacagcaggtgcacctgcagctgcccctcttccctccaggaggcacaggagttggaggtgattggtgtcacagccccccagagcctgcccttgaacccgagcctggggcagcacacagtgtggaggtcatgtggcaaacaccagtgggtgggtagagcttgccacagggatgggcccatctctctccctccttatcccagatcaccgcagacctgctgtccaacggcatcgacgtgtacccccagaaggaatttgatgaggactcggaggaccggctggtgaacgagaagttccgggtgagtggatccactaggatgttgttcccaggggacccccagttcctgctgaagggtgggttgggggtttggaggaccttaagccatgaaattatattcttggggccagagggcactgagcccaggtgtctgtacccagtgctgtcaggctgaggctctcgtttttgggggaccccaggctcagggcagctcctcccgggggcccaggggagggaattgccttcccgcacatgtgtaaccaataccgtctgcccgttccccaggagatgatcccatttgctgtggtgggcagtgaccacgagtaccaggtcaacggcaagaggatccttgggaggaagaccaagtggggtaccatcgaaggtactcgccgcaggcgccggggctccagacagatgggaagacagtctcttctgctgacccagagcctgtgggccacgcctgagccagggactcgtggaacctcatccactgccttgccccacccagagggaggggtctccttgtccccattcaacccttgggaaagtgagagggcaagtggcctgtgcagatgcctccaccccagacctccccccgggcagggaaagattcagggagacaggagctgggatgggggccgccaagttctggatcctggtgcaggctctttcataggcacctgtgtggccctggacaaatcgcccaacctctctgggcctagaaaaggggtgggctgtagctctgtgagccagatggaccctcggccccttaccctgctgaagttcctgggaccctcacaccttagtctcttgagtggctgttgtaaccaattagcacaaacgaggggacttaaaacaacacaaacgtattttcacagttccagaggccagaggtccgaaatcaggggctgtttccttctgaggccctgaggaccagcctcatccatgccttcctccttctggtggcgcctggcattcctagttgtattgtaaaggcatcacatgctctaatctctgccccattgtcacagggccttcttccctgtgtctctgtcccgtccctcctcttcctttttttttttttttttttttgtttgagacggagtctcgttctgtcacccaggctggagtgcagtgttgcaatctcagctcactgcaacctctgcctcctgggttcaagtaattctcctgcctcagcctcccgagtatctgggattacagtcacgtaccacccacctgacttaatttttgtatttttagtagagacaggatttcgccatgttggccaggctggtcttaaactcctgacctcaggtgatctgcccaccttgcttggcctcccaaagtgctgggattacaggaatgagccaccgagcctgccctctttccttcttgtctttggacaaggatgcctgtctttggacttagggcctaccctaagtggatgatcccatttggagatccttaatgaatctataaagaaagacgttttccaagtaaggtcacaatcatgggttccaaggcctggaccttgaccatgtctttgaatggatgggagcccctggggggccacagttcaacccactcctggcggtgacaccccgggagggatgggcccgaacgtttccttccccttcctctctctgtcccttcatttctcattagaatggaagaggggaaggtgcagagggaaatgcagcaggaaaagccactttgttctgggagagcacttggctgaaaggcccagtagagcaggaagcacaagtctcttaatcttccagggcctcagttttcatcatccacaaagtgggtgcagtgtgccaagattttagtgagttgagagactgtcccaaagaccacagagctttttgggaagctgttgctctaaaaaaatggtcataatgacaattaccaggaggcatcagacactcctgtgccactggctagacatgggttatctcgtttcatgtccgaagctccccgcacccaccctccttgcagagttgaagaggtgctgtgagcagaaaacctgccaagggacccagaacgggaggcggctctagaatctacagctccagccctgcaccagactccctcgagatgggagttcatgcctggaggagggtgtggagaggcacacgggcctttcccctgtctgcactcctcccctaccaccacccctgccgggcccaccctgcgggagctgcccagctgggtgcagcctgggtgttttccagtatccgcctgtggtgtcaggctggcttgcctccccttggcccctctgcctgcagttcctctcttcctctctgcccaaagagttcttgctgtttaggaaactttttatgaaaggcaggtttgggagagttagggatggatgggcctgggacgggccggcggctttgctatgggcgtgcctctgctgcaccctggtggccaaccttgagtaccgcaggtggccggtgacagaaactgtcaggaaatgcacaagagagaggtccccgcacctctctgacctgtgcgttgttgagcaccactggctccagctgaggaagagtctggaacctgtcaggacagttgtgaggtggtggggcccactttccagcagtcttatatgaggaccctggaaatgtgccttcagcactgctgggtttttatatcaggggccccatgagttcatagctgacctgacacccggactagtaagggctgtgccttgttcttgcctcccacttggtgaacagcatcttgaggtatctttcccatccttagaaaccaccccaagtattgtcaatagaaatgtggggtgtaattgatcacgccatgaactcatttaatcctcatgtccctgagaggcgggtgacgttattatccacattttatggatgaggaaactgagggaatgagagtaacttgcccgagccagggagtggcgatcacacactccaactccagcctgagagccccattcttcctgccggctctcgctgcccgtcagtgttagatgagagtgctgctggtcagtctgcaggaggttctagtgtggacaccgccctacacagggccgtggcaggagggcctaggcaaaggcaaccggcatagcactgagagcacttgagggctgggcaaggtggaggccccggccctgcctgctggcctaccaagtaaaaactagacatttttaacttggggaaaagccatgtggctctgcgatggggcagcctggagccaggtgtatgggttctgcatcccgctccagccttatgcactgtggagctgagacagacacagttcttgcgttctctatgcctcattttcttttcttttctttttctttttctttttttttttttttgagacgaagtttcactcttttgcccaggctggagtgccgtggcgtgatcttggctcaccacaacctccacctcctgggttccagtgattctcctgcctcagcctcctgagtagctgggattacaggcgcctggtaccaggcctggctaatttttgtatttttaacagagacgagatttcatcatgttggccaggctggtctcgaactcctgacctcgtgatccacccacctcagcctcccaaagtgctgggattgcagacgtgagccgtggtgcccagcgtctacgccccattttcgtaagataatggggataacaaaggaatcacaagagacacttgcaggtgtgtgaagacgaagttcatcacatgggagggcaccgggtgtctttatttgccttccctgcccggctccccacctccagtgatgccgttcactgccctccttgttaaaaggccttctgttatataacagttacacatgccaggcaccgcgtgttcatataggagttacgaagcacagcaataaaatgaccactctgagatggccaccagctcgagcccgagggcacttgtgggtgcccgtggtctcctgcccagtctccctgagaagtggccactgtcccgagcttgggcttgtatgtattgtgtgaagtgcacatgtccctgagcaatgtttagcattgctgattcttgagcttgtgaatggtcgtccacagtacgtagcccctgtgtgtgtccctgtgtgtgtgtgctctgagcgcacacaaggtggatggggccgtgggggtaacaccctgtgggccacaggttttctttaaaatcccagctccgattcctgcttcatcccattcccagcagcccagccccctgcctgtcttcaggcccctgctgggacgtcctgctctccctggtcaccccagtggtgcgggggcccactgccctggcttctccactgtggcttccttccatgctcctatttggcctggtcactgtgccatctcccattagccaggaactttctggagagcaggagctgagctgtccaggagcaggagctggtgctggtcactccagtatcccccagactgagggcagtgccaggtgtcctatactcagctgcagagcaggtggttcccctgccctcctgcccatggggctgccctcagactctgcttttggcaccagcatttctgggcagggggagagaggtggggtccgggcagagtttctccactgggacattaaagcccctcctgtctcctctcctagttgaaaacaccacacactgtgagtttgcctacctgcgggaccttctcatcaggtgagagacagggtgcttgggtggggctgacggcttcacccctaagagggccctacagcgggtgggggcagtgggtgtggggccgaagccctgggcagagtgggtgccccctgccacctgcctgccctgccctcgggaagatcttggaagcccatcttctgaaaaagaaaacccactgggaaatgaagcaggcagtgaagatccttttcaacccctgcgaagttggctggatgggaaggctgagctttgatccactgtggtctggcccgttagagctgcccggtggccactaagggcccagtgaggcctcatgtgcaggccctgccggcagcgtggggcgtctccagctccgatcccactggcctctgacccctacccctttcacctggctgaggcttctccttgtttcccttgagtccaggcaaggaggggaagccctgatggagagggtgctgggtgggtggtccctggagtgtgggccctggcctgggcaggttcttcctcagcaagcagctggcatggatgatgggaatgttatcaagaggaggggcctccaggttggcgggggcaggggtggggggattccgggagccgttctgccattgtggggatactgggctttccaacctccctccagattattcctcctgagctgcagaggaatgaaaatccgagcccaggacttttttttcctggggacaagggcaacccagccctttgccccaggccacctgcctgccacaggccatagtcctggaggccggtggtcacccactgcttccaccctgccagcaccctggacaccggcctggagcaacaatgctccagccctgtccctctgagtctatgcactgtccctgggccctggacccagggccatagggtggacccagagggagacacatgcactggaatatgtgtgttctgaccgagtctgggcttaccagggggactgacccttcccccaaaacgtgtaccagatctggtccaacatggtgggcctgggggaccccatggggagccaagcagtcgggatggggagtgggggtgggggcaggcgggcctgagtccgaggcaggccgagcagggcccctgccccgctgcccccaccccgctgcgcccacctcactgacccgcccgccccccacccccacaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccagaa

SEQ ID NO: 1830 - DNA, 50067 bp, Homo sapiens
cacttgggttcagaggtcgtggcactgagatgggtctggcagatcccagcgtccaggcccagcccctatagtgtcagctccctcctctggggacccccttgcttgtgcccctctgggtcccagcacatcccaggcctgcagggagggggagaggaagagactgactcactggccaggtcccccaggggctggagaggctggagaggcaggagctggatcagatctgaatccagaggctctcggaggaagagctcagggtgagctgcgcccccatcccctgcccctcctctcctgctccttctcccttccatggtcccagccagcaagcacctggggtagaggggacaaacccaggtggctgtgttccagccctggctgcaggtctgaatggctttctggggtggctggccatgctccctgagagcccagctgtggcgatgtctgagcaggtaggtgggggagcacctaggaagcaggggtgtcaggcagagcacaaggagagagggtgtccaggtcagtttcaggacctggctgagaggagggggctcctcacgggcaccgcctctggcaagcacagggacaagggcaaggacggcatggccagaggtccctgggagcctcttcccctctcttcttcctagcagctccccctcactcttcccagggaccctgtcactttcctttagcgtgtggcagctccttggcgtccctcccgtgccttcaggttgcttctgcgccgggcctgccgctgggcgcccctatctctgcctgccccctcctcctgctcccctcgccctgcccccttggagcaattccccaccgagcctcccttcccaggcagtcgaggtccctccctacctctgccccgcgctctgggaggctccttgttccgcgaccacaaagcccctttgatcctctgctcggctctgagccatgtgacccggtgggcgggccgcggctctcggcgcgtccagcgcagcccgacgttccgctgctggggtgagtcctgctcctttgttcttcccagccttgcaccactggctcgggggctctcaggtggcgcggccgcgaggcggaccctgatggccatggtggcggtgccgggagccacgctgtccctgggccccggcccgaggccggcaggaccgagcggggtccccaggagaggggtggcggggagctcgatctccacgcggggaccagattttcggcctcaaaatagaagaatagggctttgtgtggtcacagctatctctttgtaaatatttggccaactaagctgagtggctaagttctcctgctgcccggagcttcttggaacatgtttccttttcgcaaggggtttccctggcttccaggagggccaggaagaaattcgaattggccaccgctttctctaaaatcactccgctcaagttatcacccctctgggctcccgaagaccggctggctggaggctggagatagtctcaatgctcgaaatgccgtaaccgaagctccccgcggcgccggcactgggatccagggagctgctgctacagcgcagctctggattcctggatgtgttggatatgtgcagggcgttcctgggaggagcggggagggagggtgctgctggcggggctggtctgcgtgtgctttgcttctctacaatggcatgctgcgtgtcggccatgcagaggcatgtcagtgagcaggggctgagggatctccctaacggacctgctttcagagggtcttttcatgctgggagaaccccagagactaaatcatgcagccaacggggtggtccccggcctcaaagcagggaggggcgaggagctttgtaggcaatgccatctgctcctgaaacgccgtcccagtgactctggggactgactcagcctccagcctgctgcacttcatccctggcccctctctctttgctttttcatgtgaaatctgctgtgttttggtcagaggtttggggaacagctctctgctcatctaagataagtttgtaattcctttcctggagaaaaatatgccacccggaagcaggttgagcagtggttttctggcaggtctgttcggggctgtggagacagcacctgctggatcaggatggagttggaatttggtttggatcccacatgagaaaacccgttggaagaggaggaagcagaaaaaggccccattccctaataatgctgtgggttttcctcctccattcattgccaccttgccttgaaacttaatggggccacgtgtgtttccatgaatgtcattctctttggccaactcccccggcagccccaggagctccttttcaggaaaaggaagaaggtgtttgcttagcatctagtatacgagtccttgttggaaaggtgggattcttgtttctccttgggtctcttttaggctgagatgtggtcaaggaaggcctgtggtgtggctcgccttttttaatgctcgtctctggagacctgagttgctgctgactcccagcttgccccttctgtcccctggccatttctgtgtcggggtggctgagacactattgcattggccactttgtgttcccactagcccccgcccctgtaggctgtcattgtgatggtgatggggccaattcagctgcggtggggaggacccactgtgtgcgcctggggggtggcgtggggcactctgggatgagaagatgcgacttctgccctgagagccctgctttaatggaaggcgggggcatagttgcaggcagaagccatcaagcactgtggtcagaccagcattccatgtcaaaaatggccttgttggccgggcgcagtggctcatgcctgtaatcccaacacttcaggaggccaaggcaggcagatcacctgaggtcaagagttcgagaccagcctggccaacatggtgaaaccctgtctctactaaaaatactggctaatccgggcatggtggcgcgtgcctgtaatggcagctactcgggaggctgagacaggagaatcacttgaacctgggaggtggaggttgcagtgagctgagattgtgctactgcactccagtctgggcaacaagagtgaaactctgtctcaaaaaaaaaaaaaaaaagccttatctgggcctgggatctgtcctccgaacactgggtccactgtgctccacaaggactttcaccccggaagccctagacccacttgggcaaccagagtctctgggttgaccactccccagccctggccagcctcctgggccaccgtattctcccaacttcctgttgtgccacggctggtccaagctgctcttatcagacaatgcgaggcacttccacaggaggggacaaccccgtccttaggagccccttctccctgcccccaggcctggtgcagtgtgtggcttccctgccggtgtcaaaggtctcaaggcccctttaagaagcctgtcaccaccaccagcagcttccgttatctggttcttctgtacatgtaagcctttcccatacaccccggatgtttagggcttccgccctctctccctggccgggagtgtgggaagagggctttatttcaatgcttgagagtagggtcaatggccagggtaagctgtgggggctcctccccgccggcccctctctgcagccctcaccttaacacagagcatcgataccacctgggctttgggaagacctggaggctgaccaccctggaggctcccagcgtcccacagccactctttggggaagaggcttcctgagggacttgtggcccttggctgggactctagtcccagagttctgccttccggcgccgagctttgatttgtttattgagtgccagcccggttcccggacaggtagggacctgttcccggagctcagcagagccttgggaagctttcccaggagggctcccgagggtggcggccatgcccagtccgctgtacgtgtgagtttgtttgatgaggaattggctgggaaggcgcgggtctaattacaggcccatgagggtccctctcgcccccacccaggaagcagcggagatcctggcacactcagcacctgggcctgtgcctgcccagctgctggtggaatcatgggagccttgctccggggcctgtagagcagcagtgggaaccttccccacctcagcccctcccagagttggctgttcaaactcgccgccgctcagcctcttcctcctctctttcatcaaccctgggaatcgcacactgcccaccccaccgggccccggagcgggtgcaggaagagagagcttaacacccagaggtctgggccttctgcaggcgcctgagctgctgtggcctgagctgggttccctgctggaaccatcacagtagacctaatgatctgcctgcaggagttgcttcatcccagccgactccggggctgcgggaaggggctgggccttggttttgctgggggtggggggtcagtgcaaagggcctgaaaagtggcagaggtgatggcccatctgtcctccccctggccggccggcctaaacgcgattggctctctttcttttttttttttccctcccttttccctataaataacactaaatgcgatttgtcaatgcattcatttgggttcagtagttggaccatgggcagaagcactccagatttgtcactttccctaagctaagggtggggaacaccctctgtgagatcttggctcctgagcgcccaagactgctcttggaaccccaactctgggtcggtctcaggggactgacgttgatggagttgctgacattgacctccggcctctgcatggccttcaggaagggggcccttcgctctctgtcccgtcgagcctggctggcagcactcccttctcaggcctgtgcccccggcagggcctgctgcccccgccctgctctgtgggtgccaggctccaagcaccaggtgactcggtcactgaatggtcactgaacagtcatccttgctggtgtccccagtggaatgtgcatggacgtcctccctcccccagatccttgtcttttatctctcagcctttgttccaggggccaccacaggaccaggaggtacgcagacgtgggtggcacatccactgggcagattcagccctgaacctgcacgccccctccaagggggcccccagcgggcggggttgatggtgccgtctctctctctgtcactagaacggacatgaggattgtgtcttgtcgatccacgtcctgagttcccagacgtcataggtgcttgctcaacgagtgtttgaatgaatggtcagcattgtgtgaccgcagattttcaacttttatccaaatagtttgtggtttctgtgaggctatcccgagacagtctcacaagaatctccattctccctgcacgctccgcacaaggtctccttggggggtttttcagaaaaagggccaaagagcagcatttcctcggggatttgaacacgatctcccccggggcaggggactgccctggaagattcccggcaccgcttcccatgcgccacgtgactaggagggtcttggggcaggatggtgtcttttgtgccttgtgtgctggggccggaggaaacactgcccgtggccggtgtcatctgccagccctgaagactaatgatgggctggacagtggccccattgagtgggagggagaatcgctgctgtctgtagctggggggccgggtgggtgggagccgaggccagggagaacagcgcagacctggcacggagaggcctggaggaggagcagggggtctcagccacccagggtgcagggacgccacacgaggagcaggtgtggtgtgcgtcctcctgcgggttctccacctcttggcttcgttacctgcactaggctttgtggtgagagggcacagagtggaggaaggtgccgtggctagggcaggccacacgctgtgctaatggattgctgttacctgtcgcctctgtggttttgctgtcaggatcctccagcaccaggtccccaccaccaggtatgggccccacaggcactactggctccccgaagccagggacagaccccatagacaatactgagtccctgcagccagggatgggcccccacggccagtaccagatctcagggaccagcaccgggtacccacagccagggacaggcctccatggccagtaccaggtctcagggaccagcaccgggtacccacagccagggacgggcccccatggccagtaccagatctcagggaccagcaccgggtacccacagccagggacgggtccccatggccagtaccaggtctcagggaccagcgctgggtccccacagccaaggacaagtccccacggccaataccagatcccagtgaccagcactagatgtccacagccagagatgggcccctatggccagtaccaggtctcagggaccagcgctgggaccctggatgactgaaggagggcacggttgactaaagctgcaggagccagcctggccatcctgaggcactaagccatcactgcggtctcaggggactcagactcctctacttgtcttcttgaattctggaatcagacacacctgggtccagcctttgcccccggggctgtgtgcctgggatggttgcctcacctccctgaagctcagtgagatggggacggctgcacagggcccggcacagatggcacccgatggcacagggtcacctgcttgcatccatacagcctcggccctcgctctggctgcgtaccgagagtcccatgcccagacctctgctgagtctccaagctcctggtcatgcctcaggcctcccgtgagaagcatcactgcatggaccatgcctcgggacctcaccttgggctgggaagcttgctccatctccccaagtctcccctagaggcgccccatgtcccatcactctcactgcttgaggggtcagataggggaacccagtgtgggaggcccagaggtgccggagcagacgttaagcgagttccgtgtttatgcgctgggccttggcagacaccctgaatgagcctcttccccaggaaggagattggggtcccagtccaagttgtggcctcaaaccctgtgaccaagagtggagaaaaggcaagacccctcctcccagtcttccagaacagccgatagtggtggaaacatggggttcacactgaatttccttgtaacttgttgaagagaatttagcccacattttcaggggtggaggtctggccgatttggcagtgtgcccgtccccctggccacagtttactctggaccgggcaccctggtgccctccctcagtgacgcagtgaagtcactatgacgtgtttagttggtgagaaagtgcctcctgtaatgttttactcttcttagagggtgaataagccttgtttattataaataattatttacagaatacatgaggtttaacctaactctgggccacggcagcgtcccctgggtaaacccacgcgccaccctagctagagcctgtgcccccacaggcttcctggactcaccctgaaggggggctggattttctgcctgtcccgatgagagggctgcaggacagtccccagcgagcccttctgagggctgtaacctcttcccctggtattttcctgctcgccaggaatgtttcaagcttccagcagaagcctacccaccatagtcgctttccaccctgctcaccatccctcctgccctcactcattcagcagaccccgtgcacagcccagtgcaggactcagggtgggaaggtgtcccgggtgggctggagcaaggttcccagccagggcggggtcccaaggtgggtccacagccaggactgtgatttgggaggcccctccctgccttgttccagccccggcaccgccgctgtccttgtgctcagtggagactcactggctccaggctctaaaacctcagcgaggtctgcagacagggaggagccccactcgagggtagagtgactgccgggtccatttgcctgttacgaaccacgtggcctcagacctgccattcctcctctcctagagctatggtcttttgtctgaaaaatggataatgatggttaccatgtcagggaccattttgaggacaaacggggatgaaactgaagaggctcagcacggaacctggacacagaagtgctaattgtgtgttaccagctgcggtggctgccaaggcccaaccacatggcagccacgggctgagtggcgggcgggaagtggggagcaggagcatgcaagatgggcattcctgaagtttctgatccagtgagataagtacacacccagctctaagatggagtgtcccaggaaggtggagactgcaaaggccttgtggcgcaggagtgtgagctgcacctctgggctctctagaatttcaccagagctcagggaggaggtcagctcagatataggggcaacgggagagatgggagtgagaaaatggcttggcgtctggaagtggagcctggaaaggtgggcgtggggacagaggagggccttgggggccatgggcccatgcgtccaggaggtggaggcagtgaacggggccacggtcggccccacacgtggcaccaccagccctgctgagcctgcacctgctcctcaggccccctgagtgccactaccacctggcaccccttggtctgattcctgcttcctgcccgcctgggaagagtgagaccacttgcctaaagtcccttagctgtccttaaccattctggctgcctcctggccctgtccagggttagccgttgacctgaactgcctggtgccacctccccagactcctggggccttgccctggcaccaacagccacctccatcttcatcattcactcgcacattcacccagcagtgctttttgggcatccactcagcaatatcaaggcgctgagatgcggctgtggttaagacccgggcccggtctgtgaggacctcgcagttgccatttccccagagcacagccccagccaggcacactgtggggtccagaaagagaaactaatacattgtgttcgtccattttgagttgctataaggaatagccgaggctggggggttatttgactcacggttctgcaggctgtacaagtggtgccagcatctgcttggcttctggggaggccccaggaagcttttcctcatggtagaaggtgaagggggagctggcacgtcacatggcgagagagagaactcccagactctttttttttttgaaatggagtctcgctgtgtcagccaggctggagtgcagtggcacaatcctcggctcactgcaacctcagcctcctgagtagctgggattacaggcgcatgccaccgcgcccggctaatttttttgtatttttactagagatggggtttcaccatgttggtcgggctggtcccaaactcctaaccttgtgatccacccaccttggcctcccaaagtgctgggattacaggtgtgagccacctcacccagccctcccagactctatagcaatcagatctcccggactttgtgaccgtggggagggcaccaaaccatccatgagggatccacccccatgacccaagccccaccccccccaggccttacctccaacatcagggatcacatttcagcatgagatttggaggggacaacgtccaaaccatatcacacgtgacctctctgtgcgtgcgtcagtttctacatctggttaagcagtagaagctccttctctgttccttgttgagagagcggtgggggagaaatgactcagggatgggaggctggtcccccgaggggccctggtgtttgtggagtgggagtgcgggaaggcccctacgttgtgtgtgccgtgctgggctggctcctcacagctcaccgtggtgctccccgaggactgctggggaggaaagagctaattaacttggggacccagctgctgaagttatcattaaacttgagcagtccaggggcccctctccttctgggtcctatgtcacccagcacagtggggcttaattgaattttttctcatcccccaaggctcctggctggcgtggctggggtttgggatacggggagcgagagggcttgggcctcttccagatttggagtgggttcaccagaaatggcccaggaaaccgcgggggccacccccagcagctgggggctcctgtggtcatttcctcttggtcctgttgagcagccctggcccctggagccctcagcaagggatgtgggggcctgccaggccagggtcctcactgctgccgctatgcacagctgcatcttgcatccggggagtggggtgccgagtggggtgtttgggaggcaggttttcccttgtcccttctgcccagagaccttggggatgagttgagtgagacccttccggcttctgactggctgtgtttctgttgccatcccccactccttttaagtggaggtttatgacttccttctttatttaaaagggtcatttagtgacttagcagatcccagtctgtgttacccagggcccttttaaaaatctgtggggaggctgggcttggtggctcacacctctaatcccagcactttgggaggctgaggcgggtggatcacctgaagtcaggagttcgagaccagcctggccaacatggagaaaccctacctctagtaaaaatacaaaaaattggctgggtgtggtggcacgtgcctgtaatcccagttactcgggaggctgaggcaggagaatcactcaaatccaggaggcggaggttgcagtgagccgagatcacaccactgcactccagcctggacgacagagtgagactctgtctcaaaaaaataaaaataaataaataaaaataaaaatccatggggggacctctgtgtccattggctggtgtgaggagagggtgaggagctgcagagaaggtaccaggctgaggaccgcccccacccttgggctacagaattgaaggaggggacacatgaaagatgttcctagactcgggctggaggctggggacatccgagggcaaggacgacgctgtccctgctcttgtttgcagaggagtgcacagggctcaccagcttcttgttgctgtttaagtgatagctttatggagatagaattcacatactgtgacgttgacctttttaaaatctacagttcaatggttttgctgtattcacaaagtgattgtattagggtcatccagagaaacagaaccaatagaaggtgtgtacgtgtgtttagataaagagatttattattatgaggagttggctcacctcattacagaggttggcaagtgccaagattggcagagtaaatcagcaggctggagacacgggagagcccatgttgcggctctggtgtccacctgaaggcccaagacccaggagagccaatggcgtcgttccagtcccgagacccaggaaaagcgcatgtgtcagtttgagtctgaagcaggaaaaatctgatgttccaggttgaaggcggttaagcgggaagaattctctctcactcaggccttgtgtcctcctattcagaccttcaggcctttgtcacaaaattacaaagacctgatcagaacaaaatctgagaaaaaaccctttccttctatcggttttggattcattggctgggaccctggaaattagactgacagagattaacaggaaacaagcataacaattcaagtaagttttacttgacaccgagccttcataaggaaatgaagacccagagaaaccgttagcctgagcggtttttgttttgttttgagacaaagtctcactctgtcgcacgtccaggctggagagcagtggcccgatcacggctcactgcagccttgacttcctgggctcaagctggggcccagctgccggccccgggagctgctctgaacccactcttaagtcccagctcagactcccaagtagctgggactacaggcatgtgccaccccgcctggctaattttttattttttgtagagacagggtcccactatgttgcccgggctggtctcaaactcctgggctcgagcaatcctcctgccttggcctcccaaagtgctggggttacaggtgtgagccactgtgcccggcctaggcctgaacagtttttatttgttttgcttgttttttaaatttgtttgttgcttgttttgagcagtttttttgtttatttcttttgcttgtcttttgcccaggctggagtgcagtggcatgatctctgctcactgcaacctctgtctcctgggttcaagccattctcatgcctcagcctcccaagtagctgcgactacaggcgtgtgccaccacacccggctgatttttgtatttttagtagggatggggttttaccatgttggccaggctgttcttcaactcctgacctcaagtgatctggccaccttggccttccaaagtgctgggattgtaggtgtgagctgctgtgcctagcctaggcctgagcgtttttatgctgggtttgatgaagagtggaaagtcgtgggaaactgtgacagagcaacaaaagatgagctgaacagtgagcccgtgggggtctcggcaagacctgtgtactggggcccctctcagatcctctgtctctggagatgaggctgttcctttccgctgggtgtagggagggcacctcttacgtgaggggcttatgatctacttcagagaaggggcaggtcagtgagttcttcttggacctgccatttcttaaattccttcagctgaaaatatttactatgccaaggcactgtatcttggagtgtgcgttccaagccctgttgccttcaactgatcgggtgaggcccacccccatcagagcacacagtctgctttacccaggctcctgattgcacccttttcctgtttgccccgagaatactcaccagcagtgcttgtggctgcagcgttcaccccaagataaatttgccgggaagtatcttgcttttattattattttcacatcactctagtatatcgactttggaaacaaaagacatcattctgtttatagcattccatttttagtagtggtatttcctttaaaaaaaaatggtaattctcagctgggtgtggtggctcatgcctgtaatcctagcacttgggaaagctgaggcaggctgatcacctgaggccaggagttggagaccagcctggccaacatggtgaaatcccatctctactaaaaatacaaaaattagccaggcgtggtggtaggcacctgtaatcccagctacttgggaggccgaggccggagaattgcttgaacccgggaggcagaggttgcagtgagccgagatcgcgccattgcattccagcctggacgacagagcaagattccatctcaaaaaataaataaataaataaaatttaaaaaaaaatagtaattctcgatcgctgaaaatgtcaaatcctagagaacacagcattcctacaagtgatgttaacattgttcttgatcagttgttggctgaagattcatttgatgaatctgatttttccagaatagacgactcagatgactctgttgttttgcttagaaataactgcaggaacaatttaaaaaattttttttctttttaatttttttgttttttgagacggactctctctgttgcccaggctggagtgcagtggcacgatctcggcttactgcaacctctgcctcctgggttcaagtgattctccagtcttagcctcctgagtttagctgggattacaaggtgcctgccaccacacgtggctaattttttgtatttttagtagagacggtgtttcaccaggttgaccaggctagtctcgaacccctgacctcaaataattggcccatgtcggcttcccaaagcgctgggattacaggcgtgagccaccacgcctggccagtttttatatttaattttcacacagagcatccagtcagatttgcttcagcctcaaagagcgtgtttatgtaaaattaagtgagtgctggcagtgagctgaactttctaaaaggtaaaagggttaaatattaaactcatccaaaaacaccttcacagacacactcagaataatgtttgaccggttacctaggtgccccatagcccagtccagttgacacagaaatttttttttttttttttgagacggagtctcgctctgtcgcccaggctggagtgcagtggcgcgatcttggctcactgcaagcttcgcctcccaggttcacgccattctcctgcctcagcctcccgagtagctgggactacaggtgcccaccaccacacccggctaatttttttttttgtatttttagtagagatggggtttcaccgtggtctcaatctcctgacctcgtgatccacccgcctcagcctcccaaagtgctgggattacaggcatgagccactgcgcccggctgacacaggaaattaaccatcacagttacacagccatcgccattaatcccagcacatttcatcatccccaaaagagaccctgcccccattagccaatccccattcccaactccgggctctcagcccctagccaccgctcatctgccttcgtctctatgaattcacctgttctagatagtttgtataagtggaatcgtacagtatgtggccttggtgtctggctcctttcacttggtagaatattttcaaggctcatccacattgtagcaggtgctggtgcttcattctttttcatggccgaataatattccatcgtggatagaccacactgtgtatctcttcatctgctgatggacatttgggttgtttctgctttttggcataattctgttgtgaagaattctgcagtgagtgctggtctacaggtttttgtgtgaacatgttttcatttctcttgggtaattgcaagatcatgtggtttagccaaccagcctttaagccatgtgtctgctgagggacccaggcctggtgggggtgcattgctgtgcttggccagccaggtgctgcgagtccgtgtcgcagccatttctctgtgctgtgctctgaggttgtctcgccggcaccgggcactgtgagccccaggaggccaaagccccctttgttttatcttgagtccaggcctcgctccatgaactaggatgaatggacattgaatcaacgcagggatgggtggggctggggtggggacgcagagtgaccccgggggcctgcagctgggtcctggctgctgacttccagtttcctttgcctgttggagcccagaacaagtcagaaaggggaaatgcaaagttcgagtgtcttttctgtggtagactggcaggcctgggtgggtgagccacttgcagctagttgcagcgtgagagaggaagtgggaggggagggagagggtgagtttggtgtaactcacccctggaaggaggctgggctgaggctgggggaagtgacttttatttttctgagaggattcttccctggggccaacttcaaaccaagggagacaagaccttcctgggggaggctggaagtgctggggcccccaggtgggcaggtctcccagggccaacgtcttggggaagctataagttaccatgtttctggactgtcacacacacacacacacacacacacacacacacacacacacacacacacacacgagtaaactgtaacacaaatgtgtgcccatgaaagtgcccactttaaaccaccacacagcctgtaaagcgaaggccctggcccgcatctgggcacccactgcccagccagccggtaggcagtttgcactgtagtctgttaccatccctcagagatgcagccgaggagcccagctggcttggagggcccagtgggcgcagcctcaggaaagtggtcaggcccgggccaggccccttccccctcccagccttgggagaaattaccatatgaatgtagctccttcccggagttcgggctggaagggcctgggaggggacaggctcccaccccaggagcttccaggttccggctgctgcctgtgttagctgcgtgagcgtgagcgagccaggggtcactactgggtggaaggaagaagcgggcatttcttccaggaggtcaccgttggagtcccacagtaggtcaaccccaggccctgggtcctcgggaggaggagaaagaagagaagcaggaggtgtggagggtaggccaggaccagaaggcacacagggtcggggcagtgtgggagaccctgggggctccctcatttaaccagctaacatcacagcgttcataagaacacgctattactgcagttttattactttgctctgatttcagaaggcacaactgatgactttagggaacggagaatctgaggaaggcctcgcaggagagggtcagatgcgatcgagtaaatgtgagccgtctgtaaactgtagagtgcacgcacagcaccggtcagccctggggtcagtgttcccctggtgctcagctcggcctctgcaccttttagtgctcggctgggctctgtgggggtcagggctgggtctggtacattagaggacttctaccaagcccctggcagtgtctcagttactaaatccagtttgccagttactaaatccgctctgccggttcccgaatcactcttccgctggggccggccatgtcacgtcaggcttttcatgcaggacggcagatggatagacgctgggaccaagtcatccttgggccgcgagacgtctgaccttctgctggtgtctcagaagatgctagctctccgtggcatgtcttccacgcggtgcttggggaccagtggcctctaaggggcccccctgcctcagcgtggggagtggcctggccaaggtctcagtgtctggttggagccaggcataggctcaggtgtactggctggaggcctcctgcccatgggctctgcctgtcctgtgtccctggtccttactgtgtcttctgtgttcctgggagagaccccaggggccctgagcccagcactggggttggggagtgggcggggaagagggtggggattagggtccctggctgcagaacagccaggccccaagtccccactccactcccctcccaccgggcgcctcatcccacactgaccatttcctgaagaaaatttcctgaaccggcctcccaccccggctgtcccaggaagcccatccatccttccgccttaatgctttgtggctccagaaggatggtggaagccggaaatcatgagtctcattcacaggcggccacacaccgaagccgcggagacgccgtgggaaaggactctggccagcgcggccggcacagagggagcggtgttaccggggtagacgggaaccgtggctgcccccatgctggtctgggagagacgaggggccggacgaaaggacagcagactggccattcattcatttattcattcactcattcacagcgtcttactgggtgcttcggacgtgtaaggttttgtgggtagtgaatgcgacagaccccagacagcaatcggagggccacgtgtgtaagaactgagggacctaggctgggcgtggtgtctcaagcctgtaatctcagcactttgggaggcagaggcgggcggattacgaggtcaggagatcgagaccatcctggctaacacggtgaaaccccgtttctactaaaaatataaaaaattagccgggcgtggtggcgggcgcctgtaatcccagctactcaggaggctgaggcaggagaatggcgtgaacccgggaggcagagcttgcagtgagcccagatagtgccactgcactccagcctgggcgacagagtgagactccatctcaaaaaaaacaaaacaaaacaaaacaaaacaaaaactgaggaacccagtgtagatgagctatcccgggaaaacaagtgggagttctaggaacagcatggggaagggatggtcccggcagggaggacctctgtgggtagccttgttggaagagctgaaaggcagccagagaggctgtgcgtggatggaagctgaagagtaggttaggggcgtgtgttttgttaacaaagacttcaagcatttactgaccaggcacaacactatgtgcttcataaataaatatctcatttgatccccagcattcttatgagacagatgttattatcccatttcacatgtaagaacattgaggcacagagtggttaagttacttgctcagggtcacacagcacgtcggtggtaggcaggattctggagccacaggaatctggtatatcccaggtgcaatggaaaccagtcacggcttcatagagggaaatcatcagattagtaaattttacacacgccccctggtgctttgaggaggagggattcggacaggggcagctaatggtggtggctgtgagatgtgttgggttaacattgatgagagtttgggatggatgagtggattcggagtaatggaaatggagggcccaggcccggcccctggagatctagctgcaatagctgttggctggagaggctgttcacttagatgggggatggggtgggaggcaggtgagatgagagctccagagttcagcctggggcacggtcattgggttcaagatgccttcagatgttggggcttgacagtgacagtggctgcagatacccaggacccagcagagggcctggcacagcggggcccagggacacgtctgtgagtcaggctggcactcaagtgtgaatctggacaaagaaggtggcattgttggcattgaatgctcaggggctgggtgaagtcagctagggagaggggctctcaaggcaccaggactgactccgtgggtgagggcggaggaggagacggcagaggctgagagaatagccagagacaggaggaaggtcagcagagccatgcacagaagcctggagaagatttgaggaaaggaagggctgggtggtcgtcattccctgcagctaggaggcaagggtgacccctgtgtgtttcattcttcagaggattggtggctccatctggtcagaaccccaagtccagagatgcatctgagcttcatgccatggtgcaggcagcaggagccatggagcaggcctgcggggtcacggcctgcctgctgcttcctggtgtctctaccctgagctcaggggttgcttggatgccctgtgctgcatccccccaggcggtgttccagagaggatgaaagtggctatctcaaggtgtgaccaggtagcggtccatgcacactgctttttcctggggagagtctgggatggaagggtatgtgtgtgtttctgagactccttgaataggctccatgtacctatccacccatcttaccacccacccacccatccactcactcacccatccacgcacccacccatccacccatccactcatccacctgtcaacccatctatccactcattcacccatccactcatccacctatctacagtcattcactcatccacccatccactcatttacccatctatccatccactcatccacctgcccatccactcacccacccatccactcatccacccatccacccatctatctatgcactcatccacccatccactcatccacctatccactcattcactcattcactcatccacccatccactcattcacccatctatccatccactcatccacccatccactcattcactcatctgtccatccactcatctacccatccactcattcacccatttatccatccactcaaccatccactcatccacccatccactcatcatccgtccactcacccatctatccacccatgtatccatccactcatccacccatccactcatctgtccatccacttatccacccatctactcacccacccatccactcacccatccatctacccatcctctcatctatccatccactcatctacccatccacttatccatccatccactcatccgtccatccactcatccacgcatccactcacccatccatctacccatccactcatccacccatccacttgtctactcatccactcacccacccatccactcatccacccattcactcatctactcatccactcatccatctatccactcatccaccaattcactcatccacctatctactcatccacccatccatccagtcattcatccatttgctcattcatccgccaacccatccattcacctgcctgttcatccacctacccatccattcatccatctgtccatccatccacccacccactcacccattcacacacccatacacccatccatttatccaaccatccatccccatccttacttcagaaagcatttgaagttgctggggtgtgcacttggaaaatgcgtcataagctttcataggcctctctttggcttcctcacttctttgattggtctttctttcggacatgcaggattctgagcagctcttctgggaggtgggtgcagtccaggtaggctgcctgcaaagctaggaccgagggagccacatccaaggcactgtgggttcccaaggcgatggcactgtgggcccactgcttccagacctcctcaactcccaggctcctgagcaggaggactcctggggcagggcctggagacgggaagagaaaacaattccagtctctcaactcttgtcagtccaggtgggtgctgcatggattgggggcacctggaacagttggccccttcacccctttcccccacctttccagcccctctggctataatcagacagttgtgtgcgatgtctttctccctcctgaaggggtcatttagtcaggctcctactcatggcccaggaatgtgcccctccctgcctgtcccctacccccaagcaggccgtgcctccagccccctgctgtctctgaagggcctgggcatggggcagcctctgcagcatccccagggcccgagctgatctgcacagcagaagggaattgggggaaagctttttttctacccagcacctggcagggggccaccctgttgcaccccagagacccttgtctaagttttgttatttcagatgatttcataagttgggggaggcggagccccagcccccacagcccctgttgttgcctcactgctgagctctgctgtgtatctgctgacaggtctgctgatagcagaaggggctggagagagggaagctctgggccctgccctccccaacccctgcttaggggacatccctgataagaggaaattccagcctgtgacagatggccagtgtccacccacccacgggggaacttttctttctctttgtaagtttgcagatttgccaggaactaaaggaatctctggttgacaggccactgtggacatggctggagggctggcacgggctggatcttggggttgctttgaggtaggggccgctcctgctggaaggttccttggggtggggaaggcatcagggccattccctgaccctccctctgcagtggatccacttcagagcctgagacaaggcaagggggcagcagaaaacagaatataaaatagccccccccaccacacaccgcaccagaagtcagaggattcatccttggcctgccctccctgcagcctaagttctgagagtggctctttaggaagtgaatggtgatggtttgcaggtcagagcttgctctggcccaagattgatgtctcaataggccgcggagcctgggtgaaaaaactcaggctagggaggtggtgggttgcaaatgaaagaacagaggagggcctcttccagaaagcggcgggtggtgtgaggagcccttggaccttgtccaaatttgactttaccgactggggccaattgaaaccgtgctggcagaaaggcaaaactgcttgagattccttcctccacaatagaggagaggtttgcttgaaagggtttggcgagggaaaagctggaggaaccttggccggcagtaaaagtggggacccccgccccctgcctcgggggcgcctcggcccctgaatgaatgaaagaggaggctggatggagacagactcacaccacctgtcccttccaggtcctgcaaaggagcacacagggttcttgttggctcttccaccttgttagtcaccaagaaggagaaaacaccaacaggggaactgtaaagctgcagttttgtttaagccccatagtggaaaccggaaagagctccagctcggagaaaaatgcagctctttgcctttgcaaatccgtgtctttctctgggaggccagagccattgtgctcgatttctaagcagggtttcagagtgtctcaggaggggaaggcagagtctcagatttccggcatcccaggtcctaaccaggctttgaggagacgcttcctgtcccatacaaagtgtgaagtgtaatttgatttggagttagttaacaaattagatgagctgtgtgcattttaaaaattcagtccttgatcccccacccacacacatttgcacaatttggtcatttatattcagtgtttccatctttagaagagaacaggaagtccccagtgacatttatggagtgtttgtagtagcttgggtaggtcagtaggaacacaatgcagtgaaaagcagagttgagatgggaaaatatcctgttttcagagccccccagggatgacattccttatcgtctctgtccacccgctctggagtccactccgcaaacagcaacttgttctcacttgagagcttcctcctgccggagctcagggatggagagcagctggcctcagtcttctcctcttacctctttgtttctcagactcatcttccaccttgaataattgtttttaacctgctctccctcttctctagctgtagaacccagaactttgtgtgtgtggtcaaaagtttagagagtgctgcaggtaatgctgagataaccctattaaattctgtaagttctcatcacaccaagtttgtttgttttttttaattctcattttattttatttcattttatagggatggggtctcgctacgttgcccaggctggtcttgaactcctgggctcaaacgatcctcccgcctcggcctcccagagtgccaagttatttttttaactgggatccacgggcctagggattctttgatgaaccgttcaaaatacgtgtgtgtctgtctgtctgtcttcaatgtatacttttctagggagagtctttacttttcaccagaggtttgtggcacacacatgtcctgtactactgtatcagattgtgaattccttacatgttaaagactgcttcaaatctgtccggaagtctcggctaataaacatttaaataaatgaacttcaaattcccatgtgccaccactgttttcattctgactactctcaagcctgtagtgtcatctttttgttactgtgaagtagacactcaataaatacttgtcaaatgaatcaatgttatggtcctggtccactaggaccccaggatcatcgtctaccattattgtctatagtttctttaccatcttgttccagagcagttctttctctgaggtctgctcacctctgcacgtgtgtctagtttccagccctgtcgccttaccattctctttcctttacctgcatttcctgaactgttaatagttaacaatagcttctccctccacccactcactcatacctgaagtgagaagtcatcattgaggtctctgtggattttgtcagcccaacctggggcggcctcctggaggtggagttttcagatgagggatggacattttggtgtctgctgggtagatctacctgggagctttggcaggggccccagggcagctctgcctctttattttggctgtgggacccctggtgcactagggtttctcaagtaagcatctgtgtcctgggagagccataggcaggcctgagagggcccctggaatctgggacccccagcccggcccagtagctggtaccatcatctttcttgcaagggaagttatggaaactaagatgctaatgtgctttgataggcctggggtggctctaagccctgggaagagccctggcaactttccctggctggcgggtagaatcttctcctggcagttcagggctctgcctccagctccctgggggagagcaactgagggaggagctggaggccaaggcctcagtgctgagctgcctgcaccgcagctgcaccttctgggtcctggctgcaggaaccccatacttctccagcctttccatggttcccgaagacctggcctggggagggggtcagcagcctggggctcacctacctggcttcaaatcctggctctaccgcttactcgctttgcgaccctcataattgacaaaagccctctcggtctcggtttccttatctgtgaaatgggacaataacagtggctaccttataggattgtgtgatgatccatcagttataatagctcctgagcagcgtttagagtaacacctggggctcggtgcagtggcttatgtctataatcccagcactttgggaggccaaggtgggaggatcgcttgaggccaggagtttgaaaccagcctgaccaacattagtgagacccactctctaaaaaaaaaaattagagtaacgcctggcacagagagcccccagtaaacctcggctgctgtgatgagctttgtttcttcatttgttcattcattcaccagactttttgccggggcttgccgtgagccctacgctgctctgaagaaagccgggctggggtgagcgtgatggatgaggtgtctggcttcacaaaccctgtgtgggggggttgtggtgagaggaaaccgcacacatcattattcagttaccatcgtggggagactgtctggacgcagagagcaggctctgtgtgggagcggggagggcaagccctggttgcgaggcagggcttccccaggattcagcagggatctgaaggactttgcaggcacccagggagataggagaggaggagggagcagccctggccggacactgtcctcctagcattgcctgcatcagggactcactcagctttaagaagcccctttgtgggggacagggagcatctgttagtttataggacctgaagtgcccccatgggctcaagtttctgggaaggcctgcaggtggccgtagggctgccgcaggggtgctggccccagggtctggattcaggggagcctgcagagggagggcagctggaggctgctccagtgtgcattgttacgaggcaaagtaaggagactgctgggcccacgctgggccggggtggatggaggcaaggaagtcttcgccggggcaagggcaccagctgtagatgccggcagctttctcctggacacgggcctggaaggctgacagggtgtggtgagtgccaccggctcccctgccgtggcctggtcagtggcttcacaggcctccgtgggcaggaggaggatgaccttgcattctgcttggccaccattggcagtgacagacaaggtgtgtggggatgtggccatttcggtccgtgctctgagagccaggtgtgggttgggtttggggaagacaggggaatggcattgacttgaccctgagcactttgtcctggggtgcaggcccggctgtcactcccctggagctgggaatggcattgggcggtggctcagggtcccttgccccagcggcaccatctctgcatttggccagcaaggctgatgggacttgtgtggacatttctgggacgtagaccaggcagcatgacacacagggaggggtaggcagagaagggcggcccctgggtcttggtttccaagtcaggctttgcaagcctgctgtgtcaagccctctctcggcaccaggccaggtgggccagggtcagccctggggctgtgatgagtgtgagtgcccctaaagtgtgtcatgtccaatagctgcctcctctctgggcactgcctcccagccagatatcctacagcccccgtcccagccacagacagcaatctgattccctcatcctcggcaggtcctggggttggggtaagaatttgtcactaagtgcagatgttcccagagggtgctggctcagggctgcgtggattacagccctttcatccctgccttagacccacctgcaactctggagaaaagatggcccagtggacgcctgcggggaggagggagctggtccccaggatgagcagatttgggggcagtccccatcacgggaccggtgacctactgccaccagcgccagtgaatggcagaggggccctggcataaggcctgggttcagaatgggaacctgcagagaaactgtcaaggtctcccgccacctgacacctccgcctggctgccaccctagaaacacccttgctgcaagaagatgggggagtttgtctggggcatggtctggcgacaccaacttgagaacctcaggcctaagtgttggcctctgggcctcagctgtcctctgagctgtaaagctggctcctgggcacttgtggaaaacactggactctttattttattttactttacattctgggatacatgtgcagaacgtgcaggtttgttacataggaatacaagtgccatagtggtttgctgcacccattggactcttcaatccagctccactagaaatgactgccttctttcccttcttccgtccctccctcctcccctcccttttttccttccttccctgtttccttccccctccctccttcccttctttcccttcctctcccgtcctcatggggatataatttccatattacaccatccgccgattcagaaagcacagttgagtggcattttttcacaaccttctataagcatcacctctaattccagaacgttttcctcaccccaaaaggaaacgccatcctcggtacacagtcactccccctcccccagcccctggaaatcaccaatctgcgctttgtccctacagatgtacttattctgaacatatgactagaaccctaaaagatgtgactttttgtgcttggtttcttgcagttggaatgttttcagagttcatctgtgttggcgcacgctcgtgcctttttatggctgagaaatagtccgctgtgttgactcagcacgttgggtttctccacgcatctgttggcggatgtgttagttatttctggagccgggtgtgttgtgctactcacgggctgcactaggagctggggatatcactgagtaagccacagcctcgggcacccaggagctcgcagagcaggagctgggagggaggtcaggaggtgcatggcctgtttgccaggctggagagacttgcaaaaagtcactttgagccagaaaccagagcctgaggcctctgactcccagctgcggagccgggagggaagctctgcattttgctttgactgtggggtgacgtgtcagttactgtccaaatcagaacctttctgagagtcgacgtgggtactgctgataattagtctggatacccgaaagaatggaaagcagggacccagacagatccttgcacaaccgtgttcgtagcagggcgaggcctggaggtgcgatggggatctcaacggggcagctgccgtcttgctggagcccacggtctttggggggggtcacaggtgttaaccgcatatcatacaagcaggagtgtgaaatttcagggttgccaaattcagtgagggtcttgtgctggcctggccacttacagtggcatttcaggaaaaaaaatcactctatggacctcagtttccccattagtaaagagtaggttggactggaattctgtaccatccagtatagttgccatttatgaaatgtggctatttaaatttaaataaaaatagaaattccgttcctcagttggactagctcagtgtcaagtgctcagaagtcacttgtgaacacactgtggcaattcctcaaaaaacgaaaactagaaccaccgtagcatcccataattccacttctgggtgtggattcaaaagaatgcacagcatcttaaagagctagagatatttgtacacccacattcatagcggctctgttcacagtagccagcgggtagaaacaacccgaatgcccgcggtcaaatgaatggagaaatcaaaggcgggacaggccgggcgtggtggctcacgcctgtaatctcagcactttgggaggccgaggcgggtggatcatctgaggtcacaagttcaagaccagcctgaccagcatggagaaaccccgtctctactaaaacaaaattagccgggcatggtggcgggtgcctgtaatcccagctacttgagaggctgaggcaggagaattgcttgaacctggggaggcagaggtttcggtgagccgagatcgcgccattgcactccagcctgggcaacaagagcaaaactctgtctaaaaaaaaaaaaaaaaagggtggaacatacaaggaatttgactcagccgtaaagaggaagttaggatacctgcaacagcaagggtgaacctttcgggtattacgctaagtgaaataatttggtcacaaaaggacaatcctgtaggattccacttataccaggtccgtagagtagtcagattcagaaaaacagcagaatggaggttgccagaggcttgggggatggggctggggagttgtttaatgaggacagtttgttttacaagatgaaaaagttctggagatttgttacacaacaatgcgaatgtacttaacaccactggactgcacacttcaaaatagtgaccgtggcaaacgttatgacaattaaaaggaaaagtcacgtggccagtggctaccacgctgagcagcgcaggcctcggacggtgtcgtggtcacagacaatggagtgggtgatctttaccattgtttccagctgtctgagcaccatggtgtcctggggccaggatgaaagtgtctctgggtatgggggtctctgcttttcccacttgggagtcctgaaggcagaccccaaagctcacctggccaggtaggagagcgaggcgggctcttgcattgctctctgcgtgcgtgcctgcctgcgggccagccggggcctgcaaggccgcctctcgagggaggggttgcaggaatggctctcacctgtgcagaaggcaagccactgccctacgtcaatggcaaagatggggctcggctgcgttgtattattatttctcaagcggggcccctggtgggcaggatgtttggtttgatttgagtttctgcagtgagtgctggtgcctgtggagggacccagctgcagctgagccggcccctccctcgctctgggctccaggggcgttgggggcgagaaaggagagttcagggggcagcgcctccccccaggtcctgctggggagggttgagggatgctggggggaggtgggggcgggtaggggctggtcccagtcccaggcaaaatggctctcagacccacaggcagatggaagcgattttcggtcacgtgggtggggactgaactgctgccccgcaaggcaaggccccatgtctggcttcaggaagcggccccaaagccacatggtccatggccagatgcagggctgtgtctttgtttatttaaaggtcctggaagcccaggggagagtatttctgaagggggagcaggagcaggagcaaagccctgaaggcttccaggctgcgtggcctgggtgggggccacgtgggggcacagagagaggagccctggcctccaggtccgcctgtgggtattgctctcagcagtggagatgtgtggacccccccttggcatttcccaacaaggaattatattgttcctttgttcccccaattccataagataggaattcctgtgccctgtggaggctgagaagacggggaggtgcctgtgaggataaaccagcccccagtttctggcttccagagtcttttcctctctcacctctgatgcctcaggcctggggagcctccctccgacaccctctgaccgctccagtgaaataggccgagagggatggcttgaatcggctggggatgcaggctgcagccagggggctcagtgggcatttcctgagttcggttcttgccccgcaagtggaagggcagttgaactgaagtctcccactgcccctcctggcctggaagcctgcctcccaccttctgggcagagtgaggagtgggcgtgggccgggagggctgcctcctgtctgggagggctgctcacttgcctgtcacgggggatgagccccctgcagcctcccgtgctgtggccctggctcccacgccggctccactcccctgtggctgcccctgctgggtgcccaccggtcccagggaaaagccactcccctcccggaggactggcgggaggggccctgcctgggagcgtgccgtgtggtccctgtcttagcgcaggatgcctgaggccagatcctccctgggaggcaggatggggcaaaagtctccccgcaggcagagcagggcctggatgggcccaagcagggacgggggcacagaacagcagccgcccagcctgcgtgggagctgagggccaccaagggcagctccagcctgtggggactagcagaggcaccacctctgtgaccagcgagttgtctgcacctgcatgcgcatgcaccagtgagtgtggcgagtctgaggtgtgctgggacctggcccgtgtaccagccagccctgatgggaaccagccccatcctgggtacccctggaaccccactgtgtgggagcacctgggtcctcagcaggcgtcttccgggcgtccgcccccagccccaggcctctgacccgtgtgtggtgtcttaacagcagccaggagcagggccatcgaagggacctacagacagaagaggctttagtgatttcgggaagttcagctccacgtgccccacatacccaagagtaaaacttggtcttggcctgtgggtgtgcagcccgtgggcgctggccaggcacacaagacggccgcctgggtcagtccagggggaggcagatgtggtgcaggggcccccctcctccatgagcccaggaacagctctgcatccaggcacccgccctgcacccagcacttttccttctcccaggactgctggctcgttctatgggattgaacacacaactccatggggaccgacgctggttctatccccctttcttacaagaccatccatggggatgtgggaggcggggacacacgctggttctatccccgtttcttacaagaccatccctcctgtgtcttggctcgtggatcggcttctaaggcctttgagtggcagcaggcggtacagcttatctgagtagaggtgaaggagagggccaggtccacctgggtggcccgaggcagtgtggagggccaggagaggagagcaccctccacccttgtctgagcagccctccagggtacggagacaggagttcagggtcagccctgccttggagcgcagggggcccccagcttggcacagctcctagaagaggagatgaaaaagcctggccttgggagtctggggatggagctttgctggggaggcagcgtggctgcaggatggcagctttttagaggacaccacggccagggacatccacccgggggaattctcaggggtcgcctgggcaagtcgcttagcctttctgagcctcagtgcctcagtttccccatccaaggatgggtgtgacaaccacctggcaggcgcctgtgtgtgagcccctgttccgctctaactcctctgctgttccttccccagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcggtgagtcctcaccttgcatgccactcaaccaatgccggaaaccagcctcagcccccagggcggcccacaagcctttgggcttggtcttcccttctgtaaaatggggcagcaaccctgacctcaaggacggattgccagtgacattgcgtgtgcatgcatgcgcctgggaggagcccacagcctccagcggctcctcagaggggcctgtcctgcacatccagggcccctgagatgactttggggagcccaggccggcctggagcaggtcctgatgagtggtcgctgcctctgagcaatgacgtcagcttgtgcagagggttctgtggcagctgtcccctcactgttgctccagcctggccctccaggctccccaccgcaccccaccgcaccccggccagaggcttcccagcagctcagcttcagctctgccctggaattggggcctcgtggcttccacaccccctggtggccccggagagctggaggtcaccacgggaggtcgtcgatcagcacgacctgggcagggtgagggggccaggctggagtctacagtgggccgcctgttgtttccaaagccccccaggtcccattcaaacctcacagggaccctgtgaagggggcgtcccgttttccaggcagaagcgaggctcagggaaggctgccaaggttccttagctcacagggcagagaaccgcagccaccgttttgactcccagaactgtgttctgcccactccacggggtccagggaggggtctggggaagtgcccccgccaggtcacaccctaaacaaaggtgagcttgcggggtttctgcaaggtgtctgggcacctctcaggccgggcctgtttctctgacctttgccagccgtgcacgtccttcctgcccagctctgtggacgcaaacccacacctgccagcccgacacctttctttcctcttctgcactgatctgggccctggctcccctggggtcttggtgtcctctctgcttcctgtagcctcatgggacccggctgctcatggccctgctgtgctcacagctgcctggaagctggcagcctgcttcaagggagggcggaggtgtggggtcccctcctacggcccccaccctgttctgcctgttgtgggggacgtgcttgtaccctgaggattcagggctgcctcccgggaagatggctggagagaaagagaggggagaggcccaaaggcagtggccaggctgggactcatctctgtgggctacggaggggctgccctgctccctagccagggacagggtgagaaggacctgggaacctctgcgtcccagccatggcacaggccttcttccggagctttggccccaaggagagggagaggcagcccagcagccctcgccttccgtggctgccactgtgacagccttgccctctgggaatggtgcgcaggaggccacttcacctgtctgggcctcttcgccctttcaaccctgagaagaacagtggtcctgattccccacaaaatcactccctcccagggatgccgagtgaggaacaagacgtggggcagctctgctctcctccctcctccctcccatggcagctgtgcccacctgcagaggtgcaggcaaggtggaggggcacctgtttggaggtccacagaccccggggagaatcccagctttgtcctaactcagcggggtgaggcttgtgtgtcttcccctgggctcctcctctgtgagccttagcttcctcgtccataaaatgggatcatcccataaagtgagatcaagcgagctaggccccgggcagggtccccaacaggttgtggttgttcgagaatttgcagcagtggtgatggtggttgtggtgatgaggatgatgggggtggtaatgacggtgatgatgatggggtgatggtgctagtggagatgatggggatgatggtgatggtggtggtgatagtggtgggatggtagtggtgatgtgggtgatggtgattgtgatggtggtggtggtggtgatggaggtgatggtgatagtgatcatgagggtgatggggatggtggtggtggtgatggtgacagtggtgggatggtagtgatgatgtgggtgatggtgatggtggtgatggtggtggtggtgattgtggtggtggtggtgatgatggtggtgatgatggtgattgtggtgatggtgatggtggtaattgtgatggtggtggtggtgatggtggtgatgatggtgattgtggtgatggtggttatgatggtggtaattgtgatggtggtggtgatggtggtgatggggatgatgatggtgattgtgatgggggtggtggtggtgattgtgatggtggtgatgtgggtggtggtggtgattgtgatggtggtgatgtgggtggtggtggtgattgtgatggtggtggtggtggttgtgatggtggtgatgtgggtggtggtggtgattgtgatggtggtgatgtgggtggtggtggtgattgtgatggtggtggcgatggtggttgtgatggtggtgatgtgggtggtggtgattgtgatggttgtgattgtgatggtggtggtggtgatggtgatgatggtggtgattgtgatggtggtgatgggagtgatgctggtgattgtggtggtgaagggggtgatggtggtgattgtgatggtggtgaagggggtgatggtggtgattgtgatggtggtgaagggggtgatggtggtgattgtggtggtggtaatggtgatggtggtaaaggggtgatggtggtgattgtggtgatgtgggtggtggtggtgatgtgggtggtggtggtgattgtgatgggggtgatgatggtaatgtgggtgatggtgattgtggtggtggtggtgatggtgatgattgtgatggtggtgaagggggtgatggtggtgattgtgatggtggtgattgtgatggtgatgtgggtgatggtggtgttgatgggggtgatgatgttagtagtggtggtgatagtgatggggatgatggtggtgttgatggtgatagtggtgggatggtagtggtgatgtggttgatgatggtgctggtgctgatgattgtgatgacagtggtggtggtgatgagggtgacggaagtggtgatgatggcgggagtgatgggatgatggtaatagcagtgatggtattgtgatgatggtgctgatggggatggtggtgatgataagggtgatgatgatggtgatgataataataaaagtaacaataataaagggatacaccttgcagtatcccagttggcatctcctagatctaaggtgtcgtggctggaacattgacataactcctgacctgaggttggccaggacacagacctggtggacagagagagatggacgaggagtgtccgtccttgggctactaaacagttcaggccagggattcccagcaccagcctctgtcctcccaggagcccacacttttcctagaaaggtgttatcaaagtcagaacatcagtgtaatttagggtgttttttgtgttgtgtttttttgagacagggtctcattgttgcccaggctggagtgcagtggcatggtcttgactcactgcagcctccacatcctgggttcaagtgattctcgtgcctcaggcatgtgccaccatacctggctaatttttgtgttttttggtagagacagggtttcaccatgttggccaagctggtctcgaactcctgacctcaagtaatccaccctcctcagcctcccaaagtgctgggattacaggcgtgagccatctcgcctggccgatttttgtttttttaaaagacagggtctctgtcactctggagtggcaatgatcctagctcactgcagcctcgcactcctgggcttgagcaattctcctacttcagcctcctgcgtagctgggactataggtgctcgccactacacctagccaatgtttacattttgatgtagagacagggtctctctgtgttgcccaggctggtcttgaactcctgggctcaagcaatcctcctgcctcagcctcccaaagtgctgggactacaggcatgagccaccacacctggcctagggtattttttttggtgtgttgctagcgtagcccaaggcagctctgtgcagggtaaagcaatggggctccgagtctggaggggtgtgtgtgtgtgtgtgtgtgtgtgtgtgtgtgtgcgcgcacgcgcgcgcgtgttatatgtgatttgtttgtgtgtgttgtgagagttgtgtgtgaggtatgtgtaagaggtatgtttgaggtgagttgtgtgtgtgttgtgagttgtgcatgtgaagtgtgtgtgttgtgaggtgtgtgtatgaggtgtatgtgagttgtgtgtgttgtgttgcatatgaatgctacttcctcatcctcgtttgtctcagtcacctgtggactggctgtctgcacacacggtcactgtccctcgagtggcaccaccctgcaggccagcgccccctagcacatggccccacagaccccatgggacatgcgtgagcctgcctgatgctcacaccagctccacgggggaaggactgtttatcccattttgcagatcaggaaactgagacacggtgaggtcaggtgacttgcccaggccctggccggtcagggaggagcagtttgaacacctgggctttggttgcaaccaccctggtgaactgcaggaatcccggccacctggtgcaccctgggcagccctgggctcctccgccagcccggcctctgtcctgtccaaaatctgagccaccaggagacctcctgtccagaaagcacaaggggcacaagagatgccgactctcccaggcccggctcacctctcaggagaggactgtggcctgggttgtgctggcatcagagcccggctgtgtgggtttacacagtcactggacacccggctcgagggtgaagtcctcgggggctgcttggcagggatattgccgggaggtagcccaggcactgctgaatctcagactggagagcctcgtgcctgggtgggaggggccccatgtgcagaccctgctggtctctccggagagacccctgaccggcctcccatcctctccccagggcagagcggcttgggtaaatccaccttaatcaacaccctcttcaaatccaaaatcagccggaagtcggtgcagcccacctcagaggagcgcatccccaagaccatcgagatcaagtccatcacgcacggtcagtggccgggagtgggctgggggtgcaggacgcccctgccttcctggagcacaggggttgggggtcaagaccatcacacacagtcagtggccaggggcgggctgggggtgcaggactcctctgccttcctggagcacagagtggggggtcaagaccatcacacacagtcagtggccgggagtgggctggggatgcaggacgcccctgccttcctggagcacaggggttgggggtcaagaccatcacacacggtcagtggctggggatgggctggggatgtgggatacccatgccttcctggagcactggtgcggtgtgagggtgcccgagtcaggcaatcccaggtccccaagacggggactcgctgtgcccaccatccccagcatgttgagcatgttggggctctggctgtgatgggtcagtgtcccggacccctgtgggccccgtcacactgagctccccacagacaactgagttttccaccaaaagtctgacaggcaaggggctcccaggggaaccgtcaccggcctgtgccggagttggctgaggaaggccattaatttcccggtgtctccttggttgtcatcgctgcctacctggggttgccccggggtcagtcaggtgtggggtgtctgtgagggtcttccgtctcccctctgactctgcgtccgtggctctgtgcagatattgaggagaaaggcgtccggatgaagctgacagtgattgacacaccagggttcggggaccacatcaacaacgagaactggtgaggcccctccagggggaggagcactagcgggggcttcagggctccctggaccccacccagagtcagccctagaggtttcccggcccgcgggggtgcagggcccacctcctgggacctgacatgctgccaaagccgcacgtctcaggggcctgaaaattctggaccaaagcagaattacctggggaatcttgctgtccccaactcatcacctgaggccagcccggggaggctggtttgggaggccgagggtaaggctgtggcatctccgctcagcaagccagacctcccagggcatgcatttcattggaaggtggggtgttgggctctgagtcctgggaatgcacgacctgcttggggagggcatctcatgtgcctgctgactcgtccccatcccccacgcagctggcagcccatcatgaagttcatcaatgaccagtacgagaaatacctgcaggaggaggtcaacatcaaccgcaagaagcgcatcccggacacccgcgtccactgctgcctctacttcatccccgccaccggccactcgtacgtccctgcagtgtcggcgtcctcatgccgggtgccctgggttccctctgtcccctgggactgcaagacggtgctgtctgccctgctgctgggtgcagaggggctgagtcaggggccatggccgccagctatgaagttgggggtgtgccatgtctgcacctccaaagcctcacactgacccctatgcaagtgtcctgcccagcccccatccttcagctgcgtcttggggagctgagggtcaggcaggccctgggctgttctggagcctggtggtctgtgtcctgccttctcaggccaggctctggcaggtggagtgggagcccccagccaagcacccgtagcggtgactgaccttctcatccgggccctgcctcatgggaccccttagagggtttggtgcgttcttagacgggaagcacagagatcagtgctggccccttccagggctggacggggctgctgttggtgttggtgagagccctttcctcccgccggctctgtccgcacctgacgtcgcccctagagatcagcaagggcgggaggctgcatgtaccctggcaggtggactcttcatggcctcacggaccctctgtcctcagctccctgtgcaccccctgccagacacctgtggctcaccctgagccagggctgggaggaggaggaccagaggccagcaggagtggctggtggaggcagccgtgggtggcttgtctgcatgggtgggtggagaaggtccttcgcacctgctgtcccagatgtacttccctgggcggaggaagcccaggggtttggggaaaccatactctgtgggcaccaggtgcaggaaggagcctggctggtgggcagcgggcctcacccagagtctgtgggaaaacccaagccggagttttcgagcccaccctctggcatcatcctctgtgggccagcaggagtcaggggcagggggccagcccgctgtccatgggcctctcctgaactgaacatctgccctcccaggcagaacggctcacctgcggtcctgtggcagctgttccagctgctccaagctttgcctcagctgaggctgatggcaggaggcagaagcctctcctgatgccagctgggcaagccgagggcgggcgggcggtctgtggcacttctgccactccccagcactgaccctttggctgggactccagctaggcatgttgcctggtcccgcccaaggcgtccagtcccatggggcaggggcgggccttggccatctctgcttaaacttctgcccggagcgggcttctccccagccatgtgtgtgaccgatttattctcactgtgggaaaagctcggctccagaactggggaagatggtgccccagttccagggccctgccagcccctgccacccacagctttccccacatcagaccccaggctcactggggccaagcaggcaaggggagcagcccgcctggtgcaggggagcagcccgcctggtgcaggggcaccgcacactggtgctagcttctatttctcttgcctctcccctcccagccaaagccccacagcaagacggctgctgagccaacgacagcccttctgtgtggacatgtaggggtgtggttgggaccccagaactcatggacgagggtgcttggagctggccctggcccgcctggcctgtgcagtggtgtcacctgtgtctgggacacacccgtgtccttcctctgccccacactcacagcgtggccgactcggcccggggccctgtccttgccagcagggacccccgtgagccccgagccagcacctgagagtgtcgacacctgcttgggggtgggtgcccccccactgccccgctcccccagatgagcctcacgcacatccctctgcttcagcctcaggcccctggacatcgagtttatgaaacgcctgagcaaggtggtcaacatcgtccctgtcatcgccaaggcggacacactcaccctggaggagagggtccacttcaaacagcgggtagggttccatctctacttgccccagcccttctgtgcaacctggagacgctgcaggcctggcaggggccaccccgtctaaaggagtcacactgtcagggagaccgaaccgctggtcactctccccagcgggtggctggcctggtggtccctggcccaggtggctgctgggggccgtccctgagatggcctctccagctcccccatatctcaaaagcagctttgtgggagtgccaattctccagcagagtctctgaggggggttttggagaagacctggaccaggcagatggtgaatctctcttccagggagtgaggccgagcaggggccgtgcgacatggcccaccttgttttatgccccccctttttttttttgagaaagggtctggctcagttgccaaggttgcaatgtagtggcacaatcatggctcactgcagcctccacctcccaggctcagtccccgagtagctggaattacagacgcacaccaccatgtctggctaatttttgtatttttagtagagacgaggttttgccatgttgcccaggctggtctctaacccttgggctcaagggatcctcctgcctcagcctcccaaagtgctggggttacaggcatgagccacctcacctcgccctgcctggtttttattagatggaagagaagctgggccaggtgtggtggctcacgcctgtaatcccagcactttgggaggccgaggcgggcagatcacttgaggtcaggagtttgaggccaacatgatgaaaccccatctctactaaaaatacaaaaatattagtcgggcatggtggcgggcgcctgtagtcccagctacttgggaggctgaggcaggagaatctcttgaacccgggaggcggaggcttcagtgagccgagattgagccactgcactccagcctgggtgacagagcgagactccatctcaaaaaaaaaaaaaaaaaaaaaagtttcaggagggatggtctctgccaccttcttctccgccaccgtctgaggcccctgctgtgggatagggaggggcatccaagcaagagggcagccctgggctcttcctcctgacagggcagcacatcagagccacatggggtgcctttcaaaatgaaaccgaggtgcctgggctgcggcaccacatctgcctcggtgggtgtgggtggggcctgtaacctactccgtcctggggccaggtgtcagggaccttcccagcatgtgcaggggaagacagtccacacaaagtgggtgtgtctgccggaggctacacacgggctgtggtctgtgcctgggcaggcgagcagccgctcactgggatgtttctgttgcacgtacccatgtcgggctgctggcagggagctgagaggttactgcaggcggggcccctgctggaactggggactgtgacgagggttttttaggaagggtttcaggaggggaggtctcggtaaccctgagtactttcttggggctgtgatgagcaggagaagagaggtgggaggtgctcaggacgatgaccttaagcccctggggagttgcagcgtcgctcaggacagcaggtgcacctgcagctgcccctcttccctccaggaggcacaggagttggaggtgattggtgtcacagccccccagagcctgcccttgaacccgagcctggggcagcacacagtgtggaggtcatgtggcaaacaccagtgggtgggtagagcttgccacagggatgggcccatctctctccctccttatcccagatcaccgcagacctgctgtccaacggcatcgacgtgtacccccagaaggaatttgatgaggactcggaggaccggctggtgaacgagaagttccgggtgagtggatccactaggatgttgttcccaggggacccccagttcctgctgaagggtgggttgggggtttggaggaccttaagccatgaaattatattcttggggccagagggcactgagcccaggtgtctgtacccagtgctgtcaggctgaggctctcgtttttgggggaccccaggctcagggcagctcctcccgggggcccaggggagggaattgccttcccgcacatgtgtaaccaataccgtctgcccgttccccaggagatgatcccatttgctgtggtgggcagtgaccacgagtaccaggtcaacggcaagaggatccttgggaggaagaccaagtggggtaccatcgaaggtactcgccgcaggcgccggggctccagacagatgggaagacagtctcttctgctgacccagagcctgtgggccacgcctgagccagggactcgtggaacctcatccactgccttgccccacccagagggaggggtctccttgtccccattcaacccttgggaaagtgagagggcaagtggcctgtgcagatgcctccaccccagacctccccccgggcagggaaagattcagggagacaggagctgggatgggggccgccaagttctggatcctggtgcaggctctttcataggcacctgtgtggccctggacaaatcgcccaacctctctgggcctagaaaaggggtgggctgtagctctgtgagccagatggaccctcggccccttaccctgctgaagttcctgggaccctcacaccttagtctcttgagtggctgttgtaaccaattagcacaaacgaggggacttaaaacaacacaaacgtattttcacagttccagaggccagaggtccgaaatcaggggctgtttccttctgaggccctgaggaccagcctcatccatgccttcctccttctggtggcgcctggcattcctagttgtattgtaaaggcatcacatgctctaatctctgccccattgtcacagggccttcttccctgtgtctctgtcccgtccctcctcttcctttttttttttttttttttttgtttgagacggagtctcgttctgtcacccaggctggagtgcagtgttgcaatctcagctcactgcaacctctgcctcctgggttcaagtaattctcctgcctcagcctcccgagtatctgggattacagtcacgtaccacccacctgacttaatttttgtatttttagtagagacaggatttcgccatgttggccaggctggtcttaaactcctgacctcaggtgatctgcccaccttgcttggcctcccaaagtgctgggattacaggaatgagccaccgagcctgccctctttccttcttgtctttggacaaggatgcctgtctttggacttagggcctaccctaagtggatgatcccatttggagatccttaatgaatctataaagaaagacgttttccaagtaaggtcacaatcatgggttccaaggcctggaccttgaccatgtctttgaatggatgggagcccctggggggccacagttcaacccactcctggcggtgacaccccgggagggatgggcccgaacgtttccttccccttcctctctctgtcccttcatttctcattagaatggaagaggggaaggtgcagagggaaatgcagcaggaaaagccactttgttctgggagagcacttggctgaaaggcccagtagagcaggaagcacaagtctcttaatcttccagggcctcagttttcatcatccacaaagtgggtgcagtgtgccaagattttagtgagttgagagactgtcccaaagaccacagagctttttgggaagctgttgctctaaaaaaatggtcataatgacaattaccaggaggcatcagacactcctgtgccactggctagacatgggttatctcgtttcatgtccgaagctccccgcacccaccctccttgcagagttgaagaggtgctgtgagcagaaaacctgccaagggacccagaacgggaggcggctctagaatctacagctccagccctgcaccagactccctcgagatgggagttcatgcctggaggagggtgtggagaggcacacgggcctttcccctgtctgcactcctcccctaccaccacccctgccgggcccaccctgcgggagctgcccagctgggtgcagcctgggtgttttccagtatccgcctgtggtgtcaggctggcttgcctccccttggcccctctgcctgcagttcctctcttcctctctgcccaaagagttcttgctgtttaggaaactttttatgaaaggcaggtttgggagagttagggatggatgggcctgggacgggccggcggctttgctatgggcgtgcctctgctgcaccctggtggccaaccttgagtaccgcaggtggccggtgacagaaactgtcaggaaatgcacaagagagaggtccccgcacctctctgacctgtgcgttgttgagcaccactggctccagctgaggaagagtctggaacctgtcaggacagttgtgaggtggtggggcccactttccagcagtcttatatgaggaccctggaaatgtgccttcagcactgctgggtttttatatcaggggccccatgagttcatagctgacctgacacccggactagtaagggctgtgccttgttcttgcctcccacttggtgaacagcatcttgaggtatctttcccatccttagaaaccaccccaagtattgtcaatagaaatgtggggtgtaattgatcacgccatgaactcatttaatcctcatgtccctgagaggcgggtgacgttattatccacattttatggatgaggaaactgagggaatgagagtaacttgcccgagccagggagtggcgatcacacactccaactccagcctgagagccccattcttcctgccggctctcgctgcccgtcagtgttagatgagagtgctgctggtcagtctgcaggaggttctagtgtggacaccgccctacacagggccgtggcaggagggcctaggcaaaggcaaccggcatagcactgagagcacttgagggctgggcaaggtggaggccccggccctgcctgctggcctaccaagtaaaaactagacatttttaacttggggaaaagccatgtggctctgcgatggggcagcctggagccaggtgtatgggttctgcatcccgctccagccttatgcactgtggagctgagacagacacagttcttgcgttctctatgcctcattttcttttcttttctttttctttttctttttttttttttttgagacgaagtttcactcttttgcccaggctggagtgccgtggcgtgatcttggctcaccacaacctccacctcctgggttccagtgattctcctgcctcagcctcctgagtagctgggattacaggcgcctggtaccaggcctggctaatttttgtatttttaacagagacgagatttcatcatgttggccaggctggtctcgaactcctgacctcgtgatccacccacctcagcctcccaaagtgctgggattgcagacgtgagccgtggtgcccagcgtctacgccccattttcgtaagataatggggataacaaaggaatcacaagagacacttgcaggtgtgtgaagacgaagttcatcacatgggagggcaccgggtgtctttatttgccttccctgcccggctccccacctccagtgatgccgttcactgccctccttgttaaaaggccttctgttatataacagttacacatgccaggcaccgcgtgttcatataggagttacgaagcacagcaataaaatgaccactctgagatggccaccagctcgagcccgagggcacttgtgggtgcccgtggtctcctgcccagtctccctgagaagtggccactgtcccgagcttgggcttgtatgtattgtgtgaagtgcacatgtccctgagcaatgtttagcattgctgattcttgagcttgtgaatggtcgtccacagtacgtagcccctgtgtgtgtccctgtgtgtgtgtgctctgagcgcacacaaggtggatggggccgtgggggtaacaccctgtgggccacaggttttctttaaaatcccagctccgattcctgcttcatcccattcccagcagcccagccccctgcctgtcttcaggcccctgctgggacgtcctgctctccctggtcaccccagtggtgcgggggcccactgccctggcttctccactgtggcttccttccatgctcctatttggcctggtcactgtgccatctcccattagccaggaactttctggagagcaggagctgagctgtccaggagcaggagctggtgctggtcactccagtatcccccagactgagggcagtgccaggtgtcctatactcagctgcagagcaggtggttcccctgccctcctgcccatggggctgccctcagactctgcttttggcaccagcatttctgggcagggggagagaggtggggtccgggcagagtttctccactgggacattaaagcccctcctgtctcctctcctagttgaaaacaccacacactgtgagtttgcctacctgcgggaccttctcatcaggtgagagacagggtgcttgggtggggctgacggcttcacccctaagagggccctacagcgggtgggggcagtgggtgtggggccgaagccctgggcagagtgggtgccccctgccacctgcctgccctgccctcgggaagatcttggaagcccatcttctgaaaaagaaaacccactgggaaatgaagcaggcagtgaagatccttttcaacccctgcgaagttggctggatgggaaggctgagctttgatccactgtggtctggcccgttagagctgcccggtggccactaagggcccagtgaggcctcatgtgcaggccctgccggcagcgtggggcgtctccagctccgatcccactggcctctgacccctacccctttcacctggctgaggcttctccttgtttcccttgagtccaggcaaggaggggaagccctgatggagagggtgctgggtgggtggtccctggagtgtgggccctggcctgggcaggttcttcctcagcaagcagctggcatggatgatgggaatgttatcaagaggaggggcctccaggttggcgggggcaggggtggggggattccgggagccgttctgccattgtggggatactgggctttccaacctccctccagattattcctcctgagctgcagaggaatgaaaatccgagcccaggacttttttttcctggggacaagggcaacccagccctttgccccaggccacctgcctgccacaggccatagtcctggaggccggtggtcacccactgcttccaccctgccagcaccctggacaccggcctggagcaacaatgctccagccctgtccctctgagtctatgcactgtccctgggccctggacccagggccatagggtggacccagagggagacacatgcactggaatatgtgtgttctgaccgagtctgggcttaccagggggactgacccttcccccaaaacgtgtaccagatctggtccaacatggtgggcctgggggaccccatggggagccaagcagtcgggatggggagtgggggtgggggcaggcgggcctgagtccgaggcaggccgagcagggcccctgccccgctgcccccaccccgctgcgcccacctcactgacccgcccgccccccacccccacaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccagaa

SEQ ID NO: 1831 - DNA, 124515 bp, Homo sapiens
agtcagtatggaggaggcggaccttgagggagagtaggaattggattgcaagaggaaggagagccttctggccagcagcagccagcagcagtgggggaggctggaatgagctggctggagagggggctggggcataaggaggggcctgcctgtgaagatcatatgggccaggctgcggagggccaggcatgcccgccgggagtgcagctggtccacgggaagcatctggagtggctgggaatgggcgcaggagcagcgccgtgggagcacaggtctctttcccggggcggctcacctggtgtcttggttcctgcaaggtaggccgaaagggtggggaggaaactgccagctccttacagcgctgggatggtggccccagggttcctgaggccagcggatgtgggtgcctgtcaccatgtgggttgctgaggggcggagactccaggggccaccccaaagcaggacgagctctgagccacggcatctctgggggcagttttccaatcgagcagacgtctaggcctggaatcctgtaacagaggccacagggccctgatcagggtgttctgggaggcttagaactagtggcagtatacagggtagacggcaagtgacctggcatggggaaagaggcaggtgcccaggccggcacagcacacccgtaaggaacaggtagacgggaagccgtccgtgggcctgtgtgtgtgctcggagttaaaattctgccaatgtcccatgtcctgggcacatctaccccctccctggggagcacctttctcttcaccttttccttccccgcctgtccccttcacccagggccttccccatccctcccgtcttggggaccgagggcaccatggctttatgttccatcaccgatgagttgcacagggattcagtccttccgctgttcaggccgggtccttcaggctcagggttcccaggaatggagagggtatcagtgtcttccatggactcaaacttcccgcatcccgcctttgctcccccttcaagataggtctccgagcttcaaggttttagggctctgtggaggccgccacgtagcagcaaggagaatgttttgtatttggctgatgagatttttagagtctcattttctacttttccactgtacaaacgggcctccaggcgactgcagcacccgccactgcccgtaatagggtgacaagagggatgaccctttcctctttctcccttctggttggtggaggcacggggctggcggacggcatgtgctttcgtgaattcaggccaaatctgttatcgcaaacacgattacaactcgggtctttgtgtaacaaaagcctttccaagtaccagctgttggcctgctttgctcagcggtgtttgctgtaaccagatttgcacaccgagaaagaatccaaaagtccttgatgtttgttgaaacaatctggcccaggacccacgtgctcagatcccagagctgtgtggcatctgagcttctcccgagcccccactgtcgcccgaggaggacccccagatctgtgttctggaggcagagcaggctgtgggacgggcttctgggtgggaaggaccatgtggatatgccttcttgtctgagagtcccaacacctccgggacgtgggagctggcgcgctggcaggattcaggtgcctctttcctctctagagaaaaaggccccgttgcttggtaataggtgcagacctgtccctaattaatgccagtaggcctcttgcgtgatgaaccctgcctttcagccaagactcaaggcatcctgtgaatactgcctctctgcagtttgagcttttgtggtgggaggcaggagccatggggagtgggggcaggcctcttacacgggtcccacagccactggcagcactgacttgatgctctttgagttcagagcccagggccagacagacccactgtcccgactacgagttggttcatttagaggggggcggacacagcacccaggcagcagatgcactgtgatcagccttgcagcggggctgtgggttctctgggctggatgtccgggaagaggcaggtggaggtaaacgccaggacacccctgcagtgactgggtgactgcaggctggaaatgctttctgtgggctgtggctgtccaggaaggttttgaatggggctagtggacagagtttgcatccagaggggcagtgctttggaggagtgaggggtatggcagtgtagggatgcccaggccgccctcactctgccattggaaagctgggcggcttcggtttcttcagtttcttcgcctgtttccctgcctgcaaagtggggttagaaacagctctctttgagggttgctgggggactctgagatgcagcccatggcgctgagcacgggtcctgcctcctacgggtgtggtgggtgtcgcggctggtgtggcatctgggcgggaaaagggggcatttgcaaaggacaggtaggtttggatgcttaaatatgcagatctggggatgggaggtctcaggcaagggcctgtgtgatgccactgtatgaatgaggccggacagcatggtcaccactaattatggaaagcacggcagacactagtgccagtagcgcccgcctgggggtccctctgagcccgacaggtactcaggctcccagtgcagccatgggaccccccttttcctgcctggctgacattctggaggctggcgtcatgttggctgcaggttcctcttactgggaggttgtcctggtcttccctgccaccatctacccccacccccaccctggagtgtcacagatgggtggaccatatgcccatctgcagggccaagcgctgacaatgaggtgagcacttgctggatgaccggaccatgaggacagcgggggcgctggcagcctgcgttcggctctgcaggctggcctttccctgaaaagcggttgtggcagagtgtgcatcccagggagtggtgcctgctgccctgaacattctcatccagcaggcctctgcaagggcccagtcaagtgtggtgcagagctgggctggcagctggaacagtctcatcttgtctagtggtgagaccaagggctgatgggccaaggctgcgtgctgcttgcccagcccgtggacccatccactgagcacccccatacccctacactgggcccggggtgtcaggaggtggaggggggactgggtgcctggaaaaacaagcccaccgagagcctgagcccccaggggtcagtatcaggcagtcaccacggtgcccggtacacagtggccacctggtctcgtcggctgtcttggtggtggagagcgtgcatggtggccgtacgtgatgggcatcacccagggtaatacagatatgcagactgtgcatttgtctgtaggagccagggacttctcagcctggcaacctgtgacctctgcctacccgttgggagagaggtgctgttccctgatagcctggtgccgggagagcagaactagggtctcctcctcctttctccacctcccatttcttacatgcccaggcatcaggggaggtcacactcagggatgagtcttggccactgggttcagggcctcactgttgccatctcttccctttgccagccagccaaatgcccgtccatcatcgtgccggggatggggctggcctgctcctctgaagtctccttggtgtatagcctaggctggagccccggacgattccgccaccccctcccccgactttttctttttattttgattcatcccagaaacccagccaaaaaccaagttcctgtgctctcccttgacaaagccactgaggaaaaatggtcaaacactgcctttctttccaaagccctcttggtttttcccaaatttggaggctctgagttgcttatgagaccaaagggtccggaactctctggaacacagtcccagaagtgggaggatttgtcatctctccagccaaacagacccaccagttggcccctagacacccccaggcgcctggggcatttctgggctcaggctgtttaatttggtctgcagagccccgaggctccgtttagactgggccagcagacagttctagagacttcaagtttgttgtcgtttttaaaagtcctgccaatgcccagaaacttagagggacaagaagatgacctcgatgtcagccgggaccataaacagtgaggcccgcccccccccccacccatgcctgcctccactgctcccgtagctgggtctccaggggattgcccgtggccatgggggaggccgggaatgcggggctcagactctactgggcttctcgtatttttttgtttttccttgtccatcttctttctcggaaatttctgaatatccccctacagcctttggcattctgtcactcctggcatctctgggccaactgggaaagccatcatttgtccaatatccagaaaatcaaggggcctggccttaaatacattgcagtgccctcctccccacatggcatcgaatttcctgtgtcctcaaagccaggagcctgtgccttggatgtgggcgatggagccttgcagacacctggagcggctttcctgggagagtctccctcgccttcccatccacccgcttcccctcccctgccccaagctctggtcacagcctcggaggggtcatctgagtgtaggttgcctccaggtgtacagttggaggggggcagttaccccacatccccctgtctgctaggggcacccccagggactcaggtcttgagggacagcggaagggtggggtggggagtaggccgttgtctcgtgccacctgggtgttatgtagactctgaatgggcagttcctgggagctggtttttccttctcaccccttctacagtgctgcccctctgaggggctggagctctctggagccctttgcagcctgtggcaggtctttctgattctgtgcctggtttcgcagcctccaacccatagccagtggcatgaagaacattcctggctgtctctacctgtggcctttgcaggcagcagttccctggggcagggcctgggggtcctggcacctccttgtgggaccccttgggtatgagggagggagccacctgggccacagatagacccccttcctgtatccaggaggttcaggatggacctgtctcatctttctttctggtgggaagagagcattcctggccatggggaatgtggcctggacagagccacctagcctctcccctcccccaggcagggccctgaaagatggagatggctctgctcctgccaggtcaacagccagcagtctggtggatttccatgcagtccaggcaggatctccttctgtccccaccccccaccccatgtgcaggaagctggttccaagcagggacccttggccccgctttccacgtgggtgggcagtttccctgcgaggggcaggccaggcccctgccctatgtcccccagagaccgatgttatctacagtaagagcatacaagtctttttggctccaaaccaggcctggaggggtggtcttctcctctgtcctctgcctcttgccccccattaaaggtcagggaatggagtgctctgtatgtttgctggggttgggttttttcctttggtttaaaatgaagggctggaatccctggtgcagactgcacggtgagaggtgctccttgggatccactcgaggagcattactgctgaatgccctgccaggccaggagcatcgctgggggtgggagaggcagttggcttatttgtttatccaacagccatccatgggtaccccaagggccagctctgttctaggcactgggggtctaggcatgggctcaggagaaggggtagaacgggagggcttcctggaggaaggcttcctaaccagagaccggggtaggagtttgccaggcaggtgatgctggccagcttctcttgccattttccttttctttttttctttttctttctttctttttttttgagacagagtttcgctcttgttgcccaggctgcagtgcagtggcgtgatctcggctcactgcatcctccgcctcctgggttcaagcgattctcctgcctcagcctcctgagtagctgagactccaggcacgcaccaccacgcccagctaattttttgtatttttagtagagacaaggtttcatcctgttggccaggctggtctcaaactccttacctcaggtgatccgcccaccttggcttcccaaagtgctgggattacaggtgtgagccactgcgctcggccttctcttgccatttctgcagactcatagtgtgtgtggaagactgtatgtctgtgcctggcacagctgccctcggcactcaggtgggaggtgggggagagggctgttggtgccagcacaggtcatggcatgagacaggctcccgcagccaagcggggtgcaccgcagcattggaggggccctgctgcgcacgagatccaggctctgcatctgtcctcctccccaggaggcctggagggctgggagggaccagggtggtgaaataacccaggtgggagagaggcactgttggagaggcagagggagctgcaggtttgtagcagcgagctttaaaccctgggcctccaccagaaaacctcagaaagggctgctttgcttttttttctaaactacaaaagaaacccttggccgcctgggccccttggggtcgggtgggggaggagatccttcattcgcacctttgcaggcccagtactgtgcagagggaggagggtggaggcaaaggcgagggaggagggtggaagcaaaggcggggtccctccctagccccgctgccctgcctggttgctgctctcagacccctactcctggcccggaaacatggaatcttgggacagctggggtagggggcacagaacggagaccctggtgagggaggaactctttctccagccctggctgtggccacagcaaggccaggctgggaggacctcactcaaatatttacatctctcctaatatttaaatgatgaagcaggctcctgcacacagctgccctggagccagctgttgcctgccctaccctccctctctccctccctctttctttccctccctctttctctccctccctccttctctccctccctccctcttgcattctttgtctctgacccaagtccaggcccttccagctgttctctccttacccacaggcacctcctgtgactgagcttctccttgttatttttcataaccatttcctttaattgagcacctcctaggtgccaggccctgggctggtactttgtatacaaggtgtcttttaatccccacgagagcccaacaaggtagattgggctgctgaggctccagcgctggaaggccggcccgggtcctcccagtccgcacctgcatccatccatcactcccccactgtggagacctgttccctggcccctggctgagcacgatggaaatctctgtctactagtccttggagagtggggatggctgagggtcccgaccctggggtctgacgggggctgcctctgccccacttcagcctggctgctcttccactcaatgactgagtttgcaaaaccagaataacagtgctacctggctggtactttgggtggctgggaggcgtgggagagggtgcacggaggggctgagcgaggtgtcagcatcgtggggatctccgagggtagccttcccaggcccagggcggagtgtaggcagagggcgcgatggcccagcgtgccggctcacatctggccttgcccttgcccacacggcaatgtgggggagtcatcagcctctcagtgcctcagtttcccatctgtgcaatggggacaagagtaaatcactgtcttcaggtatggtaagcactcatacacattgactattgcagaatgaacacagtgagcccttcttaggcttctactacatgccaggcagggtgccaggccctagtggagaggggacaatgatgggcaagctggctcctgccctcaagggctgtcgagcagggaggaaggcggcggctgccctgactgtgacccggagtggggtgattcgcaaagaggctggcgggaggctggctgggggctggctgggggctgctccctctcctgcctgtgttccgtggcagggtattaaactggcttttttcatggatttccgaggccctgactgtgggacctcgggcaggttttgggaccttgtgactttgttcccgcttgtcattcaggcctttgtcctcagcagtgcccagcacacggcgacttctgcatgtccttcagtgtgtgactgaccctggagctgagacttggcagctgaggctggacattgtccttggataactcccggggaggtgggggcagggtggggctgtgagctggcaactccgagtccctagcagcctccgaatggaggctttcctcttgtaggattctcggggaggaaggaggggatgggggagatgaggcttgtgagtcttcaggagggcagaggttcacacctgcagcgccccagaaacactccggggtgcccaggcttacccagccctcctgagccagaaccaccaagagttggggaccagcagtccattttttagcaagatccagaaatgattctcctgaacagtccgagccaagaatgacatatctggaatcagaacatcagaactacagaggaatcgagagaacgggcccaaaatgtgtagggacctcagccacatggcgccacatggaggaaagcacccaacatcatcactgtatgaacctgtttaaacacacacacacacacacacacacacacacacacacacacacacactccccagtaaagagtggaaagacatttgtcagaatattgatggaagttacctgggttgtgggtttatagattttttccctttgtttttgtgcattttgcaaattttcggctttgtgcctaaattccttttacagtcaggaacaaagcaatagatgttattttttaaagttcatgggctcgtgcccgtaatcccaacactctgggaggctgaggcaggaggattccttaagcccaggagtttgagaccagcctgggcaacatagggagacccccacctttttttttttttttttttgacagagtttcactgtgtcccaggctgaagtggcggtggcacgttcttggttcactgcaacctctgcctcccaggttcaggtgattctcatgcctcagcctcctgagtagctggattacagacactcatatttgtaggatttgagaatcctacaagaggaaagcctccattcggaggctgctggggacttggagttgccagctcacatattttttagtagagacagggtttcaccatgttgaccaggctggtctcaaactcctgtcctcaagtgatccatccatctcggcctcccaaggttccaggattacaggcgtgagccactgcgcccggccatgggagaccccctcttaaaacaagaataaaaataaaaataaataaaagtttactgtcaaaaagaaaaacacatcacccaacctaatctccccctaggattgagagatgaggaagcagaggccggaaagtgtcacattccctggtcgctggcagtcaggggacctgaggcctgggctggttttctcgtgctccaggcctggggtgtcaggtggagcccctgctttgcccaaaggtctaggtgcctctgccagcactgcttgcttctgcatttttggccacaaggaatgtgggccaaaggcagggtccttgacctctgcccaggagggtgaagtgggctggtcctccttgtccctgctccaaggcccctgcggctgtgcctttggaaactgctggcccgagctagtgtgcggagctgggacagacctcaccgtggccctcgtggggtcattccatgtccgggctggaagggatctttcggtccagcccttcctgttcctcatcaggaaactgagaccagagaggtcatctgcctggcccggggtggggtgtagatggcgcttgtgactcctgcatgccacgtgcagacagtccctcagctgtgggcttcccacgcaagcagccatgctggggataacttggctgaaacctgcgatttaatgaagagaagaatgactcctcctgcagccctgtgccccacaggctccctcctgcccccacccctcctgcagaggggcctcatgctggtgggtgggtccctgttgctgcaatgggcccaggcagtttctgggcagtggaggcttggctgtcttcctgcccaatgtcccctgtagcccacgctgtccgggaagggcggggaagcactcagccactggggacttcacaagatgggtatctgggagatgctgattggcaggccaggctcccgtggcccacaggcaggtcagaggtcacagtgctgagctgggctgagttggcagctcagggcagtgggggtgggggtaccttgctcagccatgggcctctctggcacaagggtttggagtttactgtaaacaactccttcagtttttccttctctcataggccaccagcagaattgaggggccctctgttgatgaggtgtggcctgggaggggctagttgtctgtccacctgatccttgcggacaggtgaccacaggcttcctgccccagggggctgggggaaagatcggggaggcctctctggcttccccacttggaaggaaaatacgggcataggggagacactttacagggacacatttcagccagtaccctctggctgtgctgggggcacagtgcctgccctgcccacaagaggggtcagttctctccaggatttaacttcagccttcagtgcagggcagatgagcactcagaggcccagaggactcatatcacgagagagaagctgtgaccacacaggcactgaaggttaagcagaagagtgggacacacgggtgacctgaaagtcccagggtcagtgtggttagccccagatagctggggagctttgggtaccaggcttagcaggggaggagggcccccgtgacagtttgctggggctgctgcaacaaagccccacgaactttgggggctgaagatggttctagaggccagaagtccaaaatcaaggtgtcgaccaggctgatcctttggggcctctgcgggaggctccggcccaggcctctctcccagcttctggtggctcccgggtgctcctgggcatgtagatgcgtcacgccactccctgctccgtcttcacatggccttttctctgtgtctctgtgtctcgtaaggatgcttgtcattgcatttagagcccaccctaaatccaggatactctcctcttgagatcctttattgcatctgcaaagaccctattccaactcctgtcacattcacaggtccgagggctagggctctggcatgtcttttgggggtcactattcagtccactgcggcagctgatcttaggggaagcagaatgttctaagcttggggtgagcggagggaacgctgctgggtggggagtgggagaccaggctcggagacaccgcggatctcctctgtctgatgagggcgtgatgaggttctcatctcaggtcctctgaatggcggctgcttctgaggagaccctttcccctggatctgcccctccagaaacctccacttaggtccaggtcccaaggtggatggtaagaggcggctgtccctgccacacttgatgggtgagtgtgtgaacggggctgggagcaggacacttgtcacttctgtggacagattccagaggctcatgaatctgctgctggggaaggtgcctgatctagcctgaccctccacccccacctcccccttcccgccccccttcaccagccctgttcccagagcttcacttccccaaaggcaggcgccgtttcctggacttctcagcagctaccccctaccccagacccctctcttgtaggcccctctggtctcagcgcctactcctccctgggcttctgcccctctaccgtgaggcttctgggcagaagtgtggggccccctcgctgtgtctggctctcgcggtataccaggggtcctcccaggggcccgccctgcccgctaggtttccagggagcttttcaagttcttagatgggcttgatggagtttcccaatgcgttgtctcagagcaggaggggccccggctgagtccgagagtcccctcagtcacaccctgggctgtttggggcagccaggcagcccgtcttctggaggtgctgcctctctctggttaccccttctggaatcttctgcgtccagttgcggcccctcctacacagcacacccaccacccccttttacctgtgactcttctttgtcaacctcttcatgtctttgagaatggagaccaggtcctcctcaccctggagttcagcagaacctaaaccaggcagatccgtgtaggttcacgtgggggctctgtggccactgtggctctgccgtcacctccagcccagcttggcgcgctttggatcatgtcattcagtgccggtcctccaaacctctcccctggctctgcaggtctgggaagcagctggctcctgggtgcagctgtgaccggagcctgaactctgctccctggggtcaccgtcccctgtaattaggctgcagctcatattggctcgggcagaggccatcggctgcccgccttggggccacaacacagagagccccgtgattaatggaggctccacctgggccaagtggcccctggtgttaggcgcttttttttttttttttttttttttgcattttttaagtgcttgtaacatttcccctaatggacaatgagacgaggagggagggaggggtggcttctctgcccaggcagatcaggaatggtcaccgcctgtgtgtgcagtgacaggtctgggaacagacaagggagagcttgtccgggaggctggaccctcacaccgatgctgcctgtgcctggcagctctgtcccgggcctcagaacagacactgaccaacacgctcctcagggtctccaggtccgggtcctggtccccggcagagcttcccatccatgggaagaagcaccgagcagccttgctggctcctcgcagggagctgggatgcatttctaagagcagcatgcgtgaagcccggggtctgggcaaaggagtgtttggggaagagtctgctgttgttggagggtcggaagtagaggggaaggaggggcacgcggtaggctgaggaggtggctggcgaccctgtggtggggacgagggggctatgagcagaccaggagccagcatcacgtttctctgtctccagaatcgaggacggagagctgccagagaggccctggcggggtgtctggggccacctaaagggcgtgggtggattaaagctgaggaaagcctcattttgggggactccgtacttaacctttgaggccctcagagctgcagcctgtggtttttcgaagtcaatcacctcccagggcctcgctcctgccttcagcgacagccatttatcagggagtctttgacccaaggagacctgaaaggtcatctggtccctctcctacccccaggcaggccacacctagaccctcccacacagatccgtcccacccttctgctgccttccaccagggacggagggtgggcggccctcccacccaggccctggcggccccaccccagccaggaaattcttcctctttatctgcctcacatctcttcccctgcggcttccgcccatttcccctcaatctgctcctagtggagcagccagcagctggtttagaacccgggggtggggggagcgctagaccagtgcagcacatctgagagtgtgccagaggtgctcccattcccatagctgatttagtaaagaaaagaggaagtccagcaacttagcgccactttaaagtccgcctggaatgaccctgtggctgccggaaccaggggcacgcggtagatgacgggagcaggcacagagaggccttcgtcccggatcagtcgctgttgccctcttggaggctgggctgcctttcaagaagaggacccaaggccctgtgagcggtggcctcctctggagcctttactgtggtcctggttctgctctgcgtaaagagagatggcttgaagcagaagctgctacgtggctgtcccaggcaggcgcccgtagtcccagctactcgggaggcggaggcaggagaatggcatgaacccgggaggcggagcttgcagtgagcagagatggcaccactgcaccgcagcctgggcgacagagcaagactccgtcttaaaaaaaaaaaaaaaaaaaaggagtagagaaatctttcccagaaggcctgcagtcacctccccttcatgtttcagaggtaaaaaaaaaaaaaactgcacatttcgctttttttttttttttttgagacggagtctcgctctgtcgcccaggctggagtgcagtggcgcgatctcggctcgctgcaagctccgcctcccgggttcacgccattctcctgcctcagcctcccgagtagctgggactacaggcgcccgccaccacgcccggctaattttttgtgtttttagtagagacggggtttcactgtgttagccaggatggtctcgatctcctgacctcgtgatctgcccgcctctgcctcccaaagtgctgggattacaggcgtgagccgccgcgcccggccacacgtttctgttcttgaacaggtggctccctgaccctgggtgtggttactccaagaccttgctctggtggggcacaattctggccccaggtagggcgaccgtataacttactgtcccttgggggacacgttagtgaaagggacccttgaatgactacggtgggacaacagatgtgagctgggtttgtcccaggaaggctggatgtatgggcctcttgagccagaggagacaacagcagaaagctctgcggctgatgggaccgagcaggagaagggccggcggaggctggggcaacaacgcacttgcccactgtgaagggcctgtgtgagctgatggctgatgagagggcagtggggcgaggctgcctcctgccaggctagaccagctccaggacacccatatctccttttcagaaccggtgactcagtggctagaaggggcttcagaattgacgggacactgagggagtcgaatggaatggctggagtggccacagcaggctctaggcctcctcccgtttcttttctgtgttctgttcctggggtctatatcctggggttgctgtaacagagtgccacaacctgggggcttacaaacatagcttccggcggctcctggagattcctggcgttccttggcctgcagacgcatcaccatcatctctgatctctggcccctgtctccacgtggctttctccccctgtctgtgtgtctttctccttttctgtcttttataaagatgctcaccattggatttagggcccactaaattcagaatgatctcaccttgagacccttaccttaattacatctgcaaagatccgttttccaaatgtgatcatgttcgcaggttccaggagttaggacttaagacatatcgttttgggggacactgttgaacccactacatttaataaacccagagttggtgccaatgtcccctgcggacaccatagcagattctggaggttccttgtaaaggaatccgtaggacttcttttcccttctggagggatgagactgtagctgggctggggaaagctgctggttcaagctggggctggttcagctggtgctggcttgccaggttgttagagagctttatccagggagaaattaacatcacaaagttgggggataagagaaggtttggaatcccaagggctggctgttgaggtcagctgcccacccctttgtgttccatcttacagggacccaggcctgccagtgctccgtttctggaaggaatgctgtgggctgctgtgccccataggcagggtggagggtccccttgcagccagcgagctgctcttcctgtagcgtgcagagggaaggaggaggcttgtttatttctcttggcctcagccgaaaatccaaccacaggctctggcactaggcagacctgctcattctcacatcatcattgcagagtgagccaggcctcttgggtggggctgtgatgagcaggaaggacctccggagtgcctgggacttcttgggcccagggttgccagaggcagagagaaagaagcctcctcctaacacttgagcaaagatagtcatcagaatccatcagagtggcctcctgtggctcttccctgggtgctgacccccctggtgcatttgaagttttcagggatactattgacgctccctgcacctccatccaggggttagtggaaatggttcttttcctccttgtccagaggtactgtggatgatgaccccaggtcccagacctcagtcattgggccacgtgtgcagataagcctgggcagtcagtaacctttggccaccaagctggcctcctgcggactgggccggcactggaggcgggtcttagctgctagcactgtggcccagccaggcctggccttgggaaggcagagggggaggggactgggaaagggattgagctgggggtggggtggtaccctggttcttccctcccagacctttggcaggtttgaactatctggctgcggctctctaaggagggagcgcctcctccgccttgatgtggactttgccttctgttcacgttgtccctgtccctaaacaaatgtggctctctgtggggagcctgggggccgccctccactgacactgctgtttcctggcttccctttgcaggctccgctcagcttcactgcgcctatttttaagcctttccttttggacggttttgcttcctgagaacacacccctccccatcaccccaactgtgtcctcctccctatccggagcctgctccacctgccccaggagccacctccctcctccaccaagcagcccaggccaattctggagggctaatttgtgtccctccagaagcaggtcctgagacagggatttcagtgggaggggacaccaggggatgcctgagtgtgggaatgggccaggcagggaatccagccaataaagggtgcctcaccagctcattgtgaccacaggtggctgcccagcccccataccgggcagcatggggagactgcagaccgtgcccccagccttgtcccacctggggttgggtaagggagctggggtttttatacttcagttcttggccaaggactgcactgctcactccttccagccttccgagggcttgggcactaggaaaggctctgggtggagacacggaaataggccatgtgaagtcagtgggcgtgattggtagcagtaaggccaggacagccttggtcaccagcaaggtgaccacacatttcagcatgcacagcccccacagacacacacccaggagatggtaattacaccagcaacagtcacccctgccgcgtgccatgcctgcacccagggaatcttattttttatttatttatttatttttatttgagatggagttgcgctcttgttgcccaggatagagtgcaatggcacaatctcggctcaccacaacctccgcctcctgggttcaagctattctgcctcagcctcccgagtagctgggattacaggcatgcaccaccacgcctgactatttttgtatttttagtagagatggggtttctccattttggtcaggctggtctcgaactcctgacctcaggtgatccacccacctcagcctcccaaagtgttaggattacaggcatgagccaccgcgcctggcctcaggggcaccttattaccccatcacctcctacagcaggtgacactgaggacactgaggctcagagtagactgtggttatgtcactctcctgtttggttctcctgctctcagccctgaaataaagagcacggtccctgtgcaggcccatacgtcctgtctccagccctggagcagtccttaagctccttgaaggcacaccaggcctttgggcctcgtcccccaagtcctggataaataggaggtgaaggagcctttgcaactggaccccactctgccagcgccaaggccctgcctgactacccaccccaccctacacagatcagggacctgtgccaaggtccagtgtcacaggagagtgaagacaaggaggtgcccatggcgtacatgctgctggactcactctgtagatcctaagggttatggggagttatctgccaggtgaggttttcccgtggctttttcctgcaggctcagggtagcatacagggaggtgcttccctactccttggcaccatctgtccggcttccctgagccctgaccctggctcctagatagccagtgtttcttcagggacagaacctgctttgctgctgctcagaggagacccagtttgaccagggctagcgttcctggaacctgagcctggaattccaccctgccctgggcagaggccacgttgctccctcctacgagagctgagctgcgcatgagattattctgaccttgggctctaccatttctttgcatgacatttgtcccaggctggagcagggctctgtggctcgcttggtgttccctccccagactgaggcctgatatgtacaccaggaagtgcttgatctggtttcaggagctgggagcggtttgccaggcagcctgtggtcagagcaggggccttaacaatggtcccttgtgcggcacattcctctctaaataggcccaggtccaggctgctcctgtttcgaccccgccatgggcctggaggggaaagtttgcatctggagggtggcccactgtggcctctttttgtgtagcagctgagaccgtaggtgcttgagaataggagaagccctgtgcccatcctgggctgtgagatgtttttccagaggtggggatggggatgggccagcatgcagttacccacaccctccagcttgttggcatcaaggtctgtgtatgtgtgtgtttttttttttttaattttgtttttccaacatggagtcttgccatttgcccaggctggtctcggactcctggctcaagcgatcctctagcctcaggttcccaaagtgctgggattataggtgtgagccaccatgcccagccagtaccaaggtgtgttttttaagagcaatattggccgggtgcagtggctcacgcctgtaatcgcagcactttgggaggccgaggcaggcggatcatgaggtcagcagattgagaccatcctggctaacacggtgaaatcgtgtctctactaaaaatacaaaaaaattagccagacgtggtggccgggcacctgtagtcccagctactcgggaggctgaggcaggagaatggcgtgaacctgggaggtggagcttgcggtgagccgagattgcgccactgcactccagtctgggcgacagagcgagactgtctcaaaaaaaaaaaaaaaaaagaacaatatcgatggttttattccctgaacatgctaagtgatccccatgtagtataagcatctcagaaggcaggaaaatgtaatgaacaacacccaccgccattcattccatccagagatcgttattttctgcccgggtgtgagtgtgtgtgtgcgtgcaaactgcacatgtgtgtatgaaatggaattaggatctttgtatacatcttgtgtcctgctatttttacttaatattctcggcatttctcatcttcaaaaatgtgattttaatgatggtgcaggcctttgacatatgggtttagaaaatctgcggaaacccggactgtttccaggttttgtcagtttaatgctgatgcaaatgtcctcgtacgtaaatctttctgtacttctgattatttccttgggataaattcccagaagtgggccaaagcacatgaacggtcttcaggcttttggagcaagttgagatcggtggggattggagaagggacccagggaggcttttgggagcttgcgagattggagtctggctttaggggacttgaattcacagatgaaggagatggctggcaaaggtgggaacctcctgctctatgggtgggggggtgacactgctttaccttccagtgacagcatggggatcctcccaacatgacctggctccgcatctttctgacactgtgcacggtccacagttgtgatgctcagctgggagcctcttctgtgtccttcagttgcattaactccttgcagacagaggaggaagctgtccggtgctcctccctgctgcgtgggtcctttgaatctgcccagttgggcctgtggatctgtgcagtcacgtacggggttctaaaatctgcaaaatgacaagctcacgaacactctcgcttctgtgggtgaatgtggataccccttggctgcgtctccctccacagggaagatggagacgtgtaaagtgacaaggacctgctacccctgggcaggttatgccggttccactgtgaggatggtggcagggggcttcccaggaggcctgcacattgggaagagaggggcgaccgtgtgtgactgcaggacccagggcgcagtcttaggactctgatgggggaggagatgctggggagccctgttctgccagcctggtgacagacatctcctaatgtttcccggctgggtacaactcacaatgtcctccgtggggaggcaattgcccatgaggcatccctggcagggatgatcttgtttcattgccacatatcccagcaatgaaacaagaatctagagtgatgtgattcctccgatgacttctccaaccatctggggtttttgtgcgactccaagaagggggaaggaggcagctctcgctcctctgggctcctgatgtggcagctctggaatggccacgtgtccgttggcccacagtgggccatttgtcgaatgtggttgtggtgggattggggctgggctggagagtgggtgaccacaccagctagcctcaccctgggccactgtgcagccaggggtttcatcttcccaggggtctcgttgtgagtgtcctggggctgctggaacaaattactggaaaccaagtggcccaacaaagattgattcgctcatggttctggaggccacaagtttgacatcaaggtattggcaggaccacactccctccgacagctcgaggggaggacccttccttgcctcctccagcttgcgttggcccaggcgctccttggctctggcagcatctgcagtctctgctctcatcacgtagccctccccaccgtgtctctttgtgtcccaagtccccttctgcctttctcctataaggacaccgagcactggatttagagcccatcccaaatccaggatagtctcatcccgggatccctaatcacatctgcaaagaccctttttccaaataaggtcacattcgtgggttcttggggttaggtattagacatgtctttttgggggtcactagtcaaccctctacagaacctcagacgaaagtgaatcttcacaggctgaaatgggggtgaaggtctagtgcgtccctcctccttgggagctccctcagggcttgtgcctatcctgtgatcctgtgatccagccttttttttgagatgaagtcttgctttgtcgcccaggctggagtactgtggcacgatctgggctcactgcaacctctgcctcccgaatttaagtgattcttctgcctcagccttccaagtagctgggattacaggcgcccacccccatgcctagctaattttttgtgtttttagtagagacagggttttaccatgttggccaggctggtttcgaactcctgacctcaggtgatccgcctgccttgggcctgccttggcctcccaaagtgctgggattacaggcatgagccaccacgcctggcatttagtaggttttggttgttttttttttttgagacagagtctcactctgtcatccaggctggagtgtagtggtgtgatcatggctcactgcagccttgatctcctggcctcaagtgatcctctcacctcagcctctcgagtagctgggattacaggcatatgccaccacccctggccaatttttgtattgtttagtggagtcggggctttgccatgttgcccaggtttgtcttgaactcctgggctcaagcgatctgtccaccttggcttcccaaagtgttggggttacaggcgtgagccaccacgcctggcttagtaggttttctagaagcgcctgaggcctggtgaaggcatggtgtcatggagtagagaacattcaactctgttcccggggagccggaacacacccctcgtagccaatctcaacagtcatgacgtggccaggatgacatggggagggggtggtgtggactgtgtgggaggccagctccccgggaagggggctggagtgggcttggctttgaggaggattcccaagaggaggaggaggcggtggcatgctcgtttggggggatggcgtgagccagggtgggcacctcttcatttaggtgtcaccttcttgacattccagccgggacatggtttccttggggaagatggacacccccagagtggggcatctcctggggaagatggacacctccggaatggggcgcctcctgttctcactgttcttctagcacacagttgtattctcttgcagttctggaggctgtgagatctcctggctgttatctagaacaaactcgcctttgagcagcgccgtcctgatggtggggtggcccctgcgggtggaacagcccctgctgtctcagagcttactgagagctagtgggcatgggagtggtgctggaccgaaacacccagagggatcatagagccaggcagtaagcacagaggccagctagtggggagggagggacccatccatgaaaagacaccaagcattgaaagagaggagaggatggttggggaccggcacacatgtgcattttgcgcagatggccaaggtggtgaggcgccagccacgcagacaactggaggaaggaggagtgccctaggggaggggccagctccggttctagaatgatccgcttgtgcacgtgggcctggctggaataaatcattgcatccgcaccgtagactcaatcgtaagctcacaccagggcagcctctgctttggtgcagtgtcttcgatcatgagttggccatggtgggggtgactccaaggggactcccaaggagggggttcaccggatctcccagggaaggtcatttgttttcttgggttggacctgggacaaggccttctcctgtctagtttctgttctccaacttgaccgcacggaaggatgctgaggacacctggaagccggcccctgctctacagcacccataggacagaggcacaccatgtggggacagtttggacagtgctcaggaggcagggagcagatcagaggaccgcgggaggccctgggaaccgcacgaggacccaggcattgagctctgcactttctggcatcagcccgatgtacagtctggctctgtgtctaccccgtacttcactttccccatctgtacgggggcggtaataatattctttacagcccaggtttaagcgggtgtagatgtgatgagcttggtaagcccatctcattacattcagttctgggcattgaaccctggactttctggctggtagaagtggacattcaacctttccttggggccctggggcttctgcagaatcagaacacagccagcagtttgcatgcagggtgcagagggacagagggacaccatgtcgggagcccacacctggcacacccctgactctggggctcagtgtcctgctgccctgcggccacgtgatcagctagaggtcatggctggacccataggcgaatacagcctgtggatttgattttgtttggccctgcggtgttttattttatttttagttttagtttgtggagacagagtctcgctctgtcagtcaggctgagtgcagtgacacgatctcagctctgcaacctctgcctcccgggttcaagcgattctcctgcctcagcctcctgagtagctgggactataggcgagtgtcaccatgcccagctaattttttatttttagtaaagatggggtttcaccacatcagccaggctgctcagtgttttaaaaagggcttgttttgctttgtgccagcatttaaagatcaggagatatcatataaagatccagatttctactctcttgagaagtgaacagctctggccacgccgggcccatatcctctagggcagtgacggagctgagacagggcctgtgacaactgagagttctctggagtccacacggctccttgcccagcttctggtggaggttgagcttagtgacccaggatttcgtctgtgtccaccaagaaggagaggtgcctgtggcttagagagggcgcccacaggagtgccttgcccaggaagctggcagctgaggcggccagggttagggggttgggcttcctcttcccctccccagtgcctgagtgcatttggaggaagagagacgggtgaggggaaggcactgaaattggtcctggagcgctattattgggggctggggaccagctgtcatcccttttcctgtgggcaggggaggcagtggtgggatcccatgagacccggactctgtggcctggtgaggcagggagcggctggggagacactgtgggtctccacaggggtgcgctgtgggtctggcctggggaaggagctggtgaatgtgcctgccatgtgggtccctccctgctctggccctgataaccaggagcggctggctctcatttggagtgcggttgtggggactgtggaggtggcagcttcccaggtaccatccccactgcctccgagggagcagaccctggtggagaggcaggatggctgcagggcgggagctggtggttggcatcactgcacgggcttgtagtagtggatgggaagatgcaggagaggctgatgactgagaaagttggttcctgtggactaagctgggggagccggacaaccaagtggttagaaccttgggctctggtatcagcctgatgtacagtctggctctgtgtctaccccgtgccccactttccccatctgtactgggggtactggtattctttacatcccagggttaagcggctgcagatgtgatgagctcggtaggcccggcgcctcgccggcactgaaagctccagtgtccgcccttagtgtcattgatggggttttgttcctgctgcggttctgattggttacagttgcggtcacttattattggaggcatgtcccccgctgtggctgatggtagaggtgtgtttgctggtggtgtcccagtgtgtgccttggctggaggtgaggagggataaaaacagccgcgacaagaaggaaatcaaggccgggcacggtggcgcacgcctgtaatcccagcactttgggaggccgaggcgggtggatcgcttgaggtcaggagtccgagaccagactgaccaacatggtgaaaccccatctctactaaaaatacaaaaattagccaggcatggtggcccgtgcctataatcccagctactggggaggctgaggtaggagaatcgcttgaacccgggaggtgccgctgcactccagccagggcaacagagcaagactccatctcaaaaaaaaaaagaaggaaataaaagtcttctctggaactagaacgttcctatgtagacgtagctggagggggaggctgtgtggtttgcgccgtggccatggcaagacacgacgggcagcatcttcccactccagcctgcatctctgccccagaactcatgatggttctcctaggatggggctgtcccttccgcttgctgagacatgaaggacgggaagagacccccggccctcaccgccgcatcgcctgccttcctctgctgctccttagcaggaaacatgccggagtgttccctagccatccattcaccaattgcatcccctctctttatttttcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggagggtgagtcgcagagcgctaggtcttggatgctgtggtaatggggggcctggttgctggctttgccacagaatcttggaggaagaagctggatatggggtggagggtgctaccctggagacccagaaagaccggaatgcatgggggtgggggtctgcaagctcaggagaggtggctctctctgtctgatgggaacatgccaagatgccccaagcgggacttgaatgagagtttggaaagattttctgggtttcaaggagcctcctttatgggtcaccgtgggccttgctgggacctctgtctgctgtgtgtccctggagggcctgggaggcttagagaatgaggagccacgcaggaaccagggcaggctcatgcaggggtgtaggacagggtggagttgagacccctagaagggctgtcacattctggtggctcctgcttgaggaattgcaggctgcctggatatgcccagcagaggccgagggcttggggaagggaggagggacgtatgcctcctgaggcttgcattggagcccatggtctggtcctcctcccccaggagggatggttgtggcagagggaggggaacatgaggagcaccttagcctgcaggacaaaattctcagggcactgggaaggggtgcctggaccagggggctgtgtgatagctgcacacggttttatttgggggtgcccttctggcgagaggagagaggccatggggctccagcagcgtcctgggagggctcaagcccacagccgtgctgacatggagcttacaggcaggggattggtgccagtcctgtgggacacagggcctgtttggaaatgccaggctgtgggacatggttgggtcccttctcagaagcgtgccccctggccccagcagggatcgtggctccatggggctatagtaaggtgccagctgggttagaagcccctcaagagccaggtctgattctgggcacaggatcagaactcagtaatgctcagtaagccttctttaggttggacaaacagcacagtctgggtttttgatttagctgctgcttcttatttctaaccgtggtgaaatacacaacatacaatgtgcaattttagccactttgcagtgtacgtttcagcggcattcagtacattcacggtgttgcgcagctgccaccgctgtccatctccggtacccttttcatcctcccaaactgagctccgtccccgttagaccaagctccccatgcccctcccccagctgctggcagccaccattctattttctgtctttattatgaatttatttgaccactctaggaaccttgtgtgtgtggaaaaatacaataactgcccattttgtgtctggctcatttcactcagcatgacgtcctaaaggttcatccgtcgtgctgtagcatggggcagaatttccttcctttcagaggctgaataatattctgttgtgcgatgcacttgtgttgtgtagctgttcctccatcggtggacccttgggttgcttccacatctctctaagtccctctttccatcttctttgacttttctttgacttttttgagacagggtcttgctctgtcctccaggctggcgtgcagtggtgtgatcactgcttactgcaacctctgccccctgggctcaagtgattccccagcctcagcctcccaagtacctaggaccacaggttgcgcgccaccatgcctggctaatttttaaattttttttgtagagacaggttctcactaggttgcccaggctggtctcaaactcctgggttcaaatgagcctcctgcctcggcctcccaaagtgttgggattataggcatgagccacccaacccctttttggtttttctttttgaatgagagttctccagtggtcagtgggcttgggggctgggaggatgtggggcctggagagggtgtgggtttggggggagaccagtgctcctcatgctttcatgggcatgtggagtgcacatttgtcttggcgggtctggggcctgggactctgcatttcctacagagggggcatcggaacacactgagtagccagaggctagtgggccttggaaggtcctttccggccctcagtgtgcgagtcccgtgttccctctcccatctctctaagcttgactctgaagagccaccctgccccagccacccagactcagtgacagtggttgctggtggcatggtgtcaggccaaaggcatgggcagtttgcagagtggcaggaggctgtttcctcccctgccttctgttggtgcaggacctttgtttgacgtgccggatacacccccatcctgggttgatgtgttcacactcagctgagtcaaacaggatgtggctggggaggcggttgtcaccgagccatctaaatctcggtgatggctggtgctggatgcacagggacgtggtcctggctctgggggacaggtagggggatgtccatggggatgtacaagaacattctcctccaggggcagacacagtttagcccctaaattgtgccagagactgtgccgggagccaggcccagggacacaacctgcgggctctgctttctggagctcaccgagccgtgagcaggatggctgggacacaaggagtgtccagggagcttccccagcagtggaagtacaatttcatcaggccaggaaggggagagaaaggcaggccacgtggaggcagcagcgttcagagctgccaggaacctggcgctctggggggacggtggctttctccatggaataggatgtacacgttggagccggggcatgggagaaaaccatcagcatcccagacccggccacccacggacagggacctgtgcaggtgggagtccagctcacgtggagaggtccgtgggctgggctgacagtcctgagggcctaagcaagtccaggtggaggaaatgcagggacagacgagggcagggccttcccaatggaggagtgctcttgaaatccgatgggagtggcttctcggggggcccaggcctgagccccactagttcttcctccgaggcaccacctgcttgcttctccgtcctccctctctgtgtcacgaccgttctggacacggatccagttctctccaactcagcttcctgcccatctttccttcaggcccatccccttctgcccctccatgtggggctgggctgggagttccctgagccccgacatgcacagctctgaccaatctctgcggcccctctgtcccccgagcaccagggatccagctggcaccatggggaaaggaatcatggagggagttccgtgccctctgagcagacgcccagccccttggcttctgcctgcgggagggcatctgtgctgtggtttgtctccaccccagagctgtgggtgcagggcagggtctcctggggccccagctgaattgctcccagactgacttccccaaagcacagcactgctgagatctcttcccgtgctgagccttctctgctcactcaccataggcccctccacggttgattcactctcctgctcagctcacacctctctccttcccagcttctcctgctttggtcttcccttggtctctcacacctttcctcacaacccctttgccctgacctcctgaaccctgacctctgcttctctttacatcactgccttggtgaactcctatgcatccctcaaaacctggtccaaatacctcgtgtttggcttgggatataaatgatttgtgtataaactttctttcctctgctagacttttttttttaaatgtgaaagtagtttttcagatcataaaaagtaatcgagtaccctttctttaaaatgcaggaagtacagaaatgagaaagaacctaaaattcacctgtaagccagcgatatccatgcttgaggttttgctgtatagtcttcaaaattcctttcatgcccccactagattctgagggtagggctgttgtctttgtttttttttgtgttttttttttgttttttgttttttgagatggagtctctctctatcacccaggctggagtgcagtggcatgatctcagcttactgcaacctctgcctcccaggttcaagcgattcttctgcctcagcctcccgagtagctgggactataggcgtgggctaccacgcctggctaacttttgtatttttagtagagacggggtttcaccatataggccaggctggtctcgaactcctgacctcgtgacccacccacctcagcttccctgacctcccaaagtgctgggatcatgccaccgtgcccagcctgtcttggtttttataaagaatcccataaggggccaggtgcagtggctcatgcctgtaaatccagcactttggaggccgaagcaggcagattgcttgagcccaggagtttgggactagcctgggcaacatagagaaaccctatctttacaaaaaatacaaaaaattagccaggcatgatagcatgcgcttgtagtcccagctactggggaggttgaggtgggaggaccacctaagcatgggaggttgaggctgcggtgagctgagattgtgccactgcactccagcctaggagacagagtgagaccctgtctcaaaaaaaaaaaaaaaaaaaaaaaaaatcccataagataccaagtaagtgacttggacataataggtgtgccatgaaattatgctgaaggagtgagccactggtggtgagttgggatggcttttttgtggttcttgtaggcagatgtagtgacccccatgggtcgtccctagagaccaagcagaaactttcctggtcaactttacccccaggacacctggtctctcctctggaggttgtgctggagggctcagtgggtgggtgttggcttcagtgtgggggttctggaaggagtcagcatttcaggagggagtgtgggcacctagatggttgaaggggagggagaggaagagaggcgctgcagagggcagaggcatccctgcctgctcctccgccccagggcctggtgaggtctgagctttatgctggtggggtggattctcggtttccgaggctctggccctgcccctggacttggcaccctccttgctgtcctcccacagaagggcgctcatcctttggggtcatccctggtcctctcaggctctgggtggggacggccttgcctcctctcctggatccctgctcttttcctgccccccaacatgggtgcctctgggtggagtggggtggggctgggctgcagcacccagtactgagcctgcaagggctggctgctggctcagagccccccccaccagagttacccccctccggctcctcagccacaccagccaagtttctccagagctgccttataaggcgggtgctcagcgctcgttcatgggtctggttctctgccttcttgggatgctcactgggggcaagagggaggccaggcccagtgcccagctcagttctgggcatgtcccagctctgccccatgagtcaactggttctgaactatcattccacccctcccagcctcaatttcttgatctgtcaaagaggcatctgcagaggtggctgggggctgagctctcatgtatccacccaccccaagaaccaagaagggagtccacagtggttctggggccacttgtgaacatggatgtgaaattggggcggggtagacatggcagcatgtctcagtagttttcctgtgacccagagggtctggaaatctttgtcatgtgggtggagcgttgagggagcagggggtcaggcccccccgagctgatgatggtgggcgtggctcttcgcatacttggtccgcaccgggccgtgtgttccaggggcagaacagggaggaatctcagcacagacagcagggctgccagtacagcgttgagtatagggttaatcaaagcacagggctccctggaaccacccaacacagagcagtgaagaggtggctttggggaaagtggggtcagagctgagcctgagtggggggtggggagggcgggcatcagcctgcaagggagggacacctactgggccccagaagttcctggtggggatcagggactgtgaagttggggagagggtgaccactgtgatttagggaggaagggccccatagacagcccagcttctggccccgtgtttacaggacaccccacataggctctgagcctatccctggactgtggactccctgaggcagggtgtgcaggttcgtccagtaccaggtgtaaggcagggggccttggtaagcgtcgagggactcactggtgtctgatgaagcagtgagtttggatcgtgtcatgcctcgggtcctgagcctgcaggatttttctgtggggctgtgtgcttctgcttctggaggtgtccagaaggcactgacgttcctgccgggatgccttactcggaaggtcccgctgctcccacctcctcccattttcctgagctgcttgcagagggcacccaggtccccttttactttgggattgggtctctttctctttccccttctaagaacaagtaccctccttctccgaactgtccctggagcctctcagacctaggtctagagtgggaagtcccgcatgtgctgggggaacaggaatcaatgcgggaggattggccaggcccggtgtgtctccttcgtggtgggacggggtggggccagagaacagagcctggctccagagcccaggaagagaacccctcccctcgccggcctgccaagcaccgtgcagtggtgagaggaaaggagggctggtccgggaatgcagcgggtgccgagcagctgtggaataccttaaatagagcgcagctgcggggaagggtggggccaggaggcaggcgctgggggcggtttctctgctccgccccctgcagctctgtggccctgaccacccagcctggccccaggatggagccccggcccccagacacatggcactgggtgaggccgcctctcagcacttgtcccaggaagtcagagcagctgccagaagagagaggagctgtgtctgtacccgccgcctcccaggcccgggacagctgccgggattgagggtctgcacaatggcgagcctgtccggaggggcgcgccgcggccagacagccatgctctgtgcggtgtggacagagggcacattcagccctggaggagcgcactcagactccccgcctcggggcccaaagtgtgggcagcccctaaccagaccctggattccagcagacagcctgggaggatgccatgtggtccaccctgacacactgtctcacctgtgacctcatttctgagagctgcagggaggcgcttcctcagttggactccacttcctctccggggttttctgtgggtgttataagtgactctgtctccttcagtccaaggggggctcctggggtatgggctgtaactgacaggctagagtagcccatggccagggctgagcttccttcccgttctctctgaacactgggcccaggaaggggttaaagtggagatgctctgattaaagttgagggaggcatggagctcccctgaccctgtccccccatcccactgctgctactgggtgtactctgtggagccccaggactcttaaagaacccagagtggagattcccggtctcatccagtgcaggtgagggggaaagtgatttgtccacagttacatggctaccatcagcacacctgggtcaagctcgattccactccacggcccctgtctgaaacctggaactggaaatggccctggaaatcactgattccatctgccgccttccaaaatggcccgcagaggttaagatatagactcctgtaatgccttgcccactcgtgtgtggggaaatggcagaggagcaccggctttgccctcacactgcctgggctgccgcccctgccctgcctagtggctttcctctctggtccgttttctcattgtggaagtgggcacaattcttcctgtgcagcgtggttagagtggacagtgatgattcgtgaagcagggtggagcgcctgggggattcgtgttaaacaagcacataaacaaaagccaacacaacccttacttaatcagcaagcaggccttgtctgaagcccctgggcagcacctcatgccatccctaggttccaggccggtggtgtcgccccgtgtctctctcacccgcaagctggtgtttagaagccctgctctgtgttctggctcccattctccctgtgacctttccctttcttcatcctaaaaagcaatgcacgacggggcgtggtggcgggcacctgtagtcccagctgcttgggaggctgaggcaggagaatcacttgaacccaggaggcggaggttgcagtgagctgagattgtgccagtgcagtccagcctgggcaacagaacaagactcccatctgggaaaaaaaaaaaaaagcgatgcccagtcattcttagatagaaaatgaagatcacatgaaatttggaaagaagtttttctctcccattccccaactctctcccaaggggtggccatgttgacagctgggtgtggcattctcctgaattttattcctgcagagtcattcagggcttgtgtaaaaaaagtcaatgtgtaaatatagacttttcaagaacacaaaggaaatcagacttctgctaccagcttttattttttccatttaacaacactgttgccacttgtagatgtagcacgttcctttttctttttctttttttttttttttgacagagcgtggcccaggctggagtgcagtggtgcgatctcagctcactgtggctcactgtaacctccacctttcgccttccgctttcaagcgattctcctgcctcagcctcccaagtagctgaaatcacaggtgcttgccaccacacctggctaatttttgtatttttagtagagacggggtttcaccatgttggccaggctgctcttgaactcctgaccttgagatccgcccacctcggcctcccaaagtagcacgttccttttaatggttgtgtcatcagctgtcccatggccctgccaggcttgtccagcttcccactgtgattgagaggctgcaacagatgttctcgcacttgtacatgtgcacacatgactgaaggatgagctcttagtgaatttctgtgtcaaggatgtgtgcatttaagttttgatctgctgggcacagtggctcacacctgtaatcccagcactttgggaggccaaggcgggctgatcacttgaggtcaggagttcaagaccagcctggccaacatggtgaaaccccatctctactaaaaatacaaaaattagctgggcatggtggcttgtgcctgtagtcccagttactcaggaggctaaggcaggagacttgcttgaacccagcaggcagaggttgcagtgagccaagatcgtgccattgcactccagcctgggtgacagagcgagactccctatcaaaaaaaaaaaaaaaaaaaaaaaattgatccttgttcctgaattggcctctaaagtggttactagaattttttaggacccctcccctcgtcgacctgctcagctgtctgctgggccctgtgcagtgatggtccagcagggaggtcctatgccccttacccctggctgagggccaaatgctctccaattggtgttttattttgtgcatctcggtcaagcgagagggattatctcttcgtatgttataggccagggccctgtgttctcttttcatttggaaggtgtatccttttcttgttgaaattttttaaaaagagttctttgtaagccaggcgtgatggctaacacctataatcccagcactttgggaggctgaagtgggcggattgcttgagcttaggagttcgagaccagcctaggcaacatggcaaaaccgcatctctgcaaaaattagctgggtgaggtggtgcgcctgtagtcccggctactcgggaggctgatgtgggaggatcatttgagtctgggagtttgaggctgctgtgagctgtggtcataccactgcactccagcctgggtgacagagtgagatcctgtctaaaaaaaaaaaagagttatttgtacatctttatcacagcaggtacgagtatcttgtccccagctgcctacttttgattttgtttctgggatgttcttctacacagaacattttaatcctgatattgtcaagtctctgctttcccttttagcttttggaattcacatcctgtttagaggtctcctgcgttctgaaattataggaaagaatttcacccacgttttcttctagtacttctgtggtttcatttttacatgttgaaatcatgaatccattggaatgtattttggtttcagcagcgaggtaggggtagatggtattgcttggatacacagcagcgagcttggtctggagcgggtggggcgtgtgtgtgtgtgtgtgtgtgtgtgtgtgtgtgtgctatttttatcagttttggtgtctgcattgtgctggcttagcaaaaacaatttggatgcatttcttttaccctctgccttctggaacattttaagcagcaacataataatctctctgttaaaacttttcaagaattcactcgtgaaaccatctgagcctgatacttttgggggagtctagcactttaaaaacttaaactttttccatgggtctgtgagtttgggagtttttctttcttcttaaaattcattactatttttttcctagaaaagtgtcttttagcttatttaaaatccgtcagcttattccgagggggttgctttagctcgcttagtgaggacagtgtgcagcgcggtgattgacatgattgatcagcagagcacgatcgatcagtcggtgtgcaaacatgactgactgtggccagcgtcctgggatgctccatgttgaggcacatgtgtgcagtgcagggtgatgtgtattctgagaggggatgaagccacaggacccctgcacccttaggagagagcccccctccccaaggctgcagtcttgagtaggtagtgacgggactgggtctagggggctgagtggtcccagcaggccaagggcttcaggaattatgagaagtttggagttgcccagagagcagctttcaaaaccagtctggactgcagcctccagaaagacatgcgattgacaccacgaaccaggacacacctatatatggggtgggggtggggatgggatgtattaatgaaaccaaatttccgtgatggaattcttacctttaccatgcgtgtgctacactcagtattttctttttttttttttttttcccctctctctttttttctttttgtttgtttgttttggagagagggaaggctttttttcatttttttttaaacagctttattgagatccaagtaagctactatacaatccaccaatttatttatttatttatttttttgagacggagtttcactcttgtcgcctaggctggagtgcagtggcgccatctcggctgactgcaacctccgcctcctgggttcaaccaattctcctgcctcagcctcccgagtagctgagattacagacatgtaccactacgcccggctaattttgtatttttagtagagacggggtttctccatgttgaggctggtctcgaactcctgacctcaggtgatccacccgcctcagcctcccaaagtgctgggattacaggcatgagtcaccgcgtggcccaatccacccatttaaagtgcataattccatggttttcagtctattcagagagtagtgcaaccatcgtcaccacaaccaattttagaaaattgaaaatttgagaaatttagaaaatttttttcttaagaagaaaccccgtagcctttagctatcaatcctgccctcctcctccatatttccttcctatctgtgtggattctttttttttttttttttttttttgagatagggtctcactctgtcacccaggctggggtgcaatggctcaatctctgctcactgcaacctccacctcccaggctcaagccatcctcccaccatggcctcccgagtagctgagactacaggcctgtgccaccatgcccggctaatttttgtattttttgtagagatggggtttcaccatgttgcccaggctggtcttgaactcctgggctcaaatgatcctcctgccttggcctcccaaagttctggaattacaggcgtgagctactgcgcctggccgattctagacatttcttgtacagagaattgcacgtttggcctttgtgtctggcttctccacttggtgtcatgtttccaaggtccatccacattgtggcaggtgccagtgcgtccctgagtaatattccaccatggcatggaccattccattgtggacagacatgttgccttcatcagctgagggacattgggttgctgccaccgctggtgagtgtattcttttcaaattaaaaaaaaaatgctggtcaccacccactagatcgttttcttggcccacagggtgggacaagccggcctgggtgagggccaggaggtggccaggtggaggcggctggagcggccctgggttgcctctgggcgcagcaggcagaggtgcaatggcagagtctgagcaggttccctgggcggatctccatgccggtaatgtttgtttattcaagaagtctcggccaggcgtggtgcctcacacctgtaatcccagcactttgggaagttgaggcaggcagatcacctgaggtcaggagttcgagaccagcctggccaacatggcaaaaccccgtctctactaaaaatataaaaattagctgggtgtggtggcgtgtacctgtagtcccagctactcggtaggctgaggcaggagaatctgcttgattccaggaggcagagcttgaacctaggaggtggaggttgcagtgagccaaaattgcgccactgcactccagcctgggtgacagagtgagactatgtctcaaaaaaaaaaaaaaaaagaaaaaaaaagaaatctccagtgctgccctgtgcccggcaccgaagccgagggaaggcagcattagtatgagctcccagcccaccgggctcctgtctggagctgacgtgcgaccaaggcacacgagggaagcatggcgaggtggacggtgcggaggcataaggagcaaaataaggcagatgcagtggctcagtggctcctggtggctgcgaggagcgtgggcaggacagccccaggagggcacctggagagcagggccggctggggcaaggtgtgtcaggcacttgtcaggagcaaaatgtaaggggacaccaaagagctcaggaatcaacacagatagtatttaatgcagtatttttcaatatcgaaatgatgcatagtaatctctatgatgaacaaatgttggaattttaaattaagacaggcccagccctgcacgtgcacagccctgtcagagtttgttcagcgtggaatttgatttgtttaaaatgttgcttcaaaatattgtttgattcctggattttttggcactgccttaacttttgcacctggacgaaggcctcaccctaatcccagctggagagggtcaagggctggtgaatttggctttggacctgcagagcttgtggtacctgagaggtggggccaggaacaggaaggagctggtgagaacggcacccggtatgggatggggccagatcagagcagcactgtggctctttccaacccgtggttttgctgctggatgcttggcgttggtgctgagcccccggccctctgaacggagtgtgatgaataacggggccggggagctcttgggcccctccctgaagcagcagtgaagccagggacatgccggcagcaggcagggagagggacgtctggtctgtgcctggagccagctgccccatggaggagctgggtgaggatgcggtgggaggaagaccttcccagtcctgcatcctccgaagcataactgagtgcttgtgtggcttgggggtcactctggtccgaggacagtcttgctttgcttagccaggctttgaagagccaccgggatacggacagcagccctgctgggtggcaggttgtccaccctcgcccactcaacgctggaactggatgcagagcacctggatggccagtcccagagtgtctctgacactcccagtcacctcatcccttagaccaggataagatgcgggatcccaacctcgagcctcccatgggctccattccatgtgctcccataagccactgggcccacctcctggctccagggctgtctggccatttggcatcttggtttcctcatctgtacaatgaaaataatagtcccagccttctcgaggagttacaagatgcctttcgtgtgaaaaactgggatttggtaccagactatctggatttgaattttggccctacccctcctaacctgtggctttgggccaatctggcctccctgtcctcagtttccccatttatagagccatctcattgagttgctgggaggatgaacataaggaagtgtactcatgtgcccagagcattgtgattttacttattattaccaaacgaggcacacaataagtgcctaatagatgctcagtgtcatttcacggattctgtgtgccttgtgtgtctccagcagccaagctctggaggtggggaagctgttgacgagttgcacgaggtaattagaaagaggaggccacaggtgcaagggtttgggtgacacctgtggacagagagaggccgatggaccctggcagaggggaagggggcccttgcacatagaaaatgtttcctgcatccaagatccttgtgactctggaacagaggcagcagaggtctgcaaattccaaatcataaacccagaaagcatagaacattcgtagagaggaccagaaacatcatatatcttagtgtgtatagaattttccacatagccaaacaaaagcacgtttctaactgaagctgttggagagttcctgaggactttataccagacaagggccggtaagtggaagttcaatacgcaggagccattccttttgttcacaaatgtttgccgtcttttctgtctatatccgcattcatgtgagggcactcataggtccaccgtccagccccatgctttgtttgctaccaaaaaatttcttaagaattcctcagctgcaaatcctcctaccggagggggggttccaggaacccagccttgctcggggttggggcacctcagcacctgctgcacaggcgttggtcattaaaggtcatgtgccgtatccgtgggccctcggggtctggtggcacctgggcacacagtccagtggcggcctcctacctgccagacactgggagtggggggctcctcattcctgttccctggcggtggggggagtgccccgagctgtcacacatcagaacccaccgactcacacgttgcggcaccttacagccccttgacagcctctcagcctgagagaccatcaaactgagttcctggagagggtggctgttgaggcctggacacaggtgtggacaggatagccctgcctcatctcggagtcccgctccggttcagcctcttgtgggtctgaagctcaggctgggccagtccctgcccctcagatggccggaaaggcagcccagccccacggcctccttgtcaggctctgagagccgcctggcctccagctctgctctttttttttcttaagatggagttttactctgttgcccaggctggagtgcagtggtgccatcttggctcactgcaatctccacctcctgggttcaagcaattctcctgcctcagcctcctgagtagctgggactacaggcgcgtgtcaccatggcaggctagtttttgtatttttagcagggaccggttttcaccatgttggccaggctggtcttgaactcctgacctcaagtgatctgcccacctcggcttcccaaagtgctgggattacaggtgtgagccgccacgcccagcctccagctctgccttgattttctcttaaggccgtgaggatgtccacgcctcctcctttcctcacggcccattgatgtctccagatgctctgcaaagccaccctcccctcgggagctccccagctggtgacgggggaccttttggggatcactgcccaggtagtcatgtaggtctgtgggccgtgcttccaggctggaccgagacccggtgcatggggtgcttctggtctgagctgaggcccctggaagccacagccaggaggcagcaagggacggctgtcatgtcccctctcccctgtctcccagggtccctgcgggacagatttccctgcctgagcctcctggttgcccataccctggcctcccaaagcccagcctgaagccttaggcaccctacaacctgcttcctctagcagcctgccctgtctcttctctgccgatgttcctgaaactttcctgcctctccttacctcttggccagagagagactggagaccctgtgggaacccccgaggggagggagaaggccgctgtttgaacggaggtggtctttccctctgcccctccccaggcgggtcacacttgcaggcccagcctcctgctgtggcagcgcttggggtgtcggctgcctcctgggcacgagttgggagctgagggaggcgctttcaggaccggagtggcaacccagctggaggaggagtaacaggcccgtggtcagcagcagccgccgcagggaccccggcgctgtacctgtgccccagctgacccctcccgcttccctagggtgggccggggatggtggtctgttgcccagcccaggaagaagaggggccgtaatcagcagcagccacctcaggggaccccagcgctgtacctgcgacccagctgacccctcccccttccccagggctggctgggaatggtggtctgttgcccagcctaggaggaagaggggctgtggcttccactctagaggtctctctcccggtccctcccccggtgctggtctaactgcaggcctgccttaggccgtgccggcacctgctgactgacgcttagcggatgctgataggagagggctgggatggggaagcagcaagtcccggtcactgtgggctcgggttacagatggttgaggcacctcctggccatccccaggaagcaaggccccacgcagcctccgactcacccactgcccgtgtgtatttcaggaggctgcatcccccaaggcccccaccaggtaacttcattgggctgggtgtcgctgcaaaaccacccattgggtgcggtggtcttctggtggggggcatggctggggaggatgcggtggaggagaagccagctccgtggttggggggagggcggactatccgtttcctgtctgtcccctgaactggagctcatggtccctcccccaggtgcctgggccatggaagaggtcacagccctgccttattcctgtggcagcctaggggagccctggccagtcccgtgtctcctgggagggcgacagcctggtcaggctgcagggcaggactggaatgcagacccctgcttggccatgctgttgcctggctgctctgtctggggaccttctgttcaggaagagagaagcgggccggacagcccggctcagtgattggaagctcagctccccatgttcagtccagcaggaagtttgcctcctcggaacacttgcgtgcttctgcatgtgtcttcttggctggtggttctgcgaggcccctactgggctgcgtcatgtcctctggccaccctggccttggtgcctggcccctgtgaaacagagatacctgggcagtcccccacttgtgcttgcaagcctgtgtggcttcagtgatggctgattctgctccacccagaggacctgggaatcctcagcccaactgtccagaggagtctttctcagtggggagagcctgagctgtcctcctggtggacagtcctttagatctcaggcggacttccctgccggccgttcctcctgctgcccctgctcctctgtcccccatctgtctcccaccctctcccctgcagcagccagctggcacggggacctccccttccctctgggattgtgaatgagacgactttcctggtccttctgggtctagatctttctggcaacagtcagtgaaacccttgtctcaggtgggaggagaaggctcagtatgtggtcacaacaacggtcctaaccacatcactctcaaacgctggctttcacttaccccttgccctgcccaacagttactttcatcatcccattttccagattaggaaatcaaggcgcagagagcttcagccacttgcctgaggcccccacagttaagtgtctggatttgaaccctggagcagcctggctgctgagctgtcctggagacggggtactgtgcagtggtcggggtaggggtggagctctgccgtcgctgactcccgggctacctggagtgataacacagcccagtgtctgggcccctgcctgagactttggctggatgccaggagcccgagaccttccagctctttcctgtgtaaggcgccatggggtgaaatgaaagaaaaccccagttagaaggtgtccccctcttccttcagtccctcagctgccctggattttgaaataagacaccgcccgtctgtggggtgagcaggaacagattggaaccgcatttctctccccccagtcacagctgccaggagctcatctttctctgtctcctccccctgccgcctctccccacaagactgggctggatgctgctgggaaagtcaacaggaagtcttttggctgcggtggaggtgggggtctgtgcttccctggggaccgagatgagggctccaggttggctccggcaagagcagggaggctcacgtctctgcctgctggttttgcttcctgtcctgggagaaggtatccacatgtcccagaatgcaccctctgcgtgtacagggatggcttttgggccattcacctgaggtttattgatctttctctttggaactggagtggctcctccacggtggattgggctgagctctctgcctcggccgacgtctttccccaggcacttcctctcaccgtgccagggtgcaggttgctagtggatgggtcttcaccctcggggattggcagctgccacgctcatttcacagtcgagacaccctggccgaaggttctgctaagctccatggagtgtagggattttttttgagacggtctctctctgtcgcccaggctggagttcaatggcccaatgtcccgctcactgtgatctcgacctcctaggctcagcagtcctcccatctcagcctaccaagtagctgggactacaggtgtgtgccaccatgcctggttaattttttaattttaatttttttttgtagaaatggagtcttactatatttcccaggctgaactccaactcctgggcttaaatgatcctcctgccttggcctgccaaagtgctgggattccaggcatgagccattgtgctcagctggggttttcctttaacccttcctggcccttcccaggtgcaggacccgggcctcagccttatgtgttcttgaacagctctgggctctgtcctgtacctcctgggcgcgtggtcaggcctctcgtgacatcagcaggagactcaggtgaagaagcaggcagaacggaatgcttgctcacccagcctcggggccaggcggggcggccaggacagtagcagtggctggtgtggcttcctgggaggtcagcccattggcgtggccagcgaatggggaggggagcttctccccttgtctcccctcatttctggtctctgggcctccagggccaggtctccagagttctaggtggaggatggaggtcagggaagctggggtaagagcgggctgggggtgggtggtcaggcggatcctggaaaaccatcctctgcaggtcccgctttccccagggagcactcagggctggtcccggggagccgggctaatggtcacctcggatggtgcaggggtccatccccatgaaaccgggcccatccccatgaaactgggcccacagaagcttttggttccggttctgttctgccccctggctcttgcttccaaagtaggactcaggatagctctgaattccctgccgaaatgcagcttcctgggccctaacccagccctccagaaccagagtctctggggtgggccctctgcttgtctagcagcctccaggggacacttgtgcctgccagagcaagtctaataagcactgctgtaaacccctcgtccccacagccttctggttcgtctcccttttcctgctgggatctgcatcaggattaaatgccaacatcagggatcaggttatacttgtgaaccctgagacaatacctgcatctttttttttcttgaggctgtcttgctcgctctgtcatccaggctgaagtacaatggtgtgatatccactcatggcaacctccacctccagggttcaagcaattctcctgtctcagcctcctgagtagctgggactacaggctcacaccaccacacctggctaatttttgtatttttagtagagatggagtttcaccatgttggccaggctggtctcgaactcctggcctcaagcgatccgcccgcctcagcctcccaaagtgctgggactacaggcgtgagccactgcgcccggcctgatacctatatcttgaccaagctgctgtggaaacattgagttccccttgatagttttgtccacagagtgaatgtttaggaaccggcgaggcatctctcacccccacccagatggcggcctggaggcagcgtttctgaccctgtgatgggatttgtctctcttgtccaagagactttagagatgtggcccctgaatgtgggggcccctgttggggtgggaacgggagctggccctggccattgtccagtgaccccatctcagtgcctcgatcctagcaccctcgatctcagcgcctccccttccccggctccgcgcggagatcacgtggcttgcgctgagcaatcctccactgcccccgtcgcgttcctgctgcagggaagcctttccagggagccagctgacacatttggcctccattatttgtttttgaacaggaatgaaaggagagagtgagtaagaaagtggcaggaggtgggggttgcagagtaggggaaggtcagagagaggggaggaaagatctggaaagtccaggcatgtgctctggaagcaggtgccagcgatgagctcatctggagggtggccgcccgccctgagccctgcctggggccagcagggaacactctgccagggcatgtcgctgggagcctgtccttggctcactttctgctgctttgagcgctgagcagatttgtttccattttagggacaacgcaaggaggctgtcattccacccctcaccttattaatatttcatgaatcataagtgaccacttactgcgtcctgacgtactccaggcgctgggctcgaagctttatgcgcttcatgggatgtatctgcactatcgccgtagaaaacggttcctgttactactgcagagaaggcaccgaggcacagagaggttgaggaactggcctcaggccacacagctagaagcggctgaccctggctgtgaacacagggctgcttgactccaaagcctgagctggtttgcagcgaggctcatggtttctgtgccactgtttgagcctctggtcgagccccttggctcagtggggggcccagtgacctaccagctgttccattatatgttgtggacacctccacggcccacctgggtgggagggaaggggcttcaggaggtgggaggggtacagggaacacagtccagcctgcttgggcccaataccttgaccttcaaggtaccccttgagggtagcatgaggctaagctcttgttctcctccaggactctgttcctgtgagggcctcggggtcccttgcttttttctgggggccttgctggtcaggatcacagagaagctctttgctgttgatctttctgcctctgtatcttttggcaagccattttatgactcagttgctttgtctgtaaaatgggttgaataacattgtcctgcctcggagggtttttgggaggatcaaatgagacctgttgcacagaagccctttgtaagccatgctgactggcggtcgccgggcccccaagtgaatgggcatccgggcactgagtgtgtggactcagtactcggaaggaggggctggggggtacctagaactcctgggaggcttggacccctgctctgctcagattctgagcttctccttggccagtttaattcccatcagtagggtgagggtaaccaggacttacgcatagttgggcgaagtcgagtgaccacatgtggaagtctagcgtccttcatgcaaagtgggcaggcggccaaagtgagctctgctccagtccccccacccccggggctgttcctggcgccctgccctcccccagagccccactgacctgcaccatgtgacccgggcctgggaagatgggcccagctgtgggaggtcgtgcgggctggggactgagagtgccggaggagggcctcccaggaaaacccagctgcacaggaagccgggccagcggcctccggaagcctctgggctttgcaagctggactccccagatctgtggctgtggggccctctcctgcctgcagctgagagcccttgacccgcacctgagggcttcagaggtccgggagggggatgtgaccgtgtccccagggtgaagcccacccgagtgtcactctggatacagccctcacctcttcctggccccctctctggtcatggggacgctgcctggggggggttcccttacatggaaggagctgcagctgagctggcgggcctcgcacacccccaaggccgcctgacttccagcctccaagtggggttgcattcaccactcaggacctggagcctcagccagagagggaccctccactgcctctttctctgtctcttgggaaaggtagggtctttgtgccccctcccacccagggacctggcatgttgggaggctaagaggaagctgccccccgctcatctaccccccaaccctcccagccagcagagttttacctgtgtgcttagaatctgtgcgtggagccagaagtcacaaggttggcccagctgtgtctgaccctggttgtgcggtcttggacagtcccagccctcctggagctgagcatcctgatctgtagaggagaggctgctgtgccggccccgcagggccctgtgcagaggggagtgtgtgcggctgtgagttcaggccatgccctcagactggaggataggatcggaacagtgggtcaggatggccagagggtcccagcctcaggaggaggcctccacacctcccagcacctccacaccaggaaatgcagccaggcccccaggcctcccatgtcaggaagcagcaccccgccccccacctctggttgcctgggcctgagaagttgagcactcctcccgaatccgagtgccctctgacccctgcttgggtagttgtccctcctgaactgaccgcctgtcctacacagtcccctgtggtttgcccgacagggtggccagcgagtcccctgcacagcacacctcccccaggagtgctgcctgtgatgatggtgtaaagggtgcccccccgagcccccggaggcatgcagtggcgcaacagcgtgagcccaggagccccggtgagctcctggatggagaatctgttcagatcactccccagcctaaaccttccctgggtgtctgctgtgcttggggcgctgactcatcgtggggcggcctgtgagaccctacgtcacctggccactcccctcagcccctgttcactgcaccggtcccctggcctggctgctcctggaacatgagggctcatcctcacggaagaatattcacttgttccctcctggaaagtccctccctagacctcctggccgcctcattcaggtcttgctgaagcgctgccatcttggagaggcctccctgtcacccgcagttaaaacagccctcccatgcctgtgggtggctttctatggggcatggatgagtattggagagtcttgccgtttatttgttcatatgccctctgggagggcaggggacactgacttgtgttgtgggtgccttgcatgtcacgggtgctcagtgaatgcctgttaagcattaggggagcacaaaggagggaagcctctgtccaactggagcagtcagggaagacttcctggaggaagtggtatctggtctgcttagaatgtggcgatttgtctgtatgcagacattagattagagggcaaaggccattatcataacttagcagacagctacaagcagctaaggaattgctatgacatggactgctcgtgattggagctaagaaggagtcagagacagaggtccctgtgctctggcgtgagtccttgggggaggctgagctcccagaatgtggggccgcctgtgcagaggccggaggtgggagacacacctgtgagtgccggtgagtgtggggtgagccactggggctggatcagaagatgggaatccctaaacccaccaaccagccttggtgccctgggagtgacaggagacggggcttctgggggactaacccagcacaagtggacgagatgggatgcaggggaaaggacaaagctctctgaggctttgggaagctgagttagggtagagccatgacagggtgagttccagaagcaacacaagaaaaaatagctagactgggttttcccttcactgtgggagatgccccacctcacttcccccgtcctccgggctctggcaatgggctgggcacagtgaatgggttccatctgcaggagtggtcacaccccttgggcacagctgcctcatacactgtattgagatgggatccgaggccgggaagaacagcttcttctgtaggttgacattgtcagccttcggggagggaaggacggcagggggcctggagcatctccttttgccatccacactctgtgcctgcctgcagggtcttgagccctgtctgttctgcctcagtcctggtcaggaacttgttggagcccataggggcagtcaggctggaacaggaggagaccaggccggcaggggagccgagagggggccctggacagcacccagggctgagtcatcctgggcctgcccgacttgctatttggagctgttcccgcttgctcatcatgtgcaaggtcctgatccactcgggtctgtttaaccagcgcccctccccaggcccagttagcctggttttcgttcgattcatttattgtcatcagtgccatccttgcaccacgtaactagcctttgcagcatgccagccaccaagctcagggccctctgtgcatctcctgtaaccctcacagcaacccgggaggcacagagaggctgagtcgctggcccatagtcacacagcaggtatggggcattgccaggatttagccggatctctgactccagggcctttccagggccttgggtgggacactggcaaggaagcaaggtatgaacactggccctgccttggacagagctcggggacggtggcctggcaggcccagctgacacagtgaccctggtgcaggttcaaccattggcaaagtgttcaagtacacacagaatctcaactggggagacaggcgaagcggtcaagggagggctgtgagtgacaggtggacactgtacctactggcagatcagctgaccttggtgccttctggagcctttcaacttccttatccagaaaaagaggaactaacagttccacccccaaactgggtgggagtaccacattcgaaattgaagcaaagctggtcgtgtcacaggctcggcagatgttagctgtgcaggcaacttagtgaccatttgaagtaggctgtgcggcggcatcctcatcttgcagatgtagtccagagaggttagggcactaaccctgggtcacacagcgacagctcaggctacagagagcagtgctggatgggagggtgttggcagcttcaggcacaggctgggagggctgtggggtcagcagagggagggcacacttcccagctggtggggttcccttgtgcctcagtactcatgtgggcccaaaggagctggaaggagggaggttagagccacccatgggttcagaagctgataagcaggttattgactctgaatttgcctcatcgtatgtaaattggggacaaatttggggatttaatgatataatgtaagaagcagacatgtcacagccctggttatacagtcagtgtataataagtggtaagccgtcagaggaggcagccggtgagaatgggagcatctcagcagccctccgccccctgctcctggttgcagatgtacctgttcttggctatttgtgccccagctccgtgtcctccggtgtgtgtgaggccaagctcctggggtggggacttgggggtgtgtctgcagctcctgaggccaagaccaaggctgaggccgaggctgaggctgaggccaccttggtgaggaggaaattgcaggtggagaagctcgttgaccgtgaccttgatctgaccgtaattttgatggtgccgatgccgtcagcacgcaggcctcctgccctcgccacgactggctcctgcagcccacctggctgagaggtgtgctggctctcgcaggttgcaaaatggggacatcaccgtccgcctgggctacagcgtgctcgccgattgcatttggggagggactgagggctgattgtgttgtggggatgttggcagagaatcagagagggcatccaaaaaggccaacagttcggtggggagaggaggcgcaaggctggttcctgttttctgggctttgatcgaaagggaacaggggacacatctggggacagtctccttcctggaggaagaagggcttagggtgctggtgtggagtttgcacagatggggataatgagctggagggtgctgggcaggagctggccagtaataggctgacgagggaggccctgctggctgggcctggttttcaagtgagcatcctgagctgcggggacccagggggtcttagagacctcagagctgagactcgggaccacagaggggtgggctgtgctcagggcaacacagcggatggggcagatgttgcgaaacctgtctctctgcctctctttctcctgctacagaactggatcctcccagctcatggctgtcaaatcctttagatgcttctgggttccatgggcgccttacactggcttccctgtaggacagcagaccctgggggttggctctgatggtattcaccatggggtaccccatgcaagcacagtgctttcacgcccagcctcccagcctgtggagtaggcctgtgtctggccagcctcactttgtggccagaggagggagacagtggttctggagacaggagctggcctggggctgccctcccagcccctgttctcccagctcatctccttgccttgcgggtgctggccaccctccccccgccagctccatccccagctttctctgcccgagccgtgacctgtcagtagggggcagtggaggccttgaaagtccttggagaggactttgaagcagtttttacaaatctgtccctggaaagtctctcctgtcacacccccagcggctccctccctcctaacatttttcctggggttgtcatgcagcggggggtggaggaacccactaggccgtggatagagcagagccatgttgacacaaaccctggctgaacccacatgctccctacagccagcggccgatcactggaaccagggaagtgacctcatagcaagggcccgcagagcagccatcacgcattcccgatcttggtttctggacccagctctggaaaagaagccagatcctagccacttggagctgcctagggaagaccccagcctggtgccggctgacagctcactggaacttttcatctgcttggccaggtgatgccaaggggcagaggttagaagtgctaagaagcaggccgagggtggtggctcacgcatgtaatcccaacactttgggaggccaaggcgggtgaatcccttaaggtcaggagttcaagaccaggctggtcaacatggcgaaaccccatctctactgaaaatacaaaaattagccaggtatggtggtgcacgcttgtaatcccagctactctggaggctgaggcaggagaatctcttgaacccgggaggcagaggttgcagtgagccgagactgtgctactgcactccagcctgggcaacagagcaatactccgtatcaaaaaaaaaaaaaagaagaagaacaagaagtgctaagaagcatctgtcttcctgattgaaaagcaatctttgctgggcgtggtggctcacgcctgtaatcccagctttgggaggctgcggtgggagagtcgcttgaggccaggcgttcgagaccagtctgggcaacagaggtgctaggggtagtggcgcttgcctgtagtcccagctcctcaggaggctcaggtaggaggattgcttgagttaggagtttgaggctgcagtgagctatgaccacaccactgtactccagctcctgggtgacaggatgagaccctgtctcaaaaaacaaaacacaaacaaaaaaccaacgtttatcttttgtgattttaaaaatcacacctacttgtgacaaaataattaaattagaaaatgtaaaggaaatgatcaataataattgcgtcctccagacaaacactgttaacatgttcacgtttccttctagtctttttctacatagacactcaatacttattaatttgttttgaactaaagatggttttctctgctttgtatgagaaccacctcagccaggcacggtggttcacgtctataatcccagaaagctgaggcaggcagattgcttgagcccacgagtttgagaccagcctgggcaacatggcgaaactccatctctacaaaaaaacacaaaaattagcctggtgtggtggcacatgcctgtgctcccagctcctcaggaggctgaggcaggagaatagcttgagcccgggaggtagaggttgcagtgagccaagatcgtgccactgcattccagcctaggcaacgggagtgaaatgctgtctcaaaaaaaaaaaaaaaaaaaaaaaagttgccacgttgtcacctctctcagggattttcatcctttctacttttcgcccaagacttgccctgtaaaaggatgaggccaaatagccatgggagggtggtactggatgttcaaaaaaatgtttcgtggctggcgggacttagaaacaggttggggaggtttcagcagagggtggaccccagctgggggtggggggcagcaggggggcccctcacatgctctctctgcgtgtttcatggggctgcctgtgaggccgtgtgaaccagagcccggctgggaagccacatgctacctggactctgacctttcctggcagcatgaccttagccaatacgctcaactatgttcccctctgtaaaatgggctaatagaaatgtccactcgagacatgatgagaaacaaaggtgttcatagagcaaagtgcttagaacggtcctggcatgacaggagcccacatgtcagtgctgccgttggcatcgtcatcatcacggcggcattggctgctttgtttctcccttgtccctgtcaccttcttccctcagcaggctctcattcacttgttcatttattcatggccgaggccccgtctgtgtcaggcctggtgctgagaacgggggtagagagatgggggctgtgccctgctccctgacccaagggttccctttgcaatgtgaagttcttggagactggaccctcaggctgttccaccagcccctcctcaggccagcttaacccttccgtgctcgttttctgagctgttagaggaagagagcgggaggaaggatggagtggggtttttgtggggactgagcggggggtgtgtgaggccctggaaatggtgcctgcggcactcacgcagcattagcttttgctgcagttgctgtttggagaatattcttggatttcaggacactgatgacagaaggtggaacgctttttctggaagccatcaagaggggaccaccgcggcggctgagcagagttgctgacttgtgagctgtggcctgaccacagtcactgttctcatgagcgaggccccctgtggtccccctcccaggaatttctggccccttggcaggggacagttcagggctgggggtgggtagtggtgtctgcaggccctcttggagtcagagaatcccctgtcgccgtggcggggctgttccctcctgcccctcccctcccgctgtgctctcagctgctccgacaggatgcttttggcctgagagacagaaaccccaactctgaatggcttcagccctcaagagaatttggagcttttttgtgcaaaatgagatgttctgagcatcgaggatgctgtgggggatcctccatcccaccatctccagccgtggtgtccctctcggtcacaggatgctgcagccacgttgcagggaaggagagcctcccttcctgtgagcctagggagcccctccatgcagccccttcactggccattgcctgagacccgacctggtggctcctgccccaaggagcagaaagggggttcgctaggtcagggtggggctgggtgcgaggaccccccccggccaacagggtctgcttaggtgtccgtcctgttggggcagcagggaagggacccacatgtggcactgggacacggagaggcttttgtgcctgtgacggccaaaagggatggcgccccagccacgttcccacccaccccgaggcccagcatggccatgccggaaatagcagcatcgtccccctcactgtcctggcttgctttcaataggccagaggggtggggctggagcgggcgtctgacctgtggctggatctagctgcccgtggacaggctgtgagtgaatctgcagaggaagggagatgggaatgccgggaccttctcctgcacctcccgaacccccgttccctgtgagttagatggggagtgcacccctgccctcccctcctgggtatcccctgcgccccccgccccaggcacttgatgttgcctgttcattttccctctctgcccctcccgctggcccttcccatatggtcctaattaggaccttccgcccgttggtggatgggcagagaggggagcttgctgtggggcctcccccgatcgggggacttcccagcacagagctttctggcctctgcagggacgctgtgtgtgcctgtgtgagtctggcgtgttagaagcgctaagctgcagctgttctgtgcgtttttcacatttctcacttctcaaaggccctgggtttggtgtctgtgggctggggatctgtgttggggtctccaggaggcccttggtgggagaggcagggccccttcccctttaatctgggcaaccttgctttggcctgctgtctgcggaaagtgccctaggatacggtggcaggactggctggggttctggctccaggcccagccccagcccctgtcagacttaccctccttgtgcctccgttcaccctgtccacccgcagggcctgcaggagcatcctgagagttggtagggtggcctgcccggcgtccgcacagggtctgctggtgggtggctgaggctgcggtgaggtctccatggctccctcgtcctgcacatccttcccttgttgtgttgtctcgctagcatatgagcccgtactgcctctgagtctgcagcctgttttccttaccaggtggctaagcagggtggcagccagggtggcagagtcccattggcctgcaggggaccctctgtgggctgcaggtagtcccctgtggttgaaggtgccctggcaggacctgcaccatgacccccgtcaaagctcacgtccaaggcatttgtgggcacccccgccccagacgtgagggttggcatcttctcttgcacgtgaagcaaaggcctgtttgaaggagcgtgtggaagcctgggtgtgatgaaggcaaggaccggtggctcacccctcttgcacctggaccttgggtggcaggcctggggccttcagtccttaattcaggagggtagccagtcgctggaactaagagtgaacttcagctgttgttgccatagctggagggaagaggggaaaggaggcgctgcaggggagcagagacctcacccttcctctgccgacatcaggctgccggtgctggacggggccctggcaaccgtggcaggagtggtgatgtccgatgatggtaacaagggcttcctgaggaccccgagctgtcttaagggctctttacctggagtaagtatcccctttaatcctcccaacaacactgtgaaattgattctgttgttattcccatttcaccgatgaggaacccacagcccagagatgttaagtaacctgcccaagcctccctctgagcatggcagagggagggtccgaatgcggaaagtctggcttcagtgcccccatccctaaccactgtcatttacctcttcggccagccctctgattgcaaaacctgaggcccagaggagtgcagtgacttggccagcttcgcacggcaggttagtggcagagctgagcagtgtctcccatgccctgattctgtggcttcttgaggtggctcacccctaaacacgccccccatggtggctctgtttcctcctctcctctgaacctgccagcctgtgctcaggcagggggagaagtagagcaaccatgccgggcgggtcgtcgtgccccagtgccgcctgccctacacctgattggcagcagagtggcccctccttggtgtggtctggaggtgccagtggtcactcatcagcacagcccagtctcacacatgtcactcccaaaggatgttgacacagaatgaagcagctaggggaggcggacgctttggcacgagggtggcgtttctggtaatccgtagtgctgttgtctgtggctgcctttggctggcatctcacctcctcctggctgtcctgcagccacctgagggaggtcagcatgtcgccttcatcccaggacagtgtgaatgcagcagcgcaagcttgccagcgccgcactgcgggatctggaggcctttgctcctgagccctgcctctgtgtaatccctaaagcacggacttcttaggggcttccattcctccacctggaaaaaccttacaccgtttagggcttgaggcagggctagagcatggagacgttgctggaggaccaagggagaactgagcgcgtgttctcttggcctcagcctcgtgtgtgtgtttatgcatgggtactttgccatccacactggcttccacggctgggtgggagttgagttgagctcggcggctgcctttccaccctgcgggcctggttggggagtgtgaggatgcctgctggaagccaacgtgcacgaaagagttaatggtggatcccatttcctcagccccctctccagctttcccagggaaagggcaggaacagagaggccttatcttcagaggaaggggtgggcggggacacagcgctgttcggcacagtcccctctgagccaccctgcatgtttcattccaccgacttctgcagcccagctgttcagagcggatccagaaggtggagagagggtttccaataagcagaggatggagtgaatgtgagattcattactgggatttggcaaagcaaagagcctcactttctccccgcagatgggacgggggcggggctggagccagcggggtgggggtatccagcaagagctccttcccatcctcccacttcctttgccatgggccccctcctccacgcagaccctcagcctggaatgatcagtgtccagcttttctcgcccctctcctgccccgctggagggagtgacctggcccctggccccggccacctacacctcctgttttgctgcactagcctcgtggtaggggctgcggcggaggtgggcaaaagccgcttccgggcagccagcccccatcctgggagtgactgaaagtccttgggggttcctgcagggtgagctgcccattctggccctggtaaggacacccaggagagggccagggtgcctgtatttggggcacagcataaagaacagccgtaagtgtttctcaggcaggagggtgccgaagcattgggaagctgggatttagaagcattgtttggggtggtgagtggaagatgcaggacacagattcacgcgattgtgcagatcacctggcctcactccctcggtttacagtggaggaaactagaggccgagagaggtgaagtgagttccctggggtcacacagcctagccaggcccagggcgccgacctcctgctctgccttcccgtgcccattcggttggcatcagcatccctgccttgacacccccgtgtggcagctgctgtgattctgtgactcctcctcaccccaccccagtggggccctgcgagggaaagaagaatgccctatgcagaagtggttggaaagcaagaagcctggagagaagtgaggcctctgtggtttggcctgagtccaggactcatggcctggttcccagggatggagcaccgacccctcccttctacacccccaccccacgcccccaggagctccctatggggaagccggaatggacctgggctcagagattgtaaattcatcttgctggatgtgtggctgcctttatgtaaccaactctctcacggagaagccaggggatggctctcagtactctcgggggtctctcagtgaggtgggaggacctcgagaggtcaggaggctgctcaagaccttctgcccctcagggaccaggtgagggcttgtcgactgctctgacctcctgatgcttctggtggggagacctcagaggggcctgccgtcaccatcgccagtggccctggcctgcccagtcatccttctggggtggccaaactccatgctgcaaaagcccaagtgaaccccagtagtggcctgggagaatcatctgtcacgagccaaggatggagtttctggggaggactttctgctgccccccaacccctttcgggtacattctcctgtagccccactccctgtaagaaagtcaggtgcctcccgaagcttctccctggccccaggccagaggtgacagtgggggccccttgcttgcgctggtgactgtggctggttgttggtgcctggccctgccctgcactgtgcacccattgaaggcggcatcatccgggcctctccggtggccatgcatgggtgagcagcccacgacacatctgcttccagcatcgtgtgggccggggctttcagaggggctgagggcttggatggccctgcaggggggtgctcctggccttgtgaccgaaaggagctgaaggtttggagaagccgttgggccgaggtcagttcttatagatttggcgaggagggaacagatgctcacggagctgctccaggcactgcacacactgcctcactctgcgctgacagccaagaggctggttccccgccgacccccattttacagataatgtgctcccccagttccttagtggtggagccaggattcgaacccacgcaggcagcctcctgggcctgtagtcctacccttcatctccctccaggacctatgtcttggggttggcaggataatgactcccagagttgagcacatcctaatccccagcacctgggactacgttaggtgacatggcagggccagctaaggtcactaatcagctggtcttaaaatagggagatgatcctggatgatccacacgggcccgctgtcatcacaagagtttttaaaagcgcaatagaccatctgaggggtgcagtgggagaggcttggaaggaggaaggaggccacaagccaagaaatgcaggtgaacagaaaatgcaggaaaacgcagtctcccctgcagcctcgggagggtgcgcagccctgtggacaccttccctgtagcctagtgaggtggagtgtgggactaatctgtgttgtttgacatcacaagtgtgtggtcatttgctacagcagtgatgggaattgaatgccattaggcagcagtgcttctatcccggaagaattaggataaattcccctgtggatctcaagctctgggagattctgggctcctctggactgctccagttctgcaatcataggaaaggtctcccatgtctgtttgggagaagaaaaccccgtagcaaatccatttccccttttgacaaatgaaggcgagggtgtgggctggacacatgtttcctttttgtggattttttttgttttaacacttagaattctgtagctgaaggagactttggggggttgtctgcctgatttgcaagtgaagaaatggaggcccagggaagttaagtgactggcccagggtcatgcagagtcatgctggaatatcaagctagatagcccagttcctgctccaaagtgctttcctccctggttggggaggagggttggagggagtggaccccgagcaacagcagcattggcaggggttggaagagtagctactgtatccaggtgctggagcctctggccacttcctgcaggaaccaggtgacccaccatggcacaggcctctccctgtctatctgcagccctgggggccccagggaccagaggacactctggcctgagggctggggcctgagagaagagatggaagtacccctagtctggcctgcccccgtggcgtcctgcaggcatatccggcagcccaggggtcctagagaacttggctggtgggcgtccccaccttgccgcagctgcaccctgtggccagcagcttgcaggacttgggctgttgcctgtggccctgaaacagtcattttctgagctgagtggggatcaggtgagcagatccccacaccttaactgctgtgatctttctgtcctggaggctggtgggcagcctggttggtgcttcatggcactttatgaccggccctgtcaccaggctcgtgagttgctcccctcctttcgggcatcctgaacggcttccctgagagccccgccctgggccttcgcctctgcaggcccccgctgcctggggcgcctccttcccctggaagctgggcctctttggggactcattaagaagggccttgccgagtgctgccaaattgccccatctggtccccatttgttccacttaccaccctattttaacttttatgtctcctccttggctctaagatctgagcaggcagggcctgtgaggcaccccaggtcccctgatgctgccagcacccaggggactgttagtacatatgcagggagggaaggaatgaaggaagagatgacttggggagtcctccagttcccatttgtaactggcacattgcgacaaaacactcatggcattttacctttttcatataccttttttttaaatttatttttatttgagatggagtctcgctccgtcacctaggctggagtgcagtagcacaatcttggctcactgcaacctccacctctcgggttcaagcgagtctcctgcctcagcctcctaagtagctgggattataggcgcccaccaccacgcccggcgaatttttgtatttttagtagagatggggtttcaccaagttggccaggctggtctcgaactcccgacttcaggtgatccgcctgccttcgcctcccaaagtgttgggattacaggcgtgagccactgcacctggctttcgtatatctataaaagagaatttgcccagaaaatctttcagatgcacctttagggttttaaggcacagatacatgaagcttgtcagtgagcagctgctgcttattcctttttctcttccaattcagagcggcctgcgtcccaagcggacagctgctcccttcctcttggctccctgctgcccacgctcccacagaagcagggagaagaggcaggaaggtgacgcgtgatcatccgctgggcgcccgcacagtgccgtctgcacaggtgccatctcctttacttgtcactctcctcgctgagccctttcccctttttgcagatgagagagcattgcctcccagaggttaagaaatgggcccagagtcactcagctgatcagcgtgcagccagatttgaaccacatcctgctgatctccatgcctgcaggcctggcctgatgagatggacagctgggtggtggagaccttgagaccctggatggctcccaaatagggcctgtagctcctggacagggagagtctggcacaaagggtttgtggagtgagctgggggagaaggtggcttagggtccctgtctctgaacaaacagatggaggggctattccagcgttttctcagcctctggtgtgctgggctcctggttctgggaggagagaatggagctggcctccattctgggctgggctggtttgggcccaattcagacaagcttcttagtttgccatgagtgacacttttgcctgccctggtgtctctgccaaaaatatgaagggtttcagaacccccaccccggcctgcttccctcccagacttggagtgggtctggggctgacaacagtctcatgccagatagcctgagcagccaccagtgccatcaggtctgacactgcggcccctgccccggagggaaaaacaaggccctctctgggggattttctgccagcttgtgaaaacaggcctggagtcagccagcgcccccatgcttagacacttcgtgtggttttcaaagtgcttttatgttgctagctcatatgatcttccccaaaaccccataagggagggcaggaagtttgagcaacagcctgtcaagcacccatacagcaggtggtttcattgccctccatttacagacaagtaaactgagcttcagggtggctaccgcttgtctcccaagccacccagccatttagccacggaagaggtcatgactttttacaccccagtgaagctgaagatttttctttccgtttttaaaaatgtttactccccagggcagtgaacacctggtgcctctgtctagcgcaagaggtgaacgtttgccacttccgtttctttcctcctaccagacctgaccctccttttgtgacgggaacatcctgcaggcagtctgtcctgctttcatagactttgagaaacggggtccaaattgccggctgtgggtgggacaggcgacactgcagtgaagaggtggagtatttttgtagcggggaagaaatacatttcctctaccctcttaggttcagtgtttgggggtctgtgaattaaactcactcaagataaattaatgagagaaaagacagatttaatcacatacgtatgggatttcactgaaaaacgtgactcaaaagagcaggtagaaggtggggcccgtgactggtccgaaggtagtgagttatctcagttgattgttcacagtcagttacagattagactccttgttccactgtctcccctcttcccacttgttttgttttttttgagtcagagtcttgcactgttgcctgggctggagtgcaatggcacgatctcggctcactctaacctccgcctcccgggttcaagcgattcccctgcctcagcctcccgagtagctaggattacaggcacccaccaccacgcctggctaattttttgtatttttagtagagacagggtttcactatgttggccaggctggtctcaaactcctgacctcgtgatctgcctacctcggcctcccaaagtggtgggattacaggcatgagccactgcacccagccaactagtcttaaaaaaaaaaaaaaaaaaaaaagaacttagggcccgtatactatcttaataggaaaaaaggaaggggtgaaagcacatattatgggccgggtgcgatggctcacgcctgtaatcccggcacttcgggaggccgaggcaggtggatcacctgaggtcgggaattcaagaccagcctggccaacatggtgaaaccccgtctctactaaaaatacaaaaattagccgggtatggtggtgcacacctgtaatcccagctacttgggaagctgaggcaggagaattgcttgaacccacgaggcggaggttgcagtgagctgagatcataccattgcattccagtctgggcaacagagtgagactgtgtcttaaaaaaacaaataaaaaaaaaaaagcacatattatggcaaaacaaatgagtttttggaaagataaataggcccttaggagctgagatgggagatgtgaagtcttgtgacaatgtcttcttaggtgtggtgtggaaactactcacatcttccagggaagagtcagttgctcccagggagcagatttgggcctgtataccatcttaataggggaaatggaaggggcaaaagcacatattatgggctgggtgcaatgtgcccagtgcaggaggcagacgtggtttatggttgctgttgaaaccagtgcagggcccgattgctttgtattgagtgttgaggatcctggttttgtatcagccatgagtttgcagctctgggacacacttgatgttggctcaaggggaaatgaggttggaggggcagggtggttggattggatgtgggcctggggccattgctgatctacaaagtggtcatcacacgggaataatagagctggctacagaccacaaccagcaatattatttaaaagtaaggtcacacttttaataataagtcacattttaagttattatcaatttataaaacacactgttggtataatgatagcttttcaagaaggatataaaaaggcatgttgggctgggtgcagtgactcacgcctataatcccagcactttgagaggctgaggtcggcggatcacttcaagccaggagtttgagaccagcctggccaacatggtgaaaccctgtctctgctaaaaatacaaaaaaaaattagcttggcgtggcggcgcatgcttgtaatcccagctacgggggaggctgtggcagaagaatcacttaaaacctgggaggtggaggttgcagtgagctgagatcgcgccactacactccagcctgggcaacagagccagactccgtctcaaaaaaaaagaaaaaaaagaaaaaaagtaaaaaggcatgttgaaggtacctgcttgtggaaagttgcaacttgacgggaggtagggcgagcacttcttagaaaggtggaaatgggccctcctgctacagagacccacaaacatagactgaggcctgcagcctaggagactcaaaagaggcaaaggtgaataagagtcaaggtctccaagtcagggtctgactctgggggtgggggtcacatatgatggaggatgtcaggagggcttcctggaggtggtgacatttaccaggggggattttaggtggggtttgcgagacagtaggacctggctgaagagcgtaggctccttagacaggagtgggaattcaggcttgaaaatgagttggccagattgcaggggtcctcgaatgcaagggaagaatttcaactttaacagaggagcctgggaagctgtttgggaaaaggagtgataaagcgggaggggtcctccagcagagccctgcatgggcaggagggagcgagatgggaggtgggtgttggtaagggatgatcccagtggtccaggggagcagtcatagggtggaaactaaccttgtggggtctgggcaggaagggactgatttgagacaccgggaagaaacagccagtaggactttggtgagagggctgggggtcggggaggggggtgtggagagtgggagcttgagtctctgaaaacagacagtgttccaagggggagacctgaggcaagatgtggagaggcagctgagctgggaagctggaacggaggtgtggtcactccaggagactaagtcagggggcgaggggacccttgggagctatctagaccccagcactagggaatacggaggggagaaggaggggagaagaaccagctggtgcgtgtcaggcactgccctcgaggtcagatggggtggggctggatactggccatgaggattttttcaagagctgggttaatagtgagacgggcggacaccagatggctcgggctaagaagtaagtgggcggtgggaagctagaagccgtggtgtagacctactttgagaggttgggctgttcagacagggagaaagttcacagtttgaggaggtagataggtcaaaggaagagggtttgcttgtttttgagattggggcatcctgaacgttctcccaggccaagtgagaagaaaccagaagaggaacatgtcacccaaatgtgctgaaacagcccagcagctgcgctgcctcacagaaaatgtgcagaggcccctctgtcccaccatgcctgcctggggacggccttcactcgggctactcagggtttccccagcctgccaacccaagggtggcaggagctgtgggtgctcccagccccttctcaaggttggtctgtgggtagaaatgtgggctgcctcggggcgtcacagctacaaatgcataccagccctcagaaccacattcctgctccccagccctttcctccgcacccccatgcagaagcgcggccgccagctcacaaaggatagggagggatattgctcttggcatttgatgggaagcatctgctgcatcccattggggtgttgcccaggatggattggaaaagagttggcaggaaggctgagctctgtgctcacaacctggcttggtggtggccgaggagcttggcaggagcagagtgcaggacctgggaactgggggttggtgcatgtgtgcacgcacgtgtgtgtgtgtgtgcgtgcgtgctgggtgggtagggaggaagctgtgaaaccacatcccctcctctctgctgctgtgttgctgtgtgtttcagcagcacgtgggtgtcaccacacttcctagcaggtgtcaacctccaagactgttctgggctcttctcccagttggctgagttggaggtgggagtcccaactgtcccctgtggcttccagagtgggaccttgctgtgggataggctggccaatggtgctccctcccctgtgacccttctgttgggtgggtcacgaggaaggactgtgggtgttgcccacagacaggtggacatgtggcaaggacaccttgggaccttctttctgacgccccttgaagggggcactttctcagctttgagatgagtctctgtggatgtgggaagttcactatctcaagagcagcagccttggaaaatccaacacagaaccccgagtaggggcgggaaggggtcctgtcccgctcactggctgcctggcagagttctgcacaaggaagcgcctgtgttgctgtgggcggaggaatggactgagggctacattcgcttcctgttgccgctgtaactgcttatcacaaactcagtggcttaaagcaacagaggctccttcctttacagtgctaagggtcagaagccgatcagtctcaccggactaaagtcaaggtgttggcagaatccattcctgcctcttccagctttgggtgggaggctctgctggagttccttggcttgcggctgcatccctccagcctctgcctccatcctcctacagcctcctccttctctgcagtcagatctccctctgccttcctcttttttttttttgagacggagtcacccaggctggagtgcagtggcacaatcttggctcactgcagcctccgcctcctgggttcaagcgattctcctgcctcagcttcccgagtagctgggattacaggcatgtgctactacacctggctaatttttgtatttttagtagagacagggttttgccatgttggccaggctggtcttgaactcctgacctcaggtgatctgcctgcctcagcctcccaaagtgctgggattgcagccatgagccatcacacctggcctgcctccctcttaaaggacgcttgtgatttggggcccacctgggtaatctcttcatctcaacatcttcagttacatctacagagtccctgttgccacatgaggtaacacagtttgggaagggagagttattcagcctaccctaggggcctgtggtgtatctcagggcccttctgattttaagatataaagcaagaaaacaaactggctcaaggggaaaaaaggacacgttgaattctgttgctttaaatgtatatttttttattgtgctaaaatgcacagaacataaaatttgccattagtaacactgagtacattcacagtgtcgtgcaaccatcagcactgtctagcgccagaactttttcatcaccccaaagggaaaccccgtatccatgaaggactcactccccattcgccctctccagcccttggcagccaccagaatgctttctgtctccataaattcatttttaataagtgcaattctgtgtgactttaaaataaataaacatgagcacgatgagttgcttattggaaggatatccatgcggggaggccggcgtgtggagtgcgtaggcctccggacgggcaggagttgaaggggcgtggatgtgccgccctctcctccccttgctctttccttggggtcactgcctgagtatccctctttgcaaatggccccaaataatgtctcagcccccacgtctgcatcgcctcctagcttcaggaccctccaccaaaaaacattccaagcttcagactcactcctgggaaaattccaatggcctcactctcccttttgagccagccagatcccatggcctgtggcgggctgcctttgagtcctgagcacctgtgagctagggaagcaggacaggcacacccagggaaggggaagagtcgtcgtcagtcacagtaattgatatctttggaatcgtctaagagatacttagcgtgtgcctaaaacattcatttctttttttgtttgttttttgagacgaagtctcgctctgtcgcccaggctggagtgcagtggcgtgatctcagctcaccgcaacctcctcctcccgggttcaagcgattctcctgcctcaacctcctgagtggctgggactacaggcacacactaccacgcctggcgaatttttgtatttttagtagtgactgggtttcaccatgttggtcaggctggtcttgaactcctgacctcaggcaatgtgctcgccttggcctcccaaagtgctgggatgacaggtgtgagccaacacacctggccacattcatttcttaggagaagctctgcattttctgaaagtgaaatgtccccaggcgggtgacactgatggtgggatctgtggcctcaccagtgtcttatgagagatgccgctgtgtgtttcaccaagctgtatcctattgtcctctaaatgtggcttgtagacatggtgccgagaatgatctgggaggttcaaatcataatatggtccaaatcaacagctctctgatgacctggtattatcctaggatcaaattgagactatccgaggatgggcgtggtggctcacgcgtgtaatctcagcacttcaggaggctgaggcgggcggatcaattgaggtctgtagtttgagaccagcctggccaacatggtgaaaccccatctctactaaaaatacaaaaagtagccgccggacatggtggtgtacgcctgtagtcccagctacttgggaggctgaggcgggagaattgcttgaactcaggagacggaggttgcagtgagccaagatcacgccattgcgctccagcctgggtgacagagcaagactctgttccccggcaaccaaaaaaaaaaaaaaaaattgagactctccgagctgcactgtccagcatgatagccactggctgcacggggccatttgaacacctgaaatgtggtgattccaagtggagaggtgccgtgtgtgtgaagtgcactctgggtttcagagtcctagcaagggggaaagaaaagaatatcaaatatctgtcatttttacattgattacatgttgaattgataatattttgggctctgttaagtgaatgatattaaaattaatatcacctgttcttacattttttaatgatttcctttttcttttcttttctttttttttttaaatatggggtctcacactgttgcccaggctggagtgcagtggcacgatctcggctcactgcaacctttgcctcccaggtttgagcgattctcctgcctcagcctcccaagtagctgggattacaggtggctgctaccatgcctggctaatttttgtatttttagtagagacagggttttgccatgttggccaggctggttttgaactcctgacctcaggtgatctgcccacctcagcctcccaaagtgctggtatgacaggcgtgagccactgtgcctggcttgttcttacattttttattgtaggtgctggaaaatgtaaggttgcgtctgtggcccatgtgccgtttctgctggagggttggaccgagggccagccgagaaggctctggggctgctctacctgaatgctgagtgtgtgctgagcggtagagaactttgagaagtgctgaaggacagaggctttgtgtgggggatgcagccccaggccggagatgccttctctgtgctctggagaccctcatttggtgacagcaagaggaaccactgcaagaggggcggccacctcagcaaagcacccaggatgctggcctcccagctcaggaatccagaggcagaggaggggaggaggctgggcttggaggagagcagggtcttgggccctgggaaaagcctggggggccagaaagctgggggacagattgaggccagaggcaaagagaagaaggttcggagaggagggccaaggaagaagggttctgcccacggggagggagaggcccacggggcaggggcgtggtgggagctgcatcctcgaggctttctgttgaccctgacacctggccagaaaggagttccttctggcatcctttgtcagcggtttctggagctgccctttaggggccagtgatgagggtgccctgggctgggctgcagacagtggaaaagacaggctcttctcactcccagtgctggggaaattagcttcttggaggaagggggagctgtattttctgagtggccgcacttcctggcctagacgtgtgtgtcttgctgtaattttggcgactggtgttggtggtgcccattttatggatggggaaggtcaaattccacagatattgagtgacaggcccagggccttggatttcagtgtttgactcagaacccaggtctctgatctgccaccagcctccctcccattcagatgggaacagggactccgggcatgcagtcttctcccagacactcccccggctctggcctggcgcccggagaccagtagcagcagctccccacggccgttcactgtgagggtggggagggccgtgggaccaggaggccttagggggaaagttggccatgaggagtgggaagcgacgggtcagatgccagtgactgctggctggggagccgctggacgtggctggcctgtttggccagtgtggcgggtgccccggggcttcagtcacccccagccacgtgtgggggtgcgggatgggaaaggtaagagtgtgtggagcccagtcagcactcaacatgaggtcccgtgggggctgcctgagggcgtagcttccagaattcagcccctggccctcagaaggtgtcaccaaaggcttctttccatttgagtgaatccctcccagcccccagcaagccctcggaacgagcccactcccaggcgctctctcctagtgtgggagtggccacgcccctgctgggagtgactcacttgggttcagaggtcgtggcactgagatgggtctggcagatcccagcgtccaggcccagcccctatagtgtcagctccctcctctggggacccccttgcttgtgcccctctgggtcccagcacatcccaggcctgcagggagggggagaggaagagactgactcactggccaggtcccccaggggctggagaggctggagaggcaggagctggatcagatctgaatccagaggctctcggaggaagagctcagggtgagctgcgcccccatcccctgcccctcctctcctgctccttctcccttccatggtcccagccagcaagcacctggggtagaggggacaaacccaggtggctgtgttccagccctggctgcaggtctgaatggctttctggggtggctggccatgctccctgagagcccagctgtggcgatgtctgagcaggtaggtgggggagcacctaggaagcaggggtgtcaggcagagcacaaggagagagggtgtccaggtcagtttcaggacctggctgagaggagggggctcctcacgggcaccgcctctggcaagcacagggacaagggcaaggacggcatggccagaggtccctgggagcctcttcccctctcttcttcctagcagctccccctcactcttcccagggaccctgtcactttcctttagcgtgtggcagctccttggcgtccctcccgtgccttcaggttgcttctgcgccgggcctgccgctgggcgcccctatctctgcctgccccctcctcctgctcccctcgccctgcccccttggagcaattccccaccgagcctcccttcccaggcagtcgaggtccctccctacctctgccccgcgctctgggaggctccttgttccgcgaccacaaagcccctttgatcctctgctcggctctgagccatgtgacccggtgggcgggccgcggctctcggcgcgtccagcgcagcccgacgttccgctgctggggtgagtcctgctcctttgttcttcccagccttgcaccactggctcgggggctctcaggtggcgcggccgcgaggcggaccctgatggccatggtggcggtgccgggagccacgctgtccctgggccccggcccgaggccggcaggaccgagcggggtccccaggagaggggtggcggggagctcgatctccacgcggggaccagattttcggcctcaaaatagaagaatagggctttgtgtggtcacagctatctctttgtaaatatttggccaactaagctgagtggctaagttctcctgctgcccggagcttcttggaacatgtttccttttcgcaaggggtttccctggcttccaggagggccaggaagaaattcgaattggccaccgctttctctaaaatcactccgctcaagttatcacccctctgggctcccgaagaccggctggctggaggctggagatagtctcaatgctcgaaatgccgtaaccgaagctccccgcggcgccggcactgggatccagggagctgctgctacagcgcagctctggattcctggatgtgttggatatgtgcagggcgttcctgggaggagcggggagggagggtgctgctggcggggctggtctgcgtgtgctttgcttctctacaatggcatgctgcgtgtcggccatgcagaggcatgtcagtgagcaggggctgagggatctccctaacggacctgctttcagagggtcttttcatgctgggagaaccccagagactaaatcatgcagccaacggggtggtccccggcctcaaagcagggaggggcgaggagctttgtaggcaatgccatctgctcctgaaacgccgtcccagtgactctggggactgactcagcctccagcctgctgcacttcatccctggcccctctctctttgctttttcatgtgaaatctgctgtgttttggtcagaggtttggggaacagctctctgctcatctaagataagtttgtaattcctttcctggagaaaaatatgccacccggaagcaggttgagcagtggttttctggcaggtctgttcggggctgtggagacagcacctgctggatcaggatggagttggaatttggtttggatcccacatgagaaaacccgttggaagaggaggaagcagaaaaaggccccattccctaataatgctgtgggttttcctcctccattcattgccaccttgccttgaaacttaatggggccacgtgtgtttccatgaatgtcattctctttggccaactcccccggcagccccaggagctccttttcaggaaaaggaagaaggtgtttgcttagcatctagtatacgagtccttgttggaaaggtgggattcttgtttctccttgggtctcttttaggctgagatgtggtcaaggaaggcctgtggtgtggctcgccttttttaatgctcgtctctggagacctgagttgctgctgactcccagcttgccccttctgtcccctggccatttctgtgtcggggtggctgagacactattgcattggccactttgtgttcccactagcccccgcccctgtaggctgtcattgtgatggtgatggggccaattcagctgcggtggggaggacccactgtgtgcgcctggggggtggcgtggggcactctgggatgagaagatgcgacttctgccctgagagccctgctttaatggaaggcgggggcatagttgcaggcagaagccatcaagcactgtggtcagaccagcattccatgtcaaaaatggccttgttggccgggcgcagtggctcatgcctgtaatcccaacacttcaggaggccaaggcaggcagatcacctgaggtcaagagttcgagaccagcctggccaacatggtgaaaccctgtctctactaaaaatactggctaatccgggcatggtggcgcgtgcctgtaatggcagctactcgggaggctgagacaggagaatcacttgaacctgggaggtggaggttgcagtgagctgagattgtgctactgcactccagtctgggcaacaagagtgaaactctgtctcaaaaaaaaaaaaaaaaagccttatctgggcctgggatctgtcctccgaacactgggtccactgtgctccacaaggactttcaccccggaagccctagacccacttgggcaaccagagtctctgggttgaccactccccagccctggccagcctcctgggccaccgtattctcccaacttcctgttgtgccacggctggtccaagctgctcttatcagacaatgcgaggcacttccacaggaggggacaaccccgtccttaggagccccttctccctgcccccaggcctggtgcagtgtgtggcttccctgccggtgtcaaaggtctcaaggcccctttaagaagcctgtcaccaccaccagcagcttccgttatctggttcttctgtacatgtaagcctttcccatacaccccggatgtttagggcttccgccctctctccctggccgggagtgtgggaagagggctttatttcaatgcttgagagtagggtcaatggccagggtaagctgtgggggctcctccccgccggcccctctctgcagccctcaccttaacacagagcatcgataccacctgggctttgggaagacctggaggctgaccaccctggaggctcccagcgtcccacagccactctttggggaagaggcttcctgagggacttgtggcccttggctgggactctagtcccagagttctgccttccggcgccgagctttgatttgtttattgagtgccagcccggttcccggacaggtagggacctgttcccggagctcagcagagccttgggaagctttcccaggagggctcccgagggtggcggccatgcccagtccgctgtacgtgtgagtttgtttgatgaggaattggctgggaaggcgcgggtctaattacaggcccatgagggtccctctcgcccccacccaggaagcagcggagatcctggcacactcagcacctgggcctgtgcctgcccagctgctggtggaatcatgggagccttgctccggggcctgtagagcagcagtgggaaccttccccacctcagcccctcccagagttggctgttcaaactcgccgccgctcagcctcttcctcctctctttcatcaaccctgggaatcgcacactgcccaccccaccgggccccggagcgggtgcaggaagagagagcttaacacccagaggtctgggccttctgcaggcgcctgagctgctgtggcctgagctgggttccctgctggaaccatcacagtagacctaatgatctgcctgcaggagttgcttcatcccagccgactccggggctgcgggaaggggctgggccttggttttgctgggggtggggggtcagtgcaaagggcctgaaaagtggcagaggtgatggcccatctgtcctccccctggccggccggcctaaacgcgattggctctctttcttttttttttttccctcccttttccctataaataacactaaatgcgatttgtcaatgcattcatttgggttcagtagttggaccatgggcagaagcactccagatttgtcactttccctaagctaagggtggggaacaccctctgtgagatcttggctcctgagcgcccaagactgctcttggaaccccaactctgggtcggtctcaggggactgacgttgatggagttgctgacattgacctccggcctctgcatggccttcaggaagggggcccttcgctctctgtcccgtcgagcctggctggcagcactcccttctcaggcctgtgcccccggcagggcctgctgcccccgccctgctctgtgggtgccaggctccaagcaccaggtgactcggtcactgaatggtcactgaacagtcatccttgctggtgtccccagtggaatgtgcatggacgtcctccctcccccagatccttgtcttttatctctcagcctttgttccaggggccaccacaggaccaggaggtacgcagacgtgggtggcacatccactgggcagattcagccctgaacctgcacgccccctccaagggggcccccagcgggcggggttgatggtgccgtctctctctctgtcactagaacggacatgaggattgtgtcttgtcgatccacgtcctgagttcccagacgtcataggtgcttgctcaacgagtgtttgaatgaatggtcagcattgtgtgaccgcagattttcaacttttatccaaatagtttgtggtttctgtgaggctatcccgagacagtctcacaagaatctccattctccctgcacgctccgcacaaggtctccttggggggtttttcagaaaaagggccaaagagcagcatttcctcggggatttgaacacgatctcccccggggcaggggactgccctggaagattcccggcaccgcttcccatgcgccacgtgactaggagggtcttggggcaggatggtgtcttttgtgccttgtgtgctggggccggaggaaacactgcccgtggccggtgtcatctgccagccctgaagactaatgatgggctggacagtggccccattgagtgggagggagaatcgctgctgtctgtagctggggggccgggtgggtgggagccgaggccagggagaacagcgcagacctggcacggagaggcctggaggaggagcagggggtctcagccacccagggtgcagggacgccacacgaggagcaggtgtggtgtgcgtcctcctgcgggttctccacctcttggcttcgttacctgcactaggctttgtggtgagagggcacagagtggaggaaggtgccgtggctagggcaggccacacgctgtgctaatggattgctgttacctgtcgcctctgtggttttgctgtcaggatcctccagcaccaggtccccaccaccaggtatgggccccacaggcactactggctccccgaagccagggacagaccccatagacaatactgagtccctgcagccagggatgggcccccacggccagtaccagatctcagggaccagcaccgggtacccacagccagggacaggcctccatggccagtaccaggtctcagggaccagcaccgggtacccacagccagggacgggcccccatggccagtaccagatctcagggaccagcaccgggtacccacagccagggacgggtccccatggccagtaccaggtctcagggaccagcgctgggtccccacagccaaggacaagtccccacggccaataccagatcccagtgaccagcactagatgtccacagccagagatgggcccctatggccagtaccaggtctcagggaccagcgctgggaccctggatgactgaaggagggcacggttgactaaagctgcaggagccagcctggccatcctgaggcactaagccatcactgcggtctcaggggactcagactcctctacttgtcttcttgaattctggaatcagacacacctgggtccagcctttgcccccggggctgtgtgcctgggatggttgcctcacctccctgaagctcagtgagatggggacggctgcacagggcccggcacagatggcacccgatggcacagggtcacctgcttgcatccatacagcctcggccctcgctctggctgcgtaccgagagtcccatgcccagacctctgctgagtctccaagctcctggtcatgcctcaggcctcccgtgagaagcatcactgcatggaccatgcctcgggacctcaccttgggctgggaagcttgctccatctccccaagtctcccctagaggcgccccatgtcccatcactctcactgcttgaggggtcagataggggaacccagtgtgggaggcccagaggtgccggagcagacgttaagcgagttccgtgtttatgcgctgggccttggcagacaccctgaatgagcctcttccccaggaaggagattggggtcccagtccaagttgtggcctcaaaccctgtgaccaagagtggagaaaaggcaagacccctcctcccagtcttccagaacagccgatagtggtggaaacatggggttcacactgaatttccttgtaacttgttgaagagaatttagcccacattttcaggggtggaggtctggccgatttggcagtgtgcccgtccccctggccacagtttactctggaccgggcaccctggtgccctccctcagtgacgcagtgaagtcactatgacgtgtttagttggtgagaaagtgcctcctgtaatgttttactcttcttagagggtgaataagccttgtttattataaataattatttacagaatacatgaggtttaacctaactctgggccacggcagcgtcccctgggtaaacccacgcgccaccctagctagagcctgtgcccccacaggcttcctggactcaccctgaaggggggctggattttctgcctgtcccgatgagagggctgcaggacagtccccagcgagcccttctgagggctgtaacctcttcccctggtattttcctgctcgccaggaatgtttcaagcttccagcagaagcctacccaccatagtcgctttccaccctgctcaccatccctcctgccctcactcattcagcagaccccgtgcacagcccagtgcaggactcagggtgggaaggtgtcccgggtgggctggagcaaggttcccagccagggcggggtcccaaggtgggtccacagccaggactgtgatttgggaggcccctccctgccttgttccagccccggcaccgccgctgtccttgtgctcagtggagactcactggctccaggctctaaaacctcagcgaggtctgcagacagggaggagccccactcgagggtagagtgactgccgggtccatttgcctgttacgaaccacgtggcctcagacctgccattcctcctctcctagagctatggtcttttgtctgaaaaatggataatgatggttaccatgtcagggaccattttgaggacaaacggggatgaaactgaagaggctcagcacggaacctggacacagaagtgctaattgtgtgttaccagctgcggtggctgccaaggcccaaccacatggcagccacgggctgagtggcgggcgggaagtggggagcaggagcatgcaagatgggcattcctgaagtttctgatccagtgagataagtacacacccagctctaagatggagtgtcccaggaaggtggagactgcaaaggccttgtggcgcaggagtgtgagctgcacctctgggctctctagaatttcaccagagctcagggaggaggtcagctcagatataggggcaacgggagagatgggagtgagaaaatggcttggcgtctggaagtggagcctggaaaggtgggcgtggggacagaggagggccttgggggccatgggcccatgcgtccaggaggtggaggcagtgaacggggccacggtcggccccacacgtggcaccaccagccctgctgagcctgcacctgctcctcaggccccctgagtgccactaccacctggcaccccttggtctgattcctgcttcctgcccgcctgggaagagtgagaccacttgcctaaagtcccttagctgtccttaaccattctggctgcctcctggccctgtccagggttagccgttgacctgaactgcctggtgccacctccccagactcctggggccttgccctggcaccaacagccacctccatcttcatcattcactcgcacattcacccagcagtgctttttgggcatccactcagcaatatcaaggcgctgagatgcggctgtggttaagacccgggcccggtctgtgaggacctcgcagttgccatttccccagagcacagccccagccaggcacactgtggggtccagaaagagaaactaatacattgtgttcgtccattttgagttgctataaggaatagccgaggctggggggttatttgactcacggttctgcaggctgtacaagtggtgccagcatctgcttggcttctggggaggccccaggaagcttttcctcatggtagaaggtgaagggggagctggcacgtcacatggcgagagagagaactcccagactctttttttttttgaaatggagtctcgctgtgtcagccaggctggagtgcagtggcacaatcctcggctcactgcaacctcagcctcctgagtagctgggattacaggcgcatgccaccgcgcccggctaatttttttgtatttttactagagatggggtttcaccatgttggtcgggctggtcccaaactcctaaccttgtgatccacccaccttggcctcccaaagtgctgggattacaggtgtgagccacctcacccagccctcccagactctatagcaatcagatctcccggactttgtgaccgtggggagggcaccaaaccatccatgagggatccacccccatgacccaagccccaccccccccaggccttacctccaacatcagggatcacatttcagcatgagatttggaggggacaacgtccaaaccatatcacacgtgacctctctgtgcgtgcgtcagtttctacatctggttaagcagtagaagctccttctctgttccttgttgagagagcggtgggggagaaatgactcagggatgggaggctggtcccccgaggggccctggtgtttgtggagtgggagtgcgggaaggcccctacgttgtgtgtgccgtgctgggctggctcctcacagctcaccgtggtgctccccgaggactgctggggaggaaagagctaattaacttggggacccagctgctgaagttatcattaaacttgagcagtccaggggcccctctccttctgggtcctatgtcacccagcacagtggggcttaattgaattttttctcatcccccaaggctcctggctggcgtggctggggtttgggatacggggagcgagagggcttgggcctcttccagatttggagtgggttcaccagaaatggcccaggaaaccgcgggggccacccccagcagctgggggctcctgtggtcatttcctcttggtcctgttgagcagccctggcccctggagccctcagcaagggatgtgggggcctgccaggccagggtcctcactgctgccgctatgcacagctgcatcttgcatccggggagtggggtgccgagtggggtgtttgggaggcaggttttcccttgtcccttctgcccagagaccttggggatgagttgagtgagacccttccggcttctgactggctgtgtttctgttgccatcccccactccttttaagtggaggtttatgacttccttctttatttaaaagggtcatttagtgacttagcagatcccagtctgtgttacccagggcccttttaaaaatctgtggggaggctgggcttggtggctcacacctctaatcccagcactttgggaggctgaggcgggtggatcacctgaagtcaggagttcgagaccagcctggccaacatggagaaaccctacctctagtaaaaatacaaaaaattggctgggtgtggtggcacgtgcctgtaatcccagttactcgggaggctgaggcaggagaatcactcaaatccaggaggcggaggttgcagtgagccgagatcacaccactgcactccagcctggacgacagagtgagactctgtctcaaaaaaataaaaataaataaataaaaataaaaatccatggggggacctctgtgtccattggctggtgtgaggagagggtgaggagctgcagagaaggtaccaggctgaggaccgcccccacccttgggctacagaattgaaggaggggacacatgaaagatgttcctagactcgggctggaggctggggacatccgagggcaaggacgacgctgtccctgctcttgtttgcagaggagtgcacagggctcaccagcttcttgttgctgtttaagtgatagctttatggagatagaattcacatactgtgacgttgacctttttaaaatctacagttcaatggttttgctgtattcacaaagtgattgtattagggtcatccagagaaacagaaccaatagaaggtgtgtacgtgtgtttagataaagagatttattattatgaggagttggctcacctcattacagaggttggcaagtgccaagattggcagagtaaatcagcaggctggagacacgggagagcccatgttgcggctctggtgtccacctgaaggcccaagacccaggagagccaatggcgtcgttccagtcccgagacccaggaaaagcgcatgtgtcagtttgagtctgaagcaggaaaaatctgatgttccaggttgaaggcggttaagcgggaagaattctctctcactcaggccttgtgtcctcctattcagaccttcaggcctttgtcacaaaattacaaagacctgatcagaacaaaatctgagaaaaaaccctttccttctatcggttttggattcattggctgggaccctggaaattagactgacagagattaacaggaaacaagcataacaattcaagtaagttttacttgacaccgagccttcataaggaaatgaagacccagagaaaccgttagcctgagcggtttttgttttgttttgagacaaagtctcactctgtcgcacgtccaggctggagagcagtggcccgatcacggctcactgcagccttgacttcctgggctcaagctggggcccagctgccggccccgggagctgctctgaacccactcttaagtcccagctcagactcccaagtagctgggactacaggcatgtgccaccccgcctggctaattttttattttttgtagagacagggtcccactatgttgcccgggctggtctcaaactcctgggctcgagcaatcctcctgccttggcctcccaaagtgctggggttacaggtgtgagccactgtgcccggcctaggcctgaacagtttttatttgttttgcttgttttttaaatttgtttgttgcttgttttgagcagtttttttgtttatttcttttgcttgtcttttgcccaggctggagtgcagtggcatgatctctgctcactgcaacctctgtctcctgggttcaagccattctcatgcctcagcctcccaagtagctgcgactacaggcgtgtgccaccacacccggctgatttttgtatttttagtagggatggggttttaccatgttggccaggctgttcttcaactcctgacctcaagtgatctggccaccttggccttccaaagtgctgggattgtaggtgtgagctgctgtgcctagcctaggcctgagcgtttttatgctgggtttgatgaagagtggaaagtcgtgggaaactgtgacagagcaacaaaagatgagctgaacagtgagcccgtgggggtctcggcaagacctgtgtactggggcccctctcagatcctctgtctctggagatgaggctgttcctttccgctgggtgtagggagggcacctcttacgtgaggggcttatgatctacttcagagaaggggcaggtcagtgagttcttcttggacctgccatttcttaaattccttcagctgaaaatatttactatgccaaggcactgtatcttggagtgtgcgttccaagccctgttgccttcaactgatcgggtgaggcccacccccatcagagcacacagtctgctttacccaggctcctgattgcacccttttcctgtttgccccgagaatactcaccagcagtgcttgtggctgcagcgttcaccccaagataaatttgccgggaagtatcttgcttttattattattttcacatcactctagtatatcgactttggaaacaaaagacatcattctgtttatagcattccatttttagtagtggtatttcctttaaaaaaaaatggtaattctcagctgggtgtggtggctcatgcctgtaatcctagcacttgggaaagctgaggcaggctgatcacctgaggccaggagttggagaccagcctggccaacatggtgaaatcccatctctactaaaaatacaaaaattagccaggcgtggtggtaggcacctgtaatcccagctacttgggaggccgaggccggagaattgcttgaacccgggaggcagaggttgcagtgagccgagatcgcgccattgcattccagcctggacgacagagcaagattccatctcaaaaaataaataaataaataaaatttaaaaaaaaatagtaattctcgatcgctgaaaatgtcaaatcctagagaacacagcattcctacaagtgatgttaacattgttcttgatcagttgttggctgaagattcatttgatgaatctgatttttccagaatagacgactcagatgactctgttgttttgcttagaaataactgcaggaacaatttaaaaaattttttttctttttaatttttttgttttttgagacggactctctctgttgcccaggctggagtgcagtggcacgatctcggcttactgcaacctctgcctcctgggttcaagtgattctccagtcttagcctcctgagtttagctgggattacaaggtgcctgccaccacacgtggctaattttttgtatttttagtagagacggtgtttcaccaggttgaccaggctagtctcgaacccctgacctcaaataattggcccatgtcggcttcccaaagcgctgggattacaggcgtgagccaccacgcctggccagtttttatatttaattttcacacagagcatccagtcagatttgcttcagcctcaaagagcgtgtttatgtaaaattaagtgagtgctggcagtgagctgaactttctaaaaggtaaaagggttaaatattaaactcatccaaaaacaccttcacagacacactcagaataatgtttgaccggttacctaggtgccccatagcccagtccagttgacacagaaatttttttttttttttttgagacggagtctcgctctgtcgcccaggctggagtgcagtggcgcgatcttggctcactgcaagcttcgcctcccaggttcacgccattctcctgcctcagcctcccgagtagctgggactacaggtgcccaccaccacacccggctaatttttttttttgtatttttagtagagatggggtttcaccgtggtctcaatctcctgacctcgtgatccacccgcctcagcctcccaaagtgctgggattacaggcatgagccactgcgcccggctgacacaggaaattaaccatcacagttacacagccatcgccattaatcccagcacatttcatcatccccaaaagagaccctgcccccattagccaatccccattcccaactccgggctctcagcccctagccaccgctcatctgccttcgtctctatgaattcacctgttctagatagtttgtataagtggaatcgtacagtatgtggccttggtgtctggctcctttcacttggtagaatattttcaaggctcatccacattgtagcaggtgctggtgcttcattctttttcatggccgaataatattccatcgtggatagaccacactgtgtatctcttcatctgctgatggacatttgggttgtttctgctttttggcataattctgttgtgaagaattctgcagtgagtgctggtctacaggtttttgtgtgaacatgttttcatttctcttgggtaattgcaagatcatgtggtttagccaaccagcctttaagccatgtgtctgctgagggacccaggcctggtgggggtgcattgctgtgcttggccagccaggtgctgcgagtccgtgtcgcagccatttctctgtgctgtgctctgaggttgtctcgccggcaccgggcactgtgagccccaggaggccaaagccccctttgttttatcttgagtccaggcctcgctccatgaactaggatgaatggacattgaatcaacgcagggatgggtggggctggggtggggacgcagagtgaccccgggggcctgcagctgggtcctggctgctgacttccagtttcctttgcctgttggagcccagaacaagtcagaaaggggaaatgcaaagttcgagtgtcttttctgtggtagactggcaggcctgggtgggtgagccacttgcagctagttgcagcgtgagagaggaagtgggaggggagggagagggtgagtttggtgtaactcacccctggaaggaggctgggctgaggctgggggaagtgacttttatttttctgagaggattcttccctggggccaacttcaaaccaagggagacaagaccttcctgggggaggctggaagtgctggggcccccaggtgggcaggtctcccagggccaacgtcttggggaagctataagttaccatgtttctggactgtcacacacacacacacacacacacacacacacacacacacacacacacacacacgagtaaactgtaacacaaatgtgtgcccatgaaagtgcccactttaaaccaccacacagcctgtaaagcgaaggccctggcccgcatctgggcacccactgcccagccagccggtaggcagtttgcactgtagtctgttaccatccctcagagatgcagccgaggagcccagctggcttggagggcccagtgggcgcagcctcaggaaagtggtcaggcccgggccaggccccttccccctcccagccttgggagaaattaccatatgaatgtagctccttcccggagttcgggctggaagggcctgggaggggacaggctcccaccccaggagcttccaggttccggctgctgcctgtgttagctgcgtgagcgtgagcgagccaggggtcactactgggtggaaggaagaagcgggcatttcttccaggaggtcaccgttggagtcccacagtaggtcaaccccaggccctgggtcctcgggaggaggagaaagaagagaagcaggaggtgtggagggtaggccaggaccagaaggcacacagggtcggggcagtgtgggagaccctgggggctccctcatttaaccagctaacatcacagcgttcataagaacacgctattactgcagttttattactttgctctgatttcagaaggcacaactgatgactttagggaacggagaatctgaggaaggcctcgcaggagagggtcagatgcgatcgagtaaatgtgagccgtctgtaaactgtagagtgcacgcacagcaccggtcagccctggggtcagtgttcccctggtgctcagctcggcctctgcaccttttagtgctcggctgggctctgtgggggtcagggctgggtctggtacattagaggacttctaccaagcccctggcagtgtctcagttactaaatccagtttgccagttactaaatccgctctgccggttcccgaatcactcttccgctggggccggccatgtcacgtcaggcttttcatgcaggacggcagatggatagacgctgggaccaagtcatccttgggccgcgagacgtctgaccttctgctggtgtctcagaagatgctagctctccgtggcatgtcttccacgcggtgcttggggaccagtggcctctaaggggcccccctgcctcagcgtggggagtggcctggccaaggtctcagtgtctggttggagccaggcataggctcaggtgtactggctggaggcctcctgcccatgggctctgcctgtcctgtgtccctggtccttactgtgtcttctgtgttcctgggagagaccccaggggccctgagcccagcactggggttggggagtgggcggggaagagggtggggattagggtccctggctgcagaacagccaggccccaagtccccactccactcccctcccaccgggcgcctcatcccacactgaccatttcctgaagaaaatttcctgaaccggcctcccaccccggctgtcccaggaagcccatccatccttccgccttaatgctttgtggctccagaaggatggtggaagccggaaatcatgagtctcattcacaggcggccacacaccgaagccgcggagacgccgtgggaaaggactctggccagcgcggccggcacagagggagcggtgttaccggggtagacgggaaccgtggctgcccccatgctggtctgggagagacgaggggccggacgaaaggacagcagactggccattcattcatttattcattcactcattcacagcgtcttactgggtgcttcggacgtgtaaggttttgtgggtagtgaatgcgacagaccccagacagcaatcggagggccacgtgtgtaagaactgagggacctaggctgggcgtggtgtctcaagcctgtaatctcagcactttgggaggcagaggcgggcggattacgaggtcaggagatcgagaccatcctggctaacacggtgaaaccccgtttctactaaaaatataaaaaattagccgggcgtggtggcgggcgcctgtaatcccagctactcaggaggctgaggcaggagaatggcgtgaacccgggaggcagagcttgcagtgagcccagatagtgccactgcactccagcctgggcgacagagtgagactccatctcaaaaaaaacaaaacaaaacaaaacaaaacaaaaactgaggaacccagtgtagatgagctatcccgggaaaacaagtgggagttctaggaacagcatggggaagggatggtcccggcagggaggacctctgtgggtagccttgttggaagagctgaaaggcagccagagaggctgtgcgtggatggaagctgaagagtaggttaggggcgtgtgttttgttaacaaagacttcaagcatttactgaccaggcacaacactatgtgcttcataaataaatatctcatttgatccccagcattcttatgagacagatgttattatcccatttcacatgtaagaacattgaggcacagagtggttaagttacttgctcagggtcacacagcacgtcggtggtaggcaggattctggagccacaggaatctggtatatcccaggtgcaatggaaaccagtcacggcttcatagagggaaatcatcagattagtaaattttacacacgccccctggtgctttgaggaggagggattcggacaggggcagctaatggtggtggctgtgagatgtgttgggttaacattgatgagagtttgggatggatgagtggattcggagtaatggaaatggagggcccaggcccggcccctggagatctagctgcaatagctgttggctggagaggctgttcacttagatgggggatggggtgggaggcaggtgagatgagagctccagagttcagcctggggcacggtcattgggttcaagatgccttcagatgttggggcttgacagtgacagtggctgcagatacccaggacccagcagagggcctggcacagcggggcccagggacacgtctgtgagtcaggctggcactcaagtgtgaatctggacaaagaaggtggcattgttggcattgaatgctcaggggctgggtgaagtcagctagggagaggggctctcaaggcaccaggactgactccgtgggtgagggcggaggaggagacggcagaggctgagagaatagccagagacaggaggaaggtcagcagagccatgcacagaagcctggagaagatttgaggaaaggaagggctgggtggtcgtcattccctgcagctaggaggcaagggtgacccctgtgtgtttcattcttcagaggattggtggctccatctggtcagaaccccaagtccagagatgcatctgagcttcatgccatggtgcaggcagcaggagccatggagcaggcctgcggggtcacggcctgcctgctgcttcctggtgtctctaccctgagctcaggggttgcttggatgccctgtgctgcatccccccaggcggtgttccagagaggatgaaagtggctatctcaaggtgtgaccaggtagcggtccatgcacactgctttttcctggggagagtctgggatggaagggtatgtgtgtgtttctgagactccttgaataggctccatgtacctatccacccatcttaccacccacccacccatccactcactcacccatccacgcacccacccatccacccatccactcatccacctgtcaacccatctatccactcattcacccatccactcatccacctatctacagtcattcactcatccacccatccactcatttacccatctatccatccactcatccacctgcccatccactcacccacccatccactcatccacccatccacccatctatctatgcactcatccacccatccactcatccacctatccactcattcactcattcactcatccacccatccactcattcacccatctatccatccactcatccacccatccactcattcactcatctgtccatccactcatctacccatccactcattcacccatttatccatccactcaaccatccactcatccacccatccactcatcatccgtccactcacccatctatccacccatgtatccatccactcatccacccatccactcatctgtccatccacttatccacccatctactcacccacccatccactcacccatccatctacccatcctctcatctatccatccactcatctacccatccacttatccatccatccactcatccgtccatccactcatccacgcatccactcacccatccatctacccatccactcatccacccatccacttgtctactcatccactcacccacccatccactcatccacccattcactcatctactcatccactcatccatctatccactcatccaccaattcactcatccacctatctactcatccacccatccatccagtcattcatccatttgctcattcatccgccaacccatccattcacctgcctgttcatccacctacccatccattcatccatctgtccatccatccacccacccactcacccattcacacacccatacacccatccatttatccaaccatccatccccatccttacttcagaaagcatttgaagttgctggggtgtgcacttggaaaatgcgtcataagctttcataggcctctctttggcttcctcacttctttgattggtctttctttcggacatgcaggattctgagcagctcttctgggaggtgggtgcagtccaggtaggctgcctgcaaagctaggaccgagggagccacatccaaggcactgtgggttcccaaggcgatggcactgtgggcccactgcttccagacctcctcaactcccaggctcctgagcaggaggactcctggggcagggcctggagacgggaagagaaaacaattccagtctctcaactcttgtcagtccaggtgggtgctgcatggattgggggcacctggaacagttggccccttcacccctttcccccacctttccagcccctctggctataatcagacagttgtgtgcgatgtctttctccctcctgaaggggtcatttagtcaggctcctactcatggcccaggaatgtgcccctccctgcctgtcccctacccccaagcaggccgtgcctccagccccctgctgtctctgaagggcctgggcatggggcagcctctgcagcatccccagggcccgagctgatctgcacagcagaagggaattgggggaaagctttttttctacccagcacctggcagggggccaccctgttgcaccccagagacccttgtctaagttttgttatttcagatgatttcataagttgggggaggcggagccccagcccccacagcccctgttgttgcctcactgctgagctctgctgtgtatctgctgacaggtctgctgatagcagaaggggctggagagagggaagctctgggccctgccctccccaacccctgcttaggggacatccctgataagaggaaattccagcctgtgacagatggccagtgtccacccacccacgggggaacttttctttctctttgtaagtttgcagatttgccaggaactaaaggaatctctggttgacaggccactgtggacatggctggagggctggcacgggctggatcttggggttgctttgaggtaggggccgctcctgctggaaggttccttggggtggggaaggcatcagggccattccctgaccctccctctgcagtggatccacttcagagcctgagacaaggcaagggggcagcagaaaacagaatataaaatagccccccccaccacacaccgcaccagaagtcagaggattcatccttggcctgccctccctgcagcctaagttctgagagtggctctttaggaagtgaatggtgatggtttgcaggtcagagcttgctctggcccaagattgatgtctcaataggccgcggagcctgggtgaaaaaactcaggctagggaggtggtgggttgcaaatgaaagaacagaggagggcctcttccagaaagcggcgggtggtgtgaggagcccttggaccttgtccaaatttgactttaccgactggggccaattgaaaccgtgctggcagaaaggcaaaactgcttgagattccttcctccacaatagaggagaggtttgcttgaaagggtttggcgagggaaaagctggaggaaccttggccggcagtaaaagtggggacccccgccccctgcctcgggggcgcctcggcccctgaatgaatgaaagaggaggctggatggagacagactcacaccacctgtcccttccaggtcctgcaaaggagcacacagggttcttgttggctcttccaccttgttagtcaccaagaaggagaaaacaccaacaggggaactgtaaagctgcagttttgtttaagccccatagtggaaaccggaaagagctccagctcggagaaaaatgcagctctttgcctttgcaaatccgtgtctttctctgggaggccagagccattgtgctcgatttctaagcagggtttcagagtgtctcaggaggggaaggcagagtctcagatttccggcatcccaggtcctaaccaggctttgaggagacgcttcctgtcccatacaaagtgtgaagtgtaatttgatttggagttagttaacaaattagatgagctgtgtgcattttaaaaattcagtccttgatcccccacccacacacatttgcacaatttggtcatttatattcagtgtttccatctttagaagagaacaggaagtccccagtgacatttatggagtgtttgtagtagcttgggtaggtcagtaggaacacaatgcagtgaaaagcagagttgagatgggaaaatatcctgttttcagagccccccagggatgacattccttatcgtctctgtccacccgctctggagtccactccgcaaacagcaacttgttctcacttgagagcttcctcctgccggagctcagggatggagagcagctggcctcagtcttctcctcttacctctttgtttctcagactcatcttccaccttgaataattgtttttaacctgctctccctcttctctagctgtagaacccagaactttgtgtgtgtggtcaaaagtttagagagtgctgcaggtaatgctgagataaccctattaaattctgtaagttctcatcacaccaagtttgtttgttttttttaattctcattttattttatttcattttatagggatggggtctcgctacgttgcccaggctggtcttgaactcctgggctcaaacgatcctcccgcctcggcctcccagagtgccaagttatttttttaactgggatccacgggcctagggattctttgatgaaccgttcaaaatacgtgtgtgtctgtctgtctgtcttcaatgtatacttttctagggagagtctttacttttcaccagaggtttgtggcacacacatgtcctgtactactgtatcagattgtgaattccttacatgttaaagactgcttcaaatctgtccggaagtctcggctaataaacatttaaataaatgaacttcaaattcccatgtgccaccactgttttcattctgactactctcaagcctgtagtgtcatctttttgttactgtgaagtagacactcaataaatacttgtcaaatgaatcaatgttatggtcctggtccactaggaccccaggatcatcgtctaccattattgtctatagtttctttaccatcttgttccagagcagttctttctctgaggtctgctcacctctgcacgtgtgtctagtttccagccctgtcgccttaccattctctttcctttacctgcatttcctgaactgttaatagttaacaatagcttctccctccacccactcactcatacctgaagtgagaagtcatcattgaggtctctgtggattttgtcagcccaacctggggcggcctcctggaggtggagttttcagatgagggatggacattttggtgtctgctgggtagatctacctgggagctttggcaggggccccagggcagctctgcctctttattttggctgtgggacccctggtgcactagggtttctcaagtaagcatctgtgtcctgggagagccataggcaggcctgagagggcccctggaatctgggacccccagcccggcccagtagctggtaccatcatctttcttgcaagggaagttatggaaactaagatgctaatgtgctttgataggcctggggtggctctaagccctgggaagagccctggcaactttccctggctggcgggtagaatcttctcctggcagttcagggctctgcctccagctccctgggggagagcaactgagggaggagctggaggccaaggcctcagtgctgagctgcctgcaccgcagctgcaccttctgggtcctggctgcaggaaccccatacttctccagcctttccatggttcccgaagacctggcctggggagggggtcagcagcctggggctcacctacctggcttcaaatcctggctctaccgcttactcgctttgcgaccctcataattgacaaaagccctctcggtctcggtttccttatctgtgaaatgggacaataacagtggctaccttataggattgtgtgatgatccatcagttataatagctcctgagcagcgtttagagtaacacctggggctcggtgcagtggcttatgtctataatcccagcactttgggaggccaaggtgggaggatcgcttgaggccaggagtttgaaaccagcctgaccaacattagtgagacccactctctaaaaaaaaaaattagagtaacgcctggcacagagagcccccagtaaacctcggctgctgtgatgagctttgtttcttcatttgttcattcattcaccagactttttgccggggcttgccgtgagccctacgctgctctgaagaaagccgggctggggtgagcgtgatggatgaggtgtctggcttcacaaaccctgtgtgggggggttgtggtgagaggaaaccgcacacatcattattcagttaccatcgtggggagactgtctggacgcagagagcaggctctgtgtgggagcggggagggcaagccctggttgcgaggcagggcttccccaggattcagcagggatctgaaggactttgcaggcacccagggagataggagaggaggagggagcagccctggccggacactgtcctcctagcattgcctgcatcagggactcactcagctttaagaagcccctttgtgggggacagggagcatctgttagtttataggacctgaagtgcccccatgggctcaagtttctgggaaggcctgcaggtggccgtagggctgccgcaggggtgctggccccagggtctggattcaggggagcctgcagagggagggcagctggaggctgctccagtgtgcattgttacgaggcaaagtaaggagactgctgggcccacgctgggccggggtggatggaggcaaggaagtcttcgccggggcaagggcaccagctgtagatgccggcagctttctcctggacacgggcctggaaggctgacagggtgtggtgagtgccaccggctcccctgccgtggcctggtcagtggcttcacaggcctccgtgggcaggaggaggatgaccttgcattctgcttggccaccattggcagtgacagacaaggtgtgtggggatgtggccatttcggtccgtgctctgagagccaggtgtgggttgggtttggggaagacaggggaatggcattgacttgaccctgagcactttgtcctggggtgcaggcccggctgtcactcccctggagctgggaatggcattgggcggtggctcagggtcccttgccccagcggcaccatctctgcatttggccagcaaggctgatgggacttgtgtggacatttctgggacgtagaccaggcagcatgacacacagggaggggtaggcagagaagggcggcccctgggtcttggtttccaagtcaggctttgcaagcctgctgtgtcaagccctctctcggcaccaggccaggtgggccagggtcagccctggggctgtgatgagtgtgagtgcccctaaagtgtgtcatgtccaatagctgcctcctctctgggcactgcctcccagccagatatcctacagcccccgtcccagccacagacagcaatctgattccctcatcctcggcaggtcctggggttggggtaagaatttgtcactaagtgcagatgttcccagagggtgctggctcagggctgcgtggattacagccctttcatccctgccttagacccacctgcaactctggagaaaagatggcccagtggacgcctgcggggaggagggagctggtccccaggatgagcagatttgggggcagtccccatcacgggaccggtgacctactgccaccagcgccagtgaatggcagaggggccctggcataaggcctgggttcagaatgggaacctgcagagaaactgtcaaggtctcccgccacctgacacctccgcctggctgccaccctagaaacacccttgctgcaagaagatgggggagtttgtctggggcatggtctggcgacaccaacttgagaacctcaggcctaagtgttggcctctgggcctcagctgtcctctgagctgtaaagctggctcctgggcacttgtggaaaacactggactctttattttattttactttacattctgggatacatgtgcagaacgtgcaggtttgttacataggaatacaagtgccatagtggtttgctgcacccattggactcttcaatccagctccactagaaatgactgccttctttcccttcttccgtccctccctcctcccctcccttttttccttccttccctgtttccttccccctccctccttcccttctttcccttcctctcccgtcctcatggggatataatttccatattacaccatccgccgattcagaaagcacagttgagtggcattttttcacaaccttctataagcatcacctctaattccagaacgttttcctcaccccaaaaggaaacgccatcctcggtacacagtcactccccctcccccagcccctggaaatcaccaatctgcgctttgtccctacagatgtacttattctgaacatatgactagaaccctaaaagatgtgactttttgtgcttggtttcttgcagttggaatgttttcagagttcatctgtgttggcgcacgctcgtgcctttttatggctgagaaatagtccgctgtgttgactcagcacgttgggtttctccacgcatctgttggcggatgtgttagttatttctggagccgggtgtgttgtgctactcacgggctgcactaggagctggggatatcactgagtaagccacagcctcgggcacccaggagctcgcagagcaggagctgggagggaggtcaggaggtgcatggcctgtttgccaggctggagagacttgcaaaaagtcactttgagccagaaaccagagcctgaggcctctgactcccagctgcggagccgggagggaagctctgcattttgctttgactgtggggtgacgtgtcagttactgtccaaatcagaacctttctgagagtcgacgtgggtactgctgataattagtctggatacccgaaagaatggaaagcagggacccagacagatccttgcacaaccgtgttcgtagcagggcgaggcctggaggtgcgatggggatctcaacggggcagctgccgtcttgctggagcccacggtctttggggggggtcacaggtgttaaccgcatatcatacaagcaggagtgtgaaatttcagggttgccaaattcagtgagggtcttgtgctggcctggccacttacagtggcatttcaggaaaaaaaatcactctatggacctcagtttccccattagtaaagagtaggttggactggaattctgtaccatccagtatagttgccatttatgaaatgtggctatttaaatttaaataaaaatagaaattccgttcctcagttggactagctcagtgtcaagtgctcagaagtcacttgtgaacacactgtggcaattcctcaaaaaacgaaaactagaaccaccgtagcatcccataattccacttctgggtgtggattcaaaagaatgcacagcatcttaaagagctagagatatttgtacacccacattcatagcggctctgttcacagtagccagcgggtagaaacaacccgaatgcccgcggtcaaatgaatggagaaatcaaaggcgggacaggccgggcgtggtggctcacgcctgtaatctcagcactttgggaggccgaggcgggtggatcatctgaggtcacaagttcaagaccagcctgaccagcatggagaaaccccgtctctactaaaacaaaattagccgggcatggtggcgggtgcctgtaatcccagctacttgagaggctgaggcaggagaattgcttgaacctggggaggcagaggtttcggtgagccgagatcgcgccattgcactccagcctgggcaacaagagcaaaactctgtctaaaaaaaaaaaaaaaaagggtggaacatacaaggaatttgactcagccgtaaagaggaagttaggatacctgcaacagcaagggtgaacctttcgggtattacgctaagtgaaataatttggtcacaaaaggacaatcctgtaggattccacttataccaggtccgtagagtagtcagattcagaaaaacagcagaatggaggttgccagaggcttgggggatggggctggggagttgtttaatgaggacagtttgttttacaagatgaaaaagttctggagatttgttacacaacaatgcgaatgtacttaacaccactggactgcacacttcaaaatagtgaccgtggcaaacgttatgacaattaaaaggaaaagtcacgtggccagtggctaccacgctgagcagcgcaggcctcggacggtgtcgtggtcacagacaatggagtgggtgatctttaccattgtttccagctgtctgagcaccatggtgtcctggggccaggatgaaagtgtctctgggtatgggggtctctgcttttcccacttgggagtcctgaaggcagaccccaaagctcacctggccaggtaggagagcgaggcgggctcttgcattgctctctgcgtgcgtgcctgcctgcgggccagccggggcctgcaaggccgcctctcgagggaggggttgcaggaatggctctcacctgtgcagaaggcaagccactgccctacgtcaatggcaaagatggggctcggctgcgttgtattattatttctcaagcggggcccctggtgggcaggatgtttggtttgatttgagtttctgcagtgagtgctggtgcctgtggagggacccagctgcagctgagccggcccctccctcgctctgggctccaggggcgttgggggcgagaaaggagagttcagggggcagcgcctccccccaggtcctgctggggagggttgagggatgctggggggaggtgggggcgggtaggggctggtcccagtcccaggcaaaatggctctcagacccacaggcagatggaagcgattttcggtcacgtgggtggggactgaactgctgccccgcaaggcaaggccccatgtctggcttcaggaagcggccccaaagccacatggtccatggccagatgcagggctgtgtctttgtttatttaaaggtcctggaagcccaggggagagtatttctgaagggggagcaggagcaggagcaaagccctgaaggcttccaggctgcgtggcctgggtgggggccacgtgggggcacagagagaggagccctggcctccaggtccgcctgtgggtattgctctcagcagtggagatgtgtggacccccccttggcatttcccaacaaggaattatattgttcctttgttcccccaattccataagataggaattcctgtgccctgtggaggctgagaagacggggaggtgcctgtgaggataaaccagcccccagtttctggcttccagagtcttttcctctctcacctctgatgcctcaggcctggggagcctccctccgacaccctctgaccgctccagtgaaataggccgagagggatggcttgaatcggctggggatgcaggctgcagccagggggctcagtgggcatttcctgagttcggttcttgccccgcaagtggaagggcagttgaactgaagtctcccactgcccctcctggcctggaagcctgcctcccaccttctgggcagagtgaggagtgggcgtgggccgggagggctgcctcctgtctgggagggctgctcacttgcctgtcacgggggatgagccccctgcagcctcccgtgctgtggccctggctcccacgccggctccactcccctgtggctgcccctgctgggtgcccaccggtcccagggaaaagccactcccctcccggaggactggcgggaggggccctgcctgggagcgtgccgtgtggtccctgtcttagcgcaggatgcctgaggccagatcctccctgggaggcaggatggggcaaaagtctccccgcaggcagagcagggcctggatgggcccaagcagggacgggggcacagaacagcagccgcccagcctgcgtgggagctgagggccaccaagggcagctccagcctgtggggactagcagaggcaccacctctgtgaccagcgagttgtctgcacctgcatgcgcatgcaccagtgagtgtggcgagtctgaggtgtgctgggacctggcccgtgtaccagccagccctgatgggaaccagccccatcctgggtacccctggaaccccactgtgtgggagcacctgggtcctcagcaggcgtcttccgggcgtccgcccccagccccaggcctctgacccgtgtgtggtgtcttaacagcagccaggagcagggccatcgaagggacctacagacagaagaggctttagtgatttcgggaagttcagctccacgtgccccacatacccaagagtaaaacttggtcttggcctgtgggtgtgcagcccgtgggcgctggccaggcacacaagacggccgcctgggtcagtccagggggaggcagatgtggtgcaggggcccccctcctccatgagcccaggaacagctctgcatccaggcacccgccctgcacccagcacttttccttctcccaggactgctggctcgttctatgggattgaacacacaactccatggggaccgacgctggttctatccccctttcttacaagaccatccatggggatgtgggaggcggggacacacgctggttctatccccgtttcttacaagaccatccctcctgtgtcttggctcgtggatcggcttctaaggcctttgagtggcagcaggcggtacagcttatctgagtagaggtgaaggagagggccaggtccacctgggtggcccgaggcagtgtggagggccaggagaggagagcaccctccacccttgtctgagcagccctccagggtacggagacaggagttcagggtcagccctgccttggagcgcagggggcccccagcttggcacagctcctagaagaggagatgaaaaagcctggccttgggagtctggggatggagctttgctggggaggcagcgtggctgcaggatggcagctttttagaggacaccacggccagggacatccacccgggggaattctcaggggtcgcctgggcaagtcgcttagcctttctgagcctcagtgcctcagtttccccatccaaggatgggtgtgacaaccacctggcaggcgcctgtgtgtgagcccctgttccgctctaactcctctgctgttccttccccagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcggtgagtcctcaccttgcatgccactcaaccaatgccggaaaccagcctcagcccccagggcggcccacaagcctttgggcttggtcttcccttctgtaaaatggggcagcaaccctgacctcaaggacggattgccagtgacattgcgtgtgcatgcatgcgcctgggaggagcccacagcctccagcggctcctcagaggggcctgtcctgcacatccagggcccctgagatgactttggggagcccaggccggcctggagcaggtcctgatgagtggtcgctgcctctgagcaatgacgtcagcttgtgcagagggttctgtggcagctgtcccctcactgttgctccagcctggccctccaggctccccaccgcaccccaccgcaccccggccagaggcttcccagcagctcagcttcagctctgccctggaattggggcctcgtggcttccacaccccctggtggccccggagagctggaggtcaccacgggaggtcgtcgatcagcacgacctgggcagggtgagggggccaggctggagtctacagtgggccgcctgttgtttccaaagccccccaggtcccattcaaacctcacagggaccctgtgaagggggcgtcccgttttccaggcagaagcgaggctcagggaaggctgccaaggttccttagctcacagggcagagaaccgcagccaccgttttgactcccagaactgtgttctgcccactccacggggtccagggaggggtctggggaagtgcccccgccaggtcacaccctaaacaaaggtgagcttgcggggtttctgcaaggtgtctgggcacctctcaggccgggcctgtttctctgacctttgccagccgtgcacgtccttcctgcccagctctgtggacgcaaacccacacctgccagcccgacacctttctttcctcttctgcactgatctgggccctggctcccctggggtcttggtgtcctctctgcttcctgtagcctcatgggacccggctgctcatggccctgctgtgctcacagctgcctggaagctggcagcctgcttcaagggagggcggaggtgtggggtcccctcctacggcccccaccctgttctgcctgttgtgggggacgtgcttgtaccctgaggattcagggctgcctcccgggaagatggctggagagaaagagaggggagaggcccaaaggcagtggccaggctgggactcatctctgtgggctacggaggggctgccctgctccctagccagggacagggtgagaaggacctgggaacctctgcgtcccagccatggcacaggccttcttccggagctttggccccaaggagagggagaggcagcccagcagccctcgccttccgtggctgccactgtgacagccttgccctctgggaatggtgcgcaggaggccacttcacctgtctgggcctcttcgccctttcaaccctgagaagaacagtggtcctgattccccacaaaatcactccctcccagggatgccgagtgaggaacaagacgtggggcagctctgctctcctccctcctccctcccatggcagctgtgcccacctgcagaggtgcaggcaaggtggaggggcacctgtttggaggtccacagaccccggggagaatcccagctttgtcctaactcagcggggtgaggcttgtgtgtcttcccctgggctcctcctctgtgagccttagcttcctcgtccataaaatgggatcatcccataaagtgagatcaagcgagctaggccccgggcagggtccccaacaggttgtggttgttcgagaatttgcagcagtggtgatggtggttgtggtgatgaggatgatgggggtggtaatgacggtgatgatgatggggtgatggtgctagtggagatgatggggatgatggtgatggtggtggtgatagtggtgggatggtagtggtgatgtgggtgatggtgattgtgatggtggtggtggtggtgatggaggtgatggtgatagtgatcatgagggtgatggggatggtggtggtggtgatggtgacagtggtgggatggtagtgatgatgtgggtgatggtgatggtggtgatggtggtggtggtgattgtggtggtggtggtgatgatggtggtgatgatggtgattgtggtgatggtgatggtggtaattgtgatggtggtggtggtgatggtggtgatgatggtgattgtggtgatggtggttatgatggtggtaattgtgatggtggtggtgatggtggtgatggggatgatgatggtgattgtgatgggggtggtggtggtgattgtgatggtggtgatgtgggtggtggtggtgattgtgatggtggtgatgtgggtggtggtggtgattgtgatggtggtggtggtggttgtgatggtggtgatgtgggtggtggtggtgattgtgatggtggtgatgtgggtggtggtggtgattgtgatggtggtggcgatggtggttgtgatggtggtgatgtgggtggtggtgattgtgatggttgtgattgtgatggtggtggtggtgatggtgatgatggtggtgattgtgatggtggtgatgggagtgatgctggtgattgtggtggtgaagggggtgatggtggtgattgtgatggtggtgaagggggtgatggtggtgattgtgatggtggtgaagggggtgatggtggtgattgtggtggtggtaatggtgatggtggtaaaggggtgatggtggtgattgtggtgatgtgggtggtggtggtgatgtgggtggtggtggtgattgtgatgggggtgatgatggtaatgtgggtgatggtgattgtggtggtggtggtgatggtgatgattgtgatggtggtgaagggggtgatggtggtgattgtgatggtggtgattgtgatggtgatgtgggtgatggtggtgttgatgggggtgatgatgttagtagtggtggtgatagtgatggggatgatggtggtgttgatggtgatagtggtgggatggtagtggtgatgtggttgatgatggtgctggtgctgatgattgtgatgacagtggtggtggtgatgagggtgacggaagtggtgatgatggcgggagtgatgggatgatggtaatagcagtgatggtattgtgatgatggtgctgatggggatggtggtgatgataagggtgatgatgatggtgatgataataataaaagtaacaataataaagggatacaccttgcagtatcccagttggcatctcctagatctaaggtgtcgtggctggaacattgacataactcctgacctgaggttggccaggacacagacctggtggacagagagagatggacgaggagtgtccgtccttgggctactaaacagttcaggccagggattcccagcaccagcctctgtcctcccaggagcccacacttttcctagaaaggtgttatcaaagtcagaacatcagtgtaatttagggtgttttttgtgttgtgtttttttgagacagggtctcattgttgcccaggctggagtgcagtggcatggtcttgactcactgcagcctccacatcctgggttcaagtgattctcgtgcctcaggcatgtgccaccatacctggctaatttttgtgttttttggtagagacagggtttcaccatgttggccaagctggtctcgaactcctgacctcaagtaatccaccctcctcagcctcccaaagtgctgggattacaggcgtgagccatctcgcctggccgatttttgtttttttaaaagacagggtctctgtcactctggagtggcaatgatcctagctcactgcagcctcgcactcctgggcttgagcaattctcctacttcagcctcctgcgtagctgggactataggtgctcgccactacacctagccaatgtttacattttgatgtagagacagggtctctctgtgttgcccaggctggtcttgaactcctgggctcaagcaatcctcctgcctcagcctcccaaagtgctgggactacaggcatgagccaccacacctggcctagggtattttttttggtgtgttgctagcgtagcccaaggcagctctgtgcagggtaaagcaatggggctccgagtctggaggggtgtgtgtgtgtgtgtgtgtgtgtgtgtgtgtgtgcgcgcacgcgcgcgcgtgttatatgtgatttgtttgtgtgtgttgtgagagttgtgtgtgaggtatgtgtaagaggtatgtttgaggtgagttgtgtgtgtgttgtgagttgtgcatgtgaagtgtgtgtgttgtgaggtgtgtgtatgaggtgtatgtgagttgtgtgtgttgtgttgcatatgaatgctacttcctcatcctcgtttgtctcagtcacctgtggactggctgtctgcacacacggtcactgtccctcgagtggcaccaccctgcaggccagcgccccctagcacatggccccacagaccccatgggacatgcgtgagcctgcctgatgctcacaccagctccacgggggaaggactgtttatcccattttgcagatcaggaaactgagacacggtgaggtcaggtgacttgcccaggccctggccggtcagggaggagcagtttgaacacctgggctttggttgcaaccaccctggtgaactgcaggaatcccggccacctggtgcaccctgggcagccctgggctcctccgccagcccggcctctgtcctgtccaaaatctgagccaccaggagacctcctgtccagaaagcacaaggggcacaagagatgccgactctcccaggcccggctcacctctcaggagaggactgtggcctgggttgtgctggcatcagagcccggctgtgtgggtttacacagtcactggacacccggctcgagggtgaagtcctcgggggctgcttggcagggatattgccgggaggtagcccaggcactgctgaatctcagactggagagcctcgtgcctgggtgggaggggccccatgtgcagaccctgctggtctctccggagagacccctgaccggcctcccatcctctccccagggcagagcggcttgggtaaatccaccttaatcaacaccctcttcaaatccaaaatcagccggaagtcggtgcagcccacctcagaggagcgcatccccaagaccatcgagatcaagtccatcacgcacggtcagtggccgggagtgggctgggggtgcaggacgcccctgccttcctggagcacaggggttgggggtcaagaccatcacacacagtcagtggccaggggcgggctgggggtgcaggactcctctgccttcctggagcacagagtggggggtcaagaccatcacacacagtcagtggccgggagtgggctggggatgcaggacgcccctgccttcctggagcacaggggttgggggtcaagaccatcacacacggtcagtggctggggatgggctggggatgtgggatacccatgccttcctggagcactggtgcggtgtgagggtgcccgagtcaggcaatcccaggtccccaagacggggactcgctgtgcccaccatccccagcatgttgagcatgttggggctctggctgtgatgggtcagtgtcccggacccctgtgggccccgtcacactgagctccccacagacaactgagttttccaccaaaagtctgacaggcaaggggctcccaggggaaccgtcaccggcctgtgccggagttggctgaggaaggccattaatttcccggtgtctccttggttgtcatcgctgcctacctggggttgccccggggtcagtcaggtgtggggtgtctgtgagggtcttccgtctcccctctgactctgcgtccgtggctctgtgcagatattgaggagaaaggcgtccggatgaagctgacagtgattgacacaccagggttcggggaccacatcaacaacgagaactggtgaggcccctccagggggaggagcactagcgggggcttcagggctccctggaccccacccagagtcagccctagaggtttcccggcccgcgggggtgcagggcccacctcctgggacctgacatgctgccaaagccgcacgtctcaggggcctgaaaattctggaccaaagcagaattacctggggaatcttgctgtccccaactcatcacctgaggccagcccggggaggctggtttgggaggccgagggtaaggctgtggcatctccgctcagcaagccagacctcccagggcatgcatttcattggaaggtggggtgttgggctctgagtcctgggaatgcacgacctgcttggggagggcatctcatgtgcctgctgactcgtccccatcccccacgcagctggcagcccatcatgaagttcatcaatgaccagtacgagaaatacctgcaggaggaggtcaacatcaaccgcaagaagcgcatcccggacacccgcgtccactgctgcctctacttcatccccgccaccggccactcgtacgtccctgcagtgtcggcgtcctcatgccgggtgccctgggttccctctgtcccctgggactgcaagacggtgctgtctgccctgctgctgggtgcagaggggctgagtcaggggccatggccgccagctatgaagttgggggtgtgccatgtctgcacctccaaagcctcacactgacccctatgcaagtgtcctgcccagcccccatccttcagctgcgtcttggggagctgagggtcaggcaggccctgggctgttctggagcctggtggtctgtgtcctgccttctcaggccaggctctggcaggtggagtgggagcccccagccaagcacccgtagcggtgactgaccttctcatccgggccctgcctcatgggaccccttagagggtttggtgcgttcttagacgggaagcacagagatcagtgctggccccttccagggctggacggggctgctgttggtgttggtgagagccctttcctcccgccggctctgtccgcacctgacgtcgcccctagagatcagcaagggcgggaggctgcatgtaccctggcaggtggactcttcatggcctcacggaccctctgtcctcagctccctgtgcaccccctgccagacacctgtggctcaccctgagccagggctgggaggaggaggaccagaggccagcaggagtggctggtggaggcagccgtgggtggcttgtctgcatgggtgggtggagaaggtccttcgcacctgctgtcccagatgtacttccctgggcggaggaagcccaggggtttggggaaaccatactctgtgggcaccaggtgcaggaaggagcctggctggtgggcagcgggcctcacccagagtctgtgggaaaacccaagccggagttttcgagcccaccctctggcatcatcctctgtgggccagcaggagtcaggggcagggggccagcccgctgtccatgggcctctcctgaactgaacatctgccctcccaggcagaacggctcacctgcggtcctgtggcagctgttccagctgctccaagctttgcctcagctgaggctgatggcaggaggcagaagcctctcctgatgccagctgggcaagccgagggcgggcgggcggtctgtggcacttctgccactccccagcactgaccctttggctgggactccagctaggcatgttgcctggtcccgcccaaggcgtccagtcccatggggcaggggcgggccttggccatctctgcttaaacttctgcccggagcgggcttctccccagccatgtgtgtgaccgatttattctcactgtgggaaaagctcggctccagaactggggaagatggtgccccagttccagggccctgccagcccctgccacccacagctttccccacatcagaccccaggctcactggggccaagcaggcaaggggagcagcccgcctggtgcaggggagcagcccgcctggtgcaggggcaccgcacactggtgctagcttctatttctcttgcctctcccctcccagccaaagccccacagcaagacggctgctgagccaacgacagcccttctgtgtggacatgtaggggtgtggttgggaccccagaactcatggacgagggtgcttggagctggccctggcccgcctggcctgtgcagtggtgtcacctgtgtctgggacacacccgtgtccttcctctgccccacactcacagcgtggccgactcggcccggggccctgtccttgccagcagggacccccgtgagccccgagccagcacctgagagtgtcgacacctgcttgggggtgggtgcccccccactgccccgctcccccagatgagcctcacgcacatccctctgcttcagcctcaggcccctggacatcgagtttatgaaacgcctgagcaaggtggtcaacatcgtccctgtcatcgccaaggcggacacactcaccctggaggagagggtccacttcaaacagcgggtagggttccatctctacttgccccagcccttctgtgcaacctggagacgctgcaggcctggcaggggccaccccgtctaaaggagtcacactgtcagggagaccgaaccgctggtcactctccccagcgggtggctggcctggtggtccctggcccaggtggctgctgggggccgtccctgagatggcctctccagctcccccatatctcaaaagcagctttgtgggagtgccaattctccagcagagtctctgaggggggttttggagaagacctggaccaggcagatggtgaatctctcttccagggagtgaggccgagcaggggccgtgcgacatggcccaccttgttttatgccccccctttttttttttgagaaagggtctggctcagttgccaaggttgcaatgtagtggcacaatcatggctcactgcagcctccacctcccaggctcagtccccgagtagctggaattacagacgcacaccaccatgtctggctaatttttgtatttttagtagagacgaggttttgccatgttgcccaggctggtctctaacccttgggctcaagggatcctcctgcctcagcctcccaaagtgctggggttacaggcatgagccacctcacctcgccctgcctggtttttattagatggaagagaagctgggccaggtgtggtggctcacgcctgtaatcccagcactttgggaggccgaggcgggcagatcacttgaggtcaggagtttgaggccaacatgatgaaaccccatctctactaaaaatacaaaaatattagtcgggcatggtggcgggcgcctgtagtcccagctacttgggaggctgaggcaggagaatctcttgaacccgggaggcggaggcttcagtgagccgagattgagccactgcactccagcctgggtgacagagcgagactccatctcaaaaaaaaaaaaaaaaaaaaaagtttcaggagggatggtctctgccaccttcttctccgccaccgtctgaggcccctgctgtgggatagggaggggcatccaagcaagagggcagccctgggctcttcctcctgacagggcagcacatcagagccacatggggtgcctttcaaaatgaaaccgaggtgcctgggctgcggcaccacatctgcctcggtgggtgtgggtggggcctgtaacctactccgtcctggggccaggtgtcagggaccttcccagcatgtgcaggggaagacagtccacacaaagtgggtgtgtctgccggaggctacacacgggctgtggtctgtgcctgggcaggcgagcagccgctcactgggatgtttctgttgcacgtacccatgtcgggctgctggcagggagctgagaggttactgcaggcggggcccctgctggaactggggactgtgacgagggttttttaggaagggtttcaggaggggaggtctcggtaaccctgagtactttcttggggctgtgatgagcaggagaagagaggtgggaggtgctcaggacgatgaccttaagcccctggggagttgcagcgtcgctcaggacagcaggtgcacctgcagctgcccctcttccctccaggaggcacaggagttggaggtgattggtgtcacagccccccagagcctgcccttgaacccgagcctggggcagcacacagtgtggaggtcatgtggcaaacaccagtgggtgggtagagcttgccacagggatgggcccatctctctccctccttatcccagatcaccgcagacctgctgtccaacggcatcgacgtgtacccccagaaggaatttgatgaggactcggaggaccggctggtgaacgagaagttccgggtgagtggatccactaggatgttgttcccaggggacccccagttcctgctgaagggtgggttgggggtttggaggaccttaagccatgaaattatattcttggggccagagggcactgagcccaggtgtctgtacccagtgctgtcaggctgaggctctcgtttttgggggaccccaggctcagggcagctcctcccgggggcccaggggagggaattgccttcccgcacatgtgtaaccaataccgtctgcccgttccccaggagatgatcccatttgctgtggtgggcagtgaccacgagtaccaggtcaacggcaagaggatccttgggaggaagaccaagtggggtaccatcgaaggtactcgccgcaggcgccggggctccagacagatgggaagacagtctcttctgctgacccagagcctgtgggccacgcctgagccagggactcgtggaacctcatccactgccttgccccacccagagggaggggtctccttgtccccattcaacccttgggaaagtgagagggcaagtggcctgtgcagatgcctccaccccagacctccccccgggcagggaaagattcagggagacaggagctgggatgggggccgccaagttctggatcctggtgcaggctctttcataggcacctgtgtggccctggacaaatcgcccaacctctctgggcctagaaaaggggtgggctgtagctctgtgagccagatggaccctcggccccttaccctgctgaagttcctgggaccctcacaccttagtctcttgagtggctgttgtaaccaattagcacaaacgaggggacttaaaacaacacaaacgtattttcacagttccagaggccagaggtccgaaatcaggggctgtttccttctgaggccctgaggaccagcctcatccatgccttcctccttctggtggcgcctggcattcctagttgtattgtaaaggcatcacatgctctaatctctgccccattgtcacagggccttcttccctgtgtctctgtcccgtccctcctcttcctttttttttttttttttttttgtttgagacggagtctcgttctgtcacccaggctggagtgcagtgttgcaatctcagctcactgcaacctctgcctcctgggttcaagtaattctcctgcctcagcctcccgagtatctgggattacagtcacgtaccacccacctgacttaatttttgtatttttagtagagacaggatttcgccatgttggccaggctggtcttaaactcctgacctcaggtgatctgcccaccttgcttggcctcccaaagtgctgggattacaggaatgagccaccgagcctgccctctttccttcttgtctttggacaaggatgcctgtctttggacttagggcctaccctaagtggatgatcccatttggagatccttaatgaatctataaagaaagacgttttccaagtaaggtcacaatcatgggttccaaggcctggaccttgaccatgtctttgaatggatgggagcccctggggggccacagttcaacccactcctggcggtgacaccccgggagggatgggcccgaacgtttccttccccttcctctctctgtcccttcatttctcattagaatggaagaggggaaggtgcagagggaaatgcagcaggaaaagccactttgttctgggagagcacttggctgaaaggcccagtagagcaggaagcacaagtctcttaatcttccagggcctcagttttcatcatccacaaagtgggtgcagtgtgccaagattttagtgagttgagagactgtcccaaagaccacagagctttttgggaagctgttgctctaaaaaaatggtcataatgacaattaccaggaggcatcagacactcctgtgccactggctagacatgggttatctcgtttcatgtccgaagctccccgcacccaccctccttgcagagttgaagaggtgctgtgagcagaaaacctgccaagggacccagaacgggaggcggctctagaatctacagctccagccctgcaccagactccctcgagatgggagttcatgcctggaggagggtgtggagaggcacacgggcctttcccctgtctgcactcctcccctaccaccacccctgccgggcccaccctgcgggagctgcccagctgggtgcagcctgggtgttttccagtatccgcctgtggtgtcaggctggcttgcctccccttggcccctctgcctgcagttcctctcttcctctctgcccaaagagttcttgctgtttaggaaactttttatgaaaggcaggtttgggagagttagggatggatgggcctgggacgggccggcggctttgctatgggcgtgcctctgctgcaccctggtggccaaccttgagtaccgcaggtggccggtgacagaaactgtcaggaaatgcacaagagagaggtccccgcacctctctgacctgtgcgttgttgagcaccactggctccagctgaggaagagtctggaacctgtcaggacagttgtgaggtggtggggcccactttccagcagtcttatatgaggaccctggaaatgtgccttcagcactgctgggtttttatatcaggggccccatgagttcatagctgacctgacacccggactagtaagggctgtgccttgttcttgcctcccacttggtgaacagcatcttgaggtatctttcccatccttagaaaccaccccaagtattgtcaatagaaatgtggggtgtaattgatcacgccatgaactcatttaatcctcatgtccctgagaggcgggtgacgttattatccacattttatggatgaggaaactgagggaatgagagtaacttgcccgagccagggagtggcgatcacacactccaactccagcctgagagccccattcttcctgccggctctcgctgcccgtcagtgttagatgagagtgctgctggtcagtctgcaggaggttctagtgtggacaccgccctacacagggccgtggcaggagggcctaggcaaaggcaaccggcatagcactgagagcacttgagggctgggcaaggtggaggccccggccctgcctgctggcctaccaagtaaaaactagacatttttaacttggggaaaagccatgtggctctgcgatggggcagcctggagccaggtgtatgggttctgcatcccgctccagccttatgcactgtggagctgagacagacacagttcttgcgttctctatgcctcattttcttttcttttctttttctttttctttttttttttttttgagacgaagtttcactcttttgcccaggctggagtgccgtggcgtgatcttggctcaccacaacctccacctcctgggttccagtgattctcctgcctcagcctcctgagtagctgggattacaggcgcctggtaccaggcctggctaatttttgtatttttaacagagacgagatttcatcatgttggccaggctggtctcgaactcctgacctcgtgatccacccacctcagcctcccaaagtgctgggattgcagacgtgagccgtggtgcccagcgtctacgccccattttcgtaagataatggggataacaaaggaatcacaagagacacttgcaggtgtgtgaagacgaagttcatcacatgggagggcaccgggtgtctttatttgccttccctgcccggctccccacctccagtgatgccgttcactgccctccttgttaaaaggccttctgttatataacagttacacatgccaggcaccgcgtgttcatataggagttacgaagcacagcaataaaatgaccactctgagatggccaccagctcgagcccgagggcacttgtgggtgcccgtggtctcctgcccagtctccctgagaagtggccactgtcccgagcttgggcttgtatgtattgtgtgaagtgcacatgtccctgagcaatgtttagcattgctgattcttgagcttgtgaatggtcgtccacagtacgtagcccctgtgtgtgtccctgtgtgtgtgtgctctgagcgcacacaaggtggatggggccgtgggggtaacaccctgtgggccacaggttttctttaaaatcccagctccgattcctgcttcatcccattcccagcagcccagccccctgcctgtcttcaggcccctgctgggacgtcctgctctccctggtcaccccagtggtgcgggggcccactgccctggcttctccactgtggcttccttccatgctcctatttggcctggtcactgtgccatctcccattagccaggaactttctggagagcaggagctgagctgtccaggagcaggagctggtgctggtcactccagtatcccccagactgagggcagtgccaggtgtcctatactcagctgcagagcaggtggttcccctgccctcctgcccatggggctgccctcagactctgcttttggcaccagcatttctgggcagggggagagaggtggggtccgggcagagtttctccactgggacattaaagcccctcctgtctcctctcctagttgaaaacaccacacactgtgagtttgcctacctgcgggaccttctcatcaggtgagagacagggtgcttgggtggggctgacggcttcacccctaagagggccctacagcgggtgggggcagtgggtgtggggccgaagccctgggcagagtgggtgccccctgccacctgcctgccctgccctcgggaagatcttggaagcccatcttctgaaaaagaaaacccactgggaaatgaagcaggcagtgaagatccttttcaacccctgcgaagttggctggatgggaaggctgagctttgatccactgtggtctggcccgttagagctgcccggtggccactaagggcccagtgaggcctcatgtgcaggccctgccggcagcgtggggcgtctccagctccgatcccactggcctctgacccctacccctttcacctggctgaggcttctccttgtttcccttgagtccaggcaaggaggggaagccctgatggagagggtgctgggtgggtggtccctggagtgtgggccctggcctgggcaggttcttcctcagcaagcagctggcatggatgatgggaatgttatcaagaggaggggcctccaggttggcgggggcaggggtggggggattccgggagccgttctgccattgtggggatactgggctttccaacctccctccagattattcctcctgagctgcagaggaatgaaaatccgagcccaggacttttttttcctggggacaagggcaacccagccctttgccccaggccacctgcctgccacaggccatagtcctggaggccggtggtcacccactgcttccaccctgccagcaccctggacaccggcctggagcaacaatgctccagccctgtccctctgagtctatgcactgtccctgggccctggacccagggccatagggtggacccagagggagacacatgcactggaatatgtgtgttctgaccgagtctgggcttaccagggggactgacccttcccccaaaacgtgtaccagatctggtccaacatggtgggcctgggggaccccatggggagccaagcagtcgggatggggagtgggggtgggggcaggcgggcctgagtccgaggcaggccgagcagggcccctgccccgctgcccccaccccgctgcgcccacctcactgacccgcccgccccccacccccacaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccagaa

SEQ ID NO: 1832 - DNA, 25355 bp, Homo sapiens
cagttaccatcgtggggagactgtctggacgcagagagcaggctctgtgtgggagcggggagggcaagccctggttgcgaggcagggcttccccaggattcagcagggatctgaaggactttgcaggcacccagggagataggagaggaggagggagcagccctggccggacactgtcctcctagcattgcctgcatcagggactcactcagctttaagaagcccctttgtgggggacagggagcatctgttagtttataggacctgaagtgcccccatgggctcaagtttctgggaaggcctgcaggtggccgtagggctgccgcaggggtgctggccccagggtctggattcaggggagcctgcagagggagggcagctggaggctgctccagtgtgcattgttacgaggcaaagtaaggagactgctgggcccacgctgggccggggtggatggaggcaaggaagtcttcgccggggcaagggcaccagctgtagatgccggcagctttctcctggacacgggcctggaaggctgacagggtgtggtgagtgccaccggctcccctgccgtggcctggtcagtggcttcacaggcctccgtgggcaggaggaggatgaccttgcattctgcttggccaccattggcagtgacagacaaggtgtgtggggatgtggccatttcggtccgtgctctgagagccaggtgtgggttgggtttggggaagacaggggaatggcattgacttgaccctgagcactttgtcctggggtgcaggcccggctgtcactcccctggagctgggaatggcattgggcggtggctcagggtcccttgccccagcggcaccatctctgcatttggccagcaaggctgatgggacttgtgtggacatttctgggacgtagaccaggcagcatgacacacagggaggggtaggcagagaagggcggcccctgggtcttggtttccaagtcaggctttgcaagcctgctgtgtcaagccctctctcggcaccaggccaggtgggccagggtcagccctggggctgtgatgagtgtgagtgcccctaaagtgtgtcatgtccaatagctgcctcctctctgggcactgcctcccagccagatatcctacagcccccgtcccagccacagacagcaatctgattccctcatcctcggcaggtcctggggttggggtaagaatttgtcactaagtgcagatgttcccagagggtgctggctcagggctgcgtggattacagccctttcatccctgccttagacccacctgcaactctggagaaaagatggcccagtggacgcctgcggggaggagggagctggtccccaggatgagcagatttgggggcagtccccatcacgggaccggtgacctactgccaccagcgccagtgaatggcagaggggccctggcataaggcctgggttcagaatgggaacctgcagagaaactgtcaaggtctcccgccacctgacacctccgcctggctgccaccctagaaacacccttgctgcaagaagatgggggagtttgtctggggcatggtctggcgacaccaacttgagaacctcaggcctaagtgttggcctctgggcctcagctgtcctctgagctgtaaagctggctcctgggcacttgtggaaaacactggactctttattttattttactttacattctgggatacatgtgcagaacgtgcaggtttgttacataggaatacaagtgccatagtggtttgctgcacccattggactcttcaatccagctccactagaaatgactgccttctttcccttcttccgtccctccctcctcccctcccttttttccttccttccctgtttccttccccctccctccttcccttctttcccttcctctcccgtcctcatggggatataatttccatattacaccatccgccgattcagaaagcacagttgagtggcattttttcacaaccttctataagcatcacctctaattccagaacgttttcctcaccccaaaaggaaacgccatcctcggtacacagtcactccccctcccccagcccctggaaatcaccaatctgcgctttgtccctacagatgtacttattctgaacatatgactagaaccctaaaagatgtgactttttgtgcttggtttcttgcagttggaatgttttcagagttcatctgtgttggcgcacgctcgtgcctttttatggctgagaaatagtccgctgtgttgactcagcacgttgggtttctccacgcatctgttggcggatgtgttagttatttctggagccgggtgtgttgtgctactcacgggctgcactaggagctggggatatcactgagtaagccacagcctcgggcacccaggagctcgcagagcaggagctgggagggaggtcaggaggtgcatggcctgtttgccaggctggagagacttgcaaaaagtcactttgagccagaaaccagagcctgaggcctctgactcccagctgcggagccgggagggaagctctgcattttgctttgactgtggggtgacgtgtcagttactgtccaaatcagaacctttctgagagtcgacgtgggtactgctgataattagtctggatacccgaaagaatggaaagcagggacccagacagatccttgcacaaccgtgttcgtagcagggcgaggcctggaggtgcgatggggatctcaacggggcagctgccgtcttgctggagcccacggtctttggggggggtcacaggtgttaaccgcatatcatacaagcaggagtgtgaaatttcagggttgccaaattcagtgagggtcttgtgctggcctggccacttacagtggcatttcaggaaaaaaaatcactctatggacctcagtttccccattagtaaagagtaggttggactggaattctgtaccatccagtatagttgccatttatgaaatgtggctatttaaatttaaataaaaatagaaattccgttcctcagttggactagctcagtgtcaagtgctcagaagtcacttgtgaacacactgtggcaattcctcaaaaaacgaaaactagaaccaccgtagcatcccataattccacttctgggtgtggattcaaaagaatgcacagcatcttaaagagctagagatatttgtacacccacattcatagcggctctgttcacagtagccagcgggtagaaacaacccgaatgcccgcggtcaaatgaatggagaaatcaaaggcgggacaggccgggcgtggtggctcacgcctgtaatctcagcactttgggaggccgaggcgggtggatcatctgaggtcacaagttcaagaccagcctgaccagcatggagaaaccccgtctctactaaaacaaaattagccgggcatggtggcgggtgcctgtaatcccagctacttgagaggctgaggcaggagaattgcttgaacctggggaggcagaggtttcggtgagccgagatcgcgccattgcactccagcctgggcaacaagagcaaaactctgtctaaaaaaaaaaaaaaaaagggtggaacatacaaggaatttgactcagccgtaaagaggaagttaggatacctgcaacagcaagggtgaacctttcgggtattacgctaagtgaaataatttggtcacaaaaggacaatcctgtaggattccacttataccaggtccgtagagtagtcagattcagaaaaacagcagaatggaggttgccagaggcttgggggatggggctggggagttgtttaatgaggacagtttgttttacaagatgaaaaagttctggagatttgttacacaacaatgcgaatgtacttaacaccactggactgcacacttcaaaatagtgaccgtggcaaacgttatgacaattaaaaggaaaagtcacgtggccagtggctaccacgctgagcagcgcaggcctcggacggtgtcgtggtcacagacaatggagtgggtgatctttaccattgtttccagctgtctgagcaccatggtgtcctggggccaggatgaaagtgtctctgggtatgggggtctctgcttttcccacttgggagtcctgaaggcagaccccaaagctcacctggccaggtaggagagcgaggcgggctcttgcattgctctctgcgtgcgtgcctgcctgcgggccagccggggcctgcaaggccgcctctcgagggaggggttgcaggaatggctctcacctgtgcagaaggcaagccactgccctacgtcaatggcaaagatggggctcggctgcgttgtattattatttctcaagcggggcccctggtgggcaggatgtttggtttgatttgagtttctgcagtgagtgctggtgcctgtggagggacccagctgcagctgagccggcccctccctcgctctgggctccaggggcgttgggggcgagaaaggagagttcagggggcagcgcctccccccaggtcctgctggggagggttgagggatgctggggggaggtgggggcgggtaggggctggtcccagtcccaggcaaaatggctctcagacccacaggcagatggaagcgattttcggtcacgtgggtggggactgaactgctgccccgcaaggcaaggccccatgtctggcttcaggaagcggccccaaagccacatggtccatggccagatgcagggctgtgtctttgtttatttaaaggtcctggaagcccaggggagagtatttctgaagggggagcaggagcaggagcaaagccctgaaggcttccaggctgcgtggcctgggtgggggccacgtgggggcacagagagaggagccctggcctccaggtccgcctgtgggtattgctctcagcagtggagatgtgtggacccccccttggcatttcccaacaaggaattatattgttcctttgttcccccaattccataagataggaattcctgtgccctgtggaggctgagaagacggggaggtgcctgtgaggataaaccagcccccagtttctggcttccagagtcttttcctctctcacctctgatgcctcaggcctggggagcctccctccgacaccctctgaccgctccagtgaaataggccgagagggatggcttgaatcggctggggatgcaggctgcagccagggggctcagtgggcatttcctgagttcggttcttgccccgcaagtggaagggcagttgaactgaagtctcccactgcccctcctggcctggaagcctgcctcccaccttctgggcagagtgaggagtgggcgtgggccgggagggctgcctcctgtctgggagggctgctcacttgcctgtcacgggggatgagccccctgcagcctcccgtgctgtggccctggctcccacgccggctccactcccctgtggctgcccctgctgggtgcccaccggtcccagggaaaagccactcccctcccggaggactggcgggaggggccctgcctgggagcgtgccgtgtggtccctgtcttagcgcaggatgcctgaggccagatcctccctgggaggcaggatggggcaaaagtctccccgcaggcagagcagggcctggatgggcccaagcagggacgggggcacagaacagcagccgcccagcctgcgtgggagctgagggccaccaagggcagctccagcctgtggggactagcagaggcaccacctctgtgaccagcgagttgtctgcacctgcatgcgcatgcaccagtgagtgtggcgagtctgaggtgtgctgggacctggcccgtgtaccagccagccctgatgggaaccagccccatcctgggtacccctggaaccccactgtgtgggagcacctgggtcctcagcaggcgtcttccgggcgtccgcccccagccccaggcctctgacccgtgtgtggtgtcttaacagcagccaggagcagggccatcgaagggacctacagacagaagaggctttagtgatttcgggaagttcagctccacgtgccccacatacccaagagtaaaacttggtcttggcctgtgggtgtgcagcccgtgggcgctggccaggcacacaagacggccgcctgggtcagtccagggggaggcagatgtggtgcaggggcccccctcctccatgagcccaggaacagctctgcatccaggcacccgccctgcacccagcacttttccttctcccaggactgctggctcgttctatgggattgaacacacaactccatggggaccgacgctggttctatccccctttcttacaagaccatccatggggatgtgggaggcggggacacacgctggttctatccccgtttcttacaagaccatccctcctgtgtcttggctcgtggatcggcttctaaggcctttgagtggcagcaggcggtacagcttatctgagtagaggtgaaggagagggccaggtccacctgggtggcccgaggcagtgtggagggccaggagaggagagcaccctccacccttgtctgagcagccctccagggtacggagacaggagttcagggtcagccctgccttggagcgcagggggcccccagcttggcacagctcctagaagaggagatgaaaaagcctggccttgggagtctggggatggagctttgctggggaggcagcgtggctgcaggatggcagctttttagaggacaccacggccagggacatccacccgggggaattctcaggggtcgcctgggcaagtcgcttagcctttctgagcctcagtgcctcagtttccccatccaaggatgggtgtgacaaccacctggcaggcgcctgtgtgtgagcccctgttccgctctaactcctctgctgttccttccccagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcggtgagtcctcaccttgcatgccactcaaccaatgccggaaaccagcctcagcccccagggcggcccacaagcctttgggcttggtcttcccttctgtaaaatggggcagcaaccctgacctcaaggacggattgccagtgacattgcgtgtgcatgcatgcgcctgggaggagcccacagcctccagcggctcctcagaggggcctgtcctgcacatccagggcccctgagatgactttggggagcccaggccggcctggagcaggtcctgatgagtggtcgctgcctctgagcaatgacgtcagcttgtgcagagggttctgtggcagctgtcccctcactgttgctccagcctggccctccaggctccccaccgcaccccaccgcaccccggccagaggcttcccagcagctcagcttcagctctgccctggaattggggcctcgtggcttccacaccccctggtggccccggagagctggaggtcaccacgggaggtcgtcgatcagcacgacctgggcagggtgagggggccaggctggagtctacagtgggccgcctgttgtttccaaagccccccaggtcccattcaaacctcacagggaccctgtgaagggggcgtcccgttttccaggcagaagcgaggctcagggaaggctgccaaggttccttagctcacagggcagagaaccgcagccaccgttttgactcccagaactgtgttctgcccactccacggggtccagggaggggtctggggaagtgcccccgccaggtcacaccctaaacaaaggtgagcttgcggggtttctgcaaggtgtctgggcacctctcaggccgggcctgtttctctgacctttgccagccgtgcacgtccttcctgcccagctctgtggacgcaaacccacacctgccagcccgacacctttctttcctcttctgcactgatctgggccctggctcccctggggtcttggtgtcctctctgcttcctgtagcctcatgggacccggctgctcatggccctgctgtgctcacagctgcctggaagctggcagcctgcttcaagggagggcggaggtgtggggtcccctcctacggcccccaccctgttctgcctgttgtgggggacgtgcttgtaccctgaggattcagggctgcctcccgggaagatggctggagagaaagagaggggagaggcccaaaggcagtggccaggctgggactcatctctgtgggctacggaggggctgccctgctccctagccagggacagggtgagaaggacctgggaacctctgcgtcccagccatggcacaggccttcttccggagctttggccccaaggagagggagaggcagcccagcagccctcgccttccgtggctgccactgtgacagccttgccctctgggaatggtgcgcaggaggccacttcacctgtctgggcctcttcgccctttcaaccctgagaagaacagtggtcctgattccccacaaaatcactccctcccagggatgccgagtgaggaacaagacgtggggcagctctgctctcctccctcctccctcccatggcagctgtgcccacctgcagaggtgcaggcaaggtggaggggcacctgtttggaggtccacagaccccggggagaatcccagctttgtcctaactcagcggggtgaggcttgtgtgtcttcccctgggctcctcctctgtgagccttagcttcctcgtccataaaatgggatcatcccataaagtgagatcaagcgagctaggccccgggcagggtccccaacaggttgtggttgttcgagaatttgcagcagtggtgatggtggttgtggtgatgaggatgatgggggtggtaatgacggtgatgatgatggggtgatggtgctagtggagatgatggggatgatggtgatggtggtggtgatagtggtgggatggtagtggtgatgtgggtgatggtgattgtgatggtggtggtggtggtgatggaggtgatggtgatagtgatcatgagggtgatggggatggtggtggtggtgatggtgacagtggtgggatggtagtgatgatgtgggtgatggtgatggtggtgatggtggtggtggtgattgtggtggtggtggtgatgatggtggtgatgatggtgattgtggtgatggtgatggtggtaattgtgatggtggtggtggtgatggtggtgatgatggtgattgtggtgatggtggttatgatggtggtaattgtgatggtggtggtgatggtggtgatggggatgatgatggtgattgtgatgggggtggtggtggtgattgtgatggtggtgatgtgggtggtggtggtgattgtgatggtggtgatgtgggtggtggtggtgattgtgatggtggtggtggtggttgtgatggtggtgatgtgggtggtggtggtgattgtgatggtggtgatgtgggtggtggtggtgattgtgatggtggtggcgatggtggttgtgatggtggtgatgtgggtggtggtgattgtgatggttgtgattgtgatggtggtggtggtgatggtgatgatggtggtgattgtgatggtggtgatgggagtgatgctggtgattgtggtggtgaagggggtgatggtggtgattgtgatggtggtgaagggggtgatggtggtgattgtgatggtggtgaagggggtgatggtggtgattgtggtggtggtaatggtgatggtggtaaaggggtgatggtggtgattgtggtgatgtgggtggtggtggtgatgtgggtggtggtggtgattgtgatgggggtgatgatggtaatgtgggtgatggtgattgtggtggtggtggtgatggtgatgattgtgatggtggtgaagggggtgatggtggtgattgtgatggtggtgattgtgatggtgatgtgggtgatggtggtgttgatgggggtgatgatgttagtagtggtggtgatagtgatggggatgatggtggtgttgatggtgatagtggtgggatggtagtggtgatgtggttgatgatggtgctggtgctgatgattgtgatgacagtggtggtggtgatgagggtgacggaagtggtgatgatggcgggagtgatgggatgatggtaatagcagtgatggtattgtgatgatggtgctgatggggatggtggtgatgataagggtgatgatgatggtgatgataataataaaagtaacaataataaagggatacaccttgcagtatcccagttggcatctcctagatctaaggtgtcgtggctggaacattgacataactcctgacctgaggttggccaggacacagacctggtggacagagagagatggacgaggagtgtccgtccttgggctactaaacagttcaggccagggattcccagcaccagcctctgtcctcccaggagcccacacttttcctagaaaggtgttatcaaagtcagaacatcagtgtaatttagggtgttttttgtgttgtgtttttttgagacagggtctcattgttgcccaggctggagtgcagtggcatggtcttgactcactgcagcctccacatcctgggttcaagtgattctcgtgcctcaggcatgtgccaccatacctggctaatttttgtgttttttggtagagacagggtttcaccatgttggccaagctggtctcgaactcctgacctcaagtaatccaccctcctcagcctcccaaagtgctgggattacaggcgtgagccatctcgcctggccgatttttgtttttttaaaagacagggtctctgtcactctggagtggcaatgatcctagctcactgcagcctcgcactcctgggcttgagcaattctcctacttcagcctcctgcgtagctgggactataggtgctcgccactacacctagccaatgtttacattttgatgtagagacagggtctctctgtgttgcccaggctggtcttgaactcctgggctcaagcaatcctcctgcctcagcctcccaaagtgctgggactacaggcatgagccaccacacctggcctagggtattttttttggtgtgttgctagcgtagcccaaggcagctctgtgcagggtaaagcaatggggctccgagtctggaggggtgtgtgtgtgtgtgtgtgtgtgtgtgtgtgtgtgcgcgcacgcgcgcgcgtgttatatgtgatttgtttgtgtgtgttgtgagagttgtgtgtgaggtatgtgtaagaggtatgtttgaggtgagttgtgtgtgtgttgtgagttgtgcatgtgaagtgtgtgtgttgtgaggtgtgtgtatgaggtgtatgtgagttgtgtgtgttgtgttgcatatgaatgctacttcctcatcctcgtttgtctcagtcacctgtggactggctgtctgcacacacggtcactgtccctcgagtggcaccaccctgcaggccagcgccccctagcacatggccccacagaccccatgggacatgcgtgagcctgcctgatgctcacaccagctccacgggggaaggactgtttatcccattttgcagatcaggaaactgagacacggtgaggtcaggtgacttgcccaggccctggccggtcagggaggagcagtttgaacacctgggctttggttgcaaccaccctggtgaactgcaggaatcccggccacctggtgcaccctgggcagccctgggctcctccgccagcccggcctctgtcctgtccaaaatctgagccaccaggagacctcctgtccagaaagcacaaggggcacaagagatgccgactctcccaggcccggctcacctctcaggagaggactgtggcctgggttgtgctggcatcagagcccggctgtgtgggtttacacagtcactggacacccggctcgagggtgaagtcctcgggggctgcttggcagggatattgccgggaggtagcccaggcactgctgaatctcagactggagagcctcgtgcctgggtgggaggggccccatgtgcagaccctgctggtctctccggagagacccctgaccggcctcccatcctctccccagggcagagcggcttgggtaaatccaccttaatcaacaccctcttcaaatccaaaatcagccggaagtcggtgcagcccacctcagaggagcgcatccccaagaccatcgagatcaagtccatcacgcacggtcagtggccgggagtgggctgggggtgcaggacgcccctgccttcctggagcacaggggttgggggtcaagaccatcacacacagtcagtggccaggggcgggctgggggtgcaggactcctctgccttcctggagcacagagtggggggtcaagaccatcacacacagtcagtggccgggagtgggctggggatgcaggacgcccctgccttcctggagcacaggggttgggggtcaagaccatcacacacggtcagtggctggggatgggctggggatgtgggatacccatgccttcctggagcactggtgcggtgtgagggtgcccgagtcaggcaatcccaggtccccaagacggggactcgctgtgcccaccatccccagcatgttgagcatgttggggctctggctgtgatgggtcagtgtcccggacccctgtgggccccgtcacactgagctccccacagacaactgagttttccaccaaaagtctgacaggcaaggggctcccaggggaaccgtcaccggcctgtgccggagttggctgaggaaggccattaatttcccggtgtctccttggttgtcatcgctgcctacctggggttgccccggggtcagtcaggtgtggggtgtctgtgagggtcttccgtctcccctctgactctgcgtccgtggctctgtgcagatattgaggagaaaggcgtccggatgaagctgacagtgattgacacaccagggttcggggaccacatcaacaacgagaactggtgaggcccctccagggggaggagcactagcgggggcttcagggctccctggaccccacccagagtcagccctagaggtttcccggcccgcgggggtgcagggcccacctcctgggacctgacatgctgccaaagccgcacgtctcaggggcctgaaaattctggaccaaagcagaattacctggggaatcttgctgtccccaactcatcacctgaggccagcccggggaggctggtttgggaggccgagggtaaggctgtggcatctccgctcagcaagccagacctcccagggcatgcatttcattggaaggtggggtgttgggctctgagtcctgggaatgcacgacctgcttggggagggcatctcatgtgcctgctgactcgtccccatcccccacgcagctggcagcccatcatgaagttcatcaatgaccagtacgagaaatacctgcaggaggaggtcaacatcaaccgcaagaagcgcatcccggacacccgcgtccactgctgcctctacttcatccccgccaccggccactcgtacgtccctgcagtgtcggcgtcctcatgccgggtgccctgggttccctctgtcccctgggactgcaagacggtgctgtctgccctgctgctgggtgcagaggggctgagtcaggggccatggccgccagctatgaagttgggggtgtgccatgtctgcacctccaaagcctcacactgacccctatgcaagtgtcctgcccagcccccatccttcagctgcgtcttggggagctgagggtcaggcaggccctgggctgttctggagcctggtggtctgtgtcctgccttctcaggccaggctctggcaggtggagtgggagcccccagccaagcacccgtagcggtgactgaccttctcatccgggccctgcctcatgggaccccttagagggtttggtgcgttcttagacgggaagcacagagatcagtgctggccccttccagggctggacggggctgctgttggtgttggtgagagccctttcctcccgccggctctgtccgcacctgacgtcgcccctagagatcagcaagggcgggaggctgcatgtaccctggcaggtggactcttcatggcctcacggaccctctgtcctcagctccctgtgcaccccctgccagacacctgtggctcaccctgagccagggctgggaggaggaggaccagaggccagcaggagtggctggtggaggcagccgtgggtggcttgtctgcatgggtgggtggagaaggtccttcgcacctgctgtcccagatgtacttccctgggcggaggaagcccaggggtttggggaaaccatactctgtgggcaccaggtgcaggaaggagcctggctggtgggcagcgggcctcacccagagtctgtgggaaaacccaagccggagttttcgagcccaccctctggcatcatcctctgtgggccagcaggagtcaggggcagggggccagcccgctgtccatgggcctctcctgaactgaacatctgccctcccaggcagaacggctcacctgcggtcctgtggcagctgttccagctgctccaagctttgcctcagctgaggctgatggcaggaggcagaagcctctcctgatgccagctgggcaagccgagggcgggcgggcggtctgtggcacttctgccactccccagcactgaccctttggctgggactccagctaggcatgttgcctggtcccgcccaaggcgtccagtcccatggggcaggggcgggccttggccatctctgcttaaacttctgcccggagcgggcttctccccagccatgtgtgtgaccgatttattctcactgtgggaaaagctcggctccagaactggggaagatggtgccccagttccagggccctgccagcccctgccacccacagctttccccacatcagaccccaggctcactggggccaagcaggcaaggggagcagcccgcctggtgcaggggagcagcccgcctggtgcaggggcaccgcacactggtgctagcttctatttctcttgcctctcccctcccagccaaagccccacagcaagacggctgctgagccaacgacagcccttctgtgtggacatgtaggggtgtggttgggaccccagaactcatggacgagggtgcttggagctggccctggcccgcctggcctgtgcagtggtgtcacctgtgtctgggacacacccgtgtccttcctctgccccacactcacagcgtggccgactcggcccggggccctgtccttgccagcagggacccccgtgagccccgagccagcacctgagagtgtcgacacctgcttgggggtgggtgcccccccactgccccgctcccccagatgagcctcacgcacatccctctgcttcagcctcaggcccctggacatcgagtttatgaaacgcctgagcaaggtggtcaacatcgtccctgtcatcgccaaggcggacacactcaccctggaggagagggtccacttcaaacagcgggtagggttccatctctacttgccccagcccttctgtgcaacctggagacgctgcaggcctggcaggggccaccccgtctaaaggagtcacactgtcagggagaccgaaccgctggtcactctccccagcgggtggctggcctggtggtccctggcccaggtggctgctgggggccgtccctgagatggcctctccagctcccccatatctcaaaagcagctttgtgggagtgccaattctccagcagagtctctgaggggggttttggagaagacctggaccaggcagatggtgaatctctcttccagggagtgaggccgagcaggggccgtgcgacatggcccaccttgttttatgccccccctttttttttttgagaaagggtctggctcagttgccaaggttgcaatgtagtggcacaatcatggctcactgcagcctccacctcccaggctcagtccccgagtagctggaattacagacgcacaccaccatgtctggctaatttttgtatttttagtagagacgaggttttgccatgttgcccaggctggtctctaacccttgggctcaagggatcctcctgcctcagcctcccaaagtgctggggttacaggcatgagccacctcacctcgccctgcctggtttttattagatggaagagaagctgggccaggtgtggtggctcacgcctgtaatcccagcactttgggaggccgaggcgggcagatcacttgaggtcaggagtttgaggccaacatgatgaaaccccatctctactaaaaatacaaaaatattagtcgggcatggtggcgggcgcctgtagtcccagctacttgggaggctgaggcaggagaatctcttgaacccgggaggcggaggcttcagtgagccgagattgagccactgcactccagcctgggtgacagagcgagactccatctcaaaaaaaaaaaaaaaaaaaaaagtttcaggagggatggtctctgccaccttcttctccgccaccgtctgaggcccctgctgtgggatagggaggggcatccaagcaagagggcagccctgggctcttcctcctgacagggcagcacatcagagccacatggggtgcctttcaaaatgaaaccgaggtgcctgggctgcggcaccacatctgcctcggtgggtgtgggtggggcctgtaacctactccgtcctggggccaggtgtcagggaccttcccagcatgtgcaggggaagacagtccacacaaagtgggtgtgtctgccggaggctacacacgggctgtggtctgtgcctgggcaggcgagcagccgctcactgggatgtttctgttgcacgtacccatgtcgggctgctggcagggagctgagaggttactgcaggcggggcccctgctggaactggggactgtgacgagggttttttaggaagggtttcaggaggggaggtctcggtaaccctgagtactttcttggggctgtgatgagcaggagaagagaggtgggaggtgctcaggacgatgaccttaagcccctggggagttgcagcgtcgctcaggacagcaggtgcacctgcagctgcccctcttccctccaggaggcacaggagttggaggtgattggtgtcacagccccccagagcctgcccttgaacccgagcctggggcagcacacagtgtggaggtcatgtggcaaacaccagtgggtgggtagagcttgccacagggatgggcccatctctctccctccttatcccagatcaccgcagacctgctgtccaacggcatcgacgtgtacccccagaaggaatttgatgaggactcggaggaccggctggtgaacgagaagttccgggtgagtggatccactaggatgttgttcccaggggacccccagttcctgctgaagggtgggttgggggtttggaggaccttaagccatgaaattatattcttggggccagagggcactgagcccaggtgtctgtacccagtgctgtcaggctgaggctctcgtttttgggggaccccaggctcagggcagctcctcccgggggcccaggggagggaattgccttcccgcacatgtgtaaccaataccgtctgcccgttccccaggagatgatcccatttgctgtggtgggcagtgaccacgagtaccaggtcaacggcaagaggatccttgggaggaagaccaagtggggtaccatcgaaggtactcgccgcaggcgccggggctccagacagatgggaagacagtctcttctgctgacccagagcctgtgggccacgcctgagccagggactcgtggaacctcatccactgccttgccccacccagagggaggggtctccttgtccccattcaacccttgggaaagtgagagggcaagtggcctgtgcagatgcctccaccccagacctccccccgggcagggaaagattcagggagacaggagctgggatgggggccgccaagttctggatcctggtgcaggctctttcataggcacctgtgtggccctggacaaatcgcccaacctctctgggcctagaaaaggggtgggctgtagctctgtgagccagatggaccctcggccccttaccctgctgaagttcctgggaccctcacaccttagtctcttgagtggctgttgtaaccaattagcacaaacgaggggacttaaaacaacacaaacgtattttcacagttccagaggccagaggtccgaaatcaggggctgtttccttctgaggccctgaggaccagcctcatccatgccttcctccttctggtggcgcctggcattcctagttgtattgtaaaggcatcacatgctctaatctctgccccattgtcacagggccttcttccctgtgtctctgtcccgtccctcctcttcctttttttttttttttttttttgtttgagacggagtctcgttctgtcacccaggctggagtgcagtgttgcaatctcagctcactgcaacctctgcctcctgggttcaagtaattctcctgcctcagcctcccgagtatctgggattacagtcacgtaccacccacctgacttaatttttgtatttttagtagagacaggatttcgccatgttggccaggctggtcttaaactcctgacctcaggtgatctgcccaccttgcttggcctcccaaagtgctgggattacaggaatgagccaccgagcctgccctctttccttcttgtctttggacaaggatgcctgtctttggacttagggcctaccctaagtggatgatcccatttggagatccttaatgaatctataaagaaagacgttttccaagtaaggtcacaatcatgggttccaaggcctggaccttgaccatgtctttgaatggatgggagcccctggggggccacagttcaacccactcctggcggtgacaccccgggagggatgggcccgaacgtttccttccccttcctctctctgtcccttcatttctcattagaatggaagaggggaaggtgcagagggaaatgcagcaggaaaagccactttgttctgggagagcacttggctgaaaggcccagtagagcaggaagcacaagtctcttaatcttccagggcctcagttttcatcatccacaaagtgggtgcagtgtgccaagattttagtgagttgagagactgtcccaaagaccacagagctttttgggaagctgttgctctaaaaaaatggtcataatgacaattaccaggaggcatcagacactcctgtgccactggctagacatgggttatctcgtttcatgtccgaagctccccgcacccaccctccttgcagagttgaagaggtgctgtgagcagaaaacctgccaagggacccagaacgggaggcggctctagaatctacagctccagccctgcaccagactccctcgagatgggagttcatgcctggaggagggtgtggagaggcacacgggcctttcccctgtctgcactcctcccctaccaccacccctgccgggcccaccctgcgggagctgcccagctgggtgcagcctgggtgttttccagtatccgcctgtggtgtcaggctggcttgcctccccttggcccctctgcctgcagttcctctcttcctctctgcccaaagagttcttgctgtttaggaaactttttatgaaaggcaggtttgggagagttagggatggatgggcctgggacgggccggcggctttgctatgggcgtgcctctgctgcaccctggtggccaaccttgagtaccgcaggtggccggtgacagaaactgtcaggaaatgcacaagagagaggtccccgcacctctctgacctgtgcgttgttgagcaccactggctccagctgaggaagagtctggaacctgtcaggacagttgtgaggtggtggggcccactttccagcagtcttatatgaggaccctggaaatgtgccttcagcactgctgggtttttatatcaggggccccatgagttcatagctgacctgacacccggactagtaagggctgtgccttgttcttgcctcccacttggtgaacagcatcttgaggtatctttcccatccttagaaaccaccccaagtattgtcaatagaaatgtggggtgtaattgatcacgccatgaactcatttaatcctcatgtccctgagaggcgggtgacgttattatccacattttatggatgaggaaactgagggaatgagagtaacttgcccgagccagggagtggcgatcacacactccaactccagcctgagagccccattcttcctgccggctctcgctgcccgtcagtgttagatgagagtgctgctggtcagtctgcaggaggttctagtgtggacaccgccctacacagggccgtggcaggagggcctaggcaaaggcaaccggcatagcactgagagcacttgagggctgggcaaggtggaggccccggccctgcctgctggcctaccaagtaaaaactagacatttttaacttggggaaaagccatgtggctctgcgatggggcagcctggagccaggtgtatgggttctgcatcccgctccagccttatgcactgtggagctgagacagacacagttcttgcgttctctatgcctcattttcttttcttttctttttctttttctttttttttttttttgagacgaagtttcactcttttgcccaggctggagtgccgtggcgtgatcttggctcaccacaacctccacctcctgggttccagtgattctcctgcctcagcctcctgagtagctgggattacaggcgcctggtaccaggcctggctaatttttgtatttttaacagagacgagatttcatcatgttggccaggctggtctcgaactcctgacctcgtgatccacccacctcagcctcccaaagtgctgggattgcagacgtgagccgtggtgcccagcgtctacgccccattttcgtaagataatggggataacaaaggaatcacaagagacacttgcaggtgtgtgaagacgaagttcatcacatgggagggcaccgggtgtctttatttgccttccctgcccggctccccacctccagtgatgccgttcactgccctccttgttaaaaggccttctgttatataacagttacacatgccaggcaccgcgtgttcatataggagttacgaagcacagcaataaaatgaccactctgagatggccaccagctcgagcccgagggcacttgtgggtgcccgtggtctcctgcccagtctccctgagaagtggccactgtcccgagcttgggcttgtatgtattgtgtgaagtgcacatgtccctgagcaatgtttagcattgctgattcttgagcttgtgaatggtcgtccacagtacgtagcccctgtgtgtgtccctgtgtgtgtgtgctctgagcgcacacaaggtggatggggccgtgggggtaacaccctgtgggccacaggttttctttaaaatcccagctccgattcctgcttcatcccattcccagcagcccagccccctgcctgtcttcaggcccctgctgggacgtcctgctctccctggtcaccccagtggtgcgggggcccactgccctggcttctccactgtggcttccttccatgctcctatttggcctggtcactgtgccatctcccattagccaggaactttctggagagcaggagctgagctgtccaggagcaggagctggtgctggtcactccagtatcccccagactgagggcagtgccaggtgtcctatactcagctgcagagcaggtggttcccctgccctcctgcccatggggctgccctcagactctgcttttggcaccagcatttctgggcagggggagagaggtggggtccgggcagagtttctccactgggacattaaagcccctcctgtctcctctcctagttgaaaacaccacacactgtgagtttgcctacctgcgggaccttctcatcaggtgagagacagggtgcttgggtggggctgacggcttcacccctaagagggccctacagcgggtgggggcagtgggtgtggggccgaagccctgggcagagtgggtgccccctgccacctgcctgccctgccctcgggaagatcttggaagcccatcttctgaaaaagaaaacccactgggaaatgaagcaggcagtgaagatccttttcaacccctgcgaagttggctggatgggaaggctgagctttgatccactgtggtctggcccgttagagctgcccggtggccactaagggcccagtgaggcctcatgtgcaggccctgccggcagcgtggggcgtctccagctccgatcccactggcctctgacccctacccctttcacctggctgaggcttctccttgtttcccttgagtccaggcaaggaggggaagccctgatggagagggtgctgggtgggtggtccctggagtgtgggccctggcctgggcaggttcttcctcagcaagcagctggcatggatgatgggaatgttatcaagaggaggggcctccaggttggcgggggcaggggtggggggattccgggagccgttctgccattgtggggatactgggctttccaacctccctccagattattcctcctgagctgcagaggaatgaaaatccgagcccaggacttttttttcctggggacaagggcaacccagccctttgccccaggccacctgcctgccacaggccatagtcctggaggccggtggtcacccactgcttccaccctgccagcaccctggacaccggcctggagcaacaatgctccagccctgtccctctgagtctatgcactgtccctgggccctggacccagggccatagggtggacccagagggagacacatgcactggaatatgtgtgttctgaccgagtctgggcttaccagggggactgacccttcccccaaaacgtgtaccagatctggtccaacatggtgggcctgggggaccccatggggagccaagcagtcgggatggggagtgggggtgggggcaggcgggcctgagtccgaggcaggccgagcagggcccctgccccgctgcccccaccccgctgcgcccacctcactgacccgcccgccccccacccccacaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccagaa

SEQ ID NO: 1833 - DNA, 5271 bp, Homo sapiens
attattctaaaacctgctttatttagaaattacaaagagcaaagagcagagaaatcatcacagggagaaagactgtgtacatcatacgactagtcacttgtgcttccatgcatactgcggggcgggggttcacaatacttttaacttagggagtttgggggccaatggaaaataagtggaagttgttctgaaataagccccaggcgattttcagtaatgaaaaggaacagagatcattttcttataatgctcagcctcagagagaacaattttggaggcaagaaattaataatttagtaacaaagtgaagctccattggtgaatacattatgatgtaaaatcaaaggttgatctgatggtgagcaatgggtgctcagatggggcaggtatagacagagagaagtgagggcactaagcatccatacccagctctacctcggagagcagggaagactagaggccaggagaggataggcaacctgaggagacggctctgcagccagagaagggcctgaggactgtgggaccgagagctggaggcagcactttagtgcttgtagctcttcctgctggaggaggaggtggtggtgtacttgatggtggaactgccgcctccaacagagctgaggccacccccaatggctctgccactgctggaactgaagccacctccaatgccaagaccactgccataggagtagctgcttcctccacccaggcctaagccactgccgacaccgctggcaccgccatagccactggagatggtggactgtactacagctgtggtggggaggggacaaggacacaagaagccacggtgagctcatcctgccggcctgagcccagtcagaagagtgcgagggcaggggaggaaggcaagcaaaggtacttacagacgttgacttgtccaacgccttcgccattcagcctgtggagaggaacacagggagggtgagacctcagagagctcttccttccctggaccagtgtgggcagcctcggtgggtggaagagtccatgggaaactgctcttttagttttctctcaagaagagcaattacggccatgagcagtgcaccctagaattgtgctcagtgccaggaaccttgaagatggactcagctgttggaggaagtcgcgtcagttacctacctgcactcctcgccctccagcagcttgcggtaggtggcgatctccacatccagggccagcttgacattcatcagctcctggtactccttcagcagccgggccaggtcctgcttggccttctgcagggcatcctccagcccttccagcttgttcttagcatccttgagtgccatctccccacgctgctcagcatcagcaatggcagcctgcaggctggcacactaggaggggaaaggaagagaaggaacttcttgtctgctcctccggaggaggctggcccttgtttagtgaaccagggtcctgtaacccaaaattgacagagaatgagctttgactcttcctgtccagtatttctccatttggcaatatttgtctagtctgggagtcaagtgacaaagtcctatgccccttgtattaagcacccgcatgagaatgtgcgttgcatcttatgggagacactacaatggacccaaaaacaagccatatggaagatgaatgctcggtttgtactgagtgctgttttcaaaactacaagaatgattttgaggaatacatctggatgccacattaaaatatacaaaattatgaccatctgtaggggaggtggtaactttttacctgactgttgagacctggccttgcttgtgcctcagaggctcatcctcttgggtgggattcacttctctattgagttctcactgagggcaagaactacacatgttcctcaccctagtgttggtttacgtttcaggaattatatcaaataatggctaatgactgcctgatgggtctagcaaaaaatgatgcttctttcctccactgcacctcactgtacctgcttcttgacatggtcgatctcagatctcagcctctggatcatgcggttgatctcagcaatctcctgcttggtgttgcgcaggtcgtccccatgtctgcctgctgtgacctgcagctcctcgtactgcagcccagaggtggagagagagacagtgtctacgggttcttacctgggagcgatgactttcacttgtgtatcatgcatgtcatgaagtggacctaatggcttctcctcaagaaacttgaggaaaagttgatgttatgtggtgggtggatactaaactctggagtcacagacgatcctcattatggcaccactgcctgcctagtttctttagggagtagaaatattctgtaccaatttctaaaagtcagcaatcagggtgaagataaatgcagagatgactatgtccttgtctatggcagctttcctcctgcattgggttctttttcctccttgacttgcacataagttccccaaatgtctactctaatagtgcagagtgcatgtcctgtgagaggaccccagcttcctgtcaggggatgtccccagtgaagtctgcagtcctctggtattccaggatggacacaaggattcctcagcagctgcccactccctgctcaccttggtctggtaccaggactcagcctcagcccggctcctctgagcaatctcctcgtattgggccttgacctcagcgatgatgctgtccaggtccaggttgcggttgttgtccatggatagcaccacggatgtgtctgagatgtgggtctgcatctgggacagctcctgcagaacagaaggtcataagatcaacttcacatctgacatttacagagatacccaaccctatacatcttctcccctttgcagaccccatcagagtaaacagaaggatggtggagatgcttactgcatcatacaaggctctcaggaagttgatctcatctgtgagagtgtctgccttggcttgcagttcaaccttgttcatgtaggcagcatccacatcctggggaaagagccaacaacctggagttacctgagctcacctttccaatctacccatcttctagtcctcctgccaattctctcccaggggagcgaggacacagagccacttctctccttctaaatgaatttgaacccccggcttcatctgctcaccttcttcagagtcacaaattcattctctgctgctgtgcgcttgttgatttcatcctcatatctacaggaagaaaggcataggacacatatgagccagtgggtaggatgaaacagaaaagcagcttgggattcaacaatttcctgaatggaatatattctaattgagctttcctgccacagagagccaaagagatgagttttgctactactaaatttgccacttctttaatccccccatcctcccataaccatctgtggttcttgcaggtttgctcctagggactaatttgtgcttttcatttccatggacatgggttgttaggaatcctacacacatctggccctggtcacccaatagtcttgaagtgtgtgctgcaggaaatggagtcctcacttgttcttgaggtcctccaccaggtcctgcatgtttctcagctccgagtccaggcggccccgttccccgacgatgctgtccagctgcctcctgaggttgttgatgtactgctcgaacaacggctccaggttctgcctcacagtcttggtgccctgctcctgcagcagggtccacttggtgtccagaaccttgttctgctgctctaggaaccgcacctggaagggaagcaagatggtcattttccaggcaaaggaaggaagaaaaagtgtctggtatccagtttcctggcaggtcttggaggtccccatggtgctgggctactacagtgcatgtggagaggctcaggctgagctctgctcccccaaccccttctcctttgcaccccaccagtctcactagagaaattgtcccatggaccattgaggtgttctcacgctgtaagctattgatcatcagtgagtttcaacatttcttctcttctttttccaggcacaatcacaaatctagtttaaaaatactaattacctgatatattgtacacagtttttttactgataggatcttagttaggagagatattatatgttgactcatgattacatttcagtctactttcccatttagtgtctcctctcaaatattctgatgttatggtcattctctgtttttaaaattaattagcatttatccatgttttacagttgtttctatgtccctttttttcttaatccagccagattatcttttccttttctttctaaatctttttcctcttacccagaccccagagtgtaatttaccagcccatatactcctggcatttgctttgtaatctcttaaacacttcagaggggagaattaacctactccactctctgatggcctcatctgtgcttcagggttatgaaaagttacggctctccctaggcaggagtgagggccactccagagatcccatgggggagtgatgcccatctgtgctgcctcctgtgcaccgagagccacctgcactctctgcagagctgggctgaatccccttctccctccctcctaggtctccctagcaggaaggtgttgctcttctggtctggggaccctgaagtgcccgatggagggcatggcactggctcaccttgtcgatgaaggaggcaaacttgttgttgagggtcttgatctgctcacgctcctcggcccgcacccgctggatggcggggtcaatttgcaggttgaggggagtcaggagactctggttgacggtgacctcttggatgcctccaggggggcacacagggaagccagggcccccaaagccaccagcaaggccggctccaccacccagaccaaagccaatgccggctccaccaccgaaaccaaatccactcccggcgccaccaaagccatagctgcctccggctctgctgccatagccgccactgatggcacagctgccccctccaatggagatcctcttggagccccccaggccatacagactgcggctgccaaagccagctcctccacatgcaccacccaggccaccactgcccctggagcgggacacggagatgctgctgaagccagagcggctgaccccagggagcctggctgagttggcactgaaaccccggcggctgctgctgtggctcctgatggtggtggatgtgctggccatggttccaggagatgagagggctgtggcgagcgttggaggctggaggcg

SEQ ID NO: 1834 - DNA, 42560 bp, Homo sapiens
ggtgtgaagaaaaaaatgacactccaatgggctgcagtggcaacctttctttatgccgaaataggactcattttaatcttctgcctaccttttattcctcctcagaggtaggaaaccttcaaatcgttaactaataaatattggatcgctcttaatgtaaaatggaaaaagttttctgaacattaaaaagtttcgaaagtctttgaaaataaactcacctaacgaattaggtagtatataatgacaatattaaaataacattttatataaaactctgttacgtgtacaagtgaaataactttttcttcccttctaaaagaaaaggcgcctatacttttgattctgttgattacagatataataaagcaacgattatacttttaacacctgccctgccttgtctcaggttttacctttgttttattgccctgaattggagccatgaactaaataaatataagtggataaatcatgtttacagtacagcatgggtgtaaaagtgtttcactgaggcactggaacagcaatttagaaaccaaagccaataaattattcttagttttcgcctttgtaaccgttagtttcattaatgacaattttactacttttgatttcacataaaattaatgaatgtatattaaaagtgctgaatgtgaaaagtatcacaaccatgtattagcattagttcgttagtgacggaacttctaaggtcttgaagaaccaagtacagtgtttcaagccaagcagtggttcattttacccttgcagtaatctactttttagtcgtttaattttagatccagaaatttgatagtatgaatggggaaatacacatgtaataaaaatattgcaagatatttgttcatactcctggcataaaagaaagtatttcataagtgagatcctagagataacccactaaagtgtattaaaatcccaggactgggagaaacttcttaaagtttcaccttagctcagggtccagatagtctttcacaactcctaacttgctccttacctgcctggatttctgctctcttctgtccttctctatcagctaagctaagctcagtaagttgtttcttactaaagaaaaaaaattgaatcatactgtagggtctttgatcttatttgatccattccacccatgttctatatatcacgtactgagacccaggagggcaagtagcctacggttacctagctggtaagtgacagattctagaaaaaaatctggctcttagtccagtgttctttctactccatcatgctgcctctcatcctgtaggttttgtttcaaactcagtaacaccctgttttgctttttggtaatatttgcaatgatagaatcctatatactcaagagaaagaaagattttgtatataaacatctaatttatagataaggcttaagggtttgcaaagaaggaaaaattgtcagttgatctttactccatcagagtgatctgtaacttatggatcaatatttttcttcctgccaaataaaaattttacccatcctgatcaagtagctattagatagatgtgtgtatatttgcatatgatatataaatgtgttctcatgtacagatataaagaaaatacggtatgtatgcacgcagatcatttacaatatgtcctatgtgtgtatccacatctttttatcttttatatttgtatcaccataatctttaaagaaaatatttcatcatttagtctctattattttcttacataacccagtggttaaaggcacatgctcagaaatcaggtcacctataactgcatgttactaaccttgggcatgctcttgatcctctctgatctgtttccccatctgtaaaatggaggtagtactagtgtctaccccttacggtagttgttgtaattaaatgagataaaacatgtaaaagtacttagaaccataatatagtgagaacacaataggtattagctatgataaggtgctcaactgctagttgttccctatgagagatctcttacattcccttttacaccacaccaaaccttgaagaaataagtaaatttacatttggacctagatcaaggtattaccacttatgttctcttaaaaatataaaattttatattgcataatttaaatattggctgtataaaatgcttggacttggaagcagagacaaaatgaaccgattcatctgtatgaatctccctcaacccaccaatttcaagtagttacttgaagttgtcctaatcttaaatcttaaatgtgtcctaatcttaaagtgaaactgtttttttcaagttgtaagtgcttgaagctatttaagtgcttactacatttttctgcctcctttcaactaaagtgttactcatttaaattgcccttgtacaaagtttgttacctttcctattgcgtgatggattattttgccactttgccatttataacccatgctttcttaccactgtctttgtttatactgttcaatccacctagactatttccccatctcatttcctctatgttcacatctttatctgtagtaattacatggttttatatatatatatatagtgtgtgtgtgaaaattatcaagctacatatttaagattttttcaatttatgtgtataatacctgggtagtttttataattccctcatggttaaagtagagaaacttttagttggagtatacgttaaaattgtactatataaaaatcagtatgcagagttagaccccactcctgaaatgttgccaattgttagaacaatatatctttatttctaagtcatttctctgaccatgaaaaagatacagagtagtagcttctatcaacaatataatattttactactgcaagaattcctttttaaggttttgctcatgtatggtttacttttagaatatttaagccaccagacagaggataatcaaatatcaggttattattaaatttgaaagagttgttttttaattcatgagatattctgtcatgtcagaattaataaattttaaaattaaatttctgtaattttcacttgctacacaattactaaaatgttacttcagtatttaaaaagtatttcaaaactttattttagtttttttatacctaatataattgtattgctttacagatggcagaagattttttcatttaatgtctggggtaaaattgcaactttttggaacaaggctttccttaccattatcatcctattgattgttctatttctaggtaagtactagatcccttctttgaataaatataactttttttaaatgaatttctttttaattaatagagttgatgttacaattggtgtacagttgactttatatagtatattgatagtacatagagtggatactgatctattgatacacagttgatagatactaccattctgtatgttcaagcttaagtttcaacagggcacaatgattcttaaccccttctaggttattttaagatttaaatgctgtatattaatgcataccttgctgttcagagttaccagactttatttttcatggtgttgtctctcctttgttactgtgatgtcctaggcacccaggagcttagctgttagaaaggcaaataaaagaatagaatcattaggctctccaaaggagtcttagatgcagggtgtgcatttggactggattaaaaaataaacatggccgggcgaggtggctcaggcctgtaatcctagcactttgggaggccaaggcgggaggattgcctgagtccaggagtttgagactagcctgggcaacatagcaaaaccttatctttacaaaaatgtaaaaattagccaggtgtggtgatgtgcacccatagtcccagctactcgggaggctgagagactggaggattgcctgagcccagaagttcaagtttgcagtgaactattgcactccagcctgagcaacagagcaagatccttccttaaaaaaacaaacaaacaaacaaaactgcaacatagatttggggactaccgcaaaaatttgaatatggagtgattgtataatattagggaatttttgttaactttagttgtgataacagcattgttacatagcagggtcagcaacctatatagcctgtgggccaaatacctatttttgtaaataaagttttattgggaaatgaccatgcccatttgtttacataatgtctgtactcgtttttcagcatgttttaaattttcatggtaacagtattttaaaaattaaaagtagacctttaggttcttgtcaaaccagaagttccatgagtcttagtaatcaccatgtttttccagttgttactgagctcagagaaattgagtgacttgtctaagattatctagctacttcttgaaatgccccttcttgcacagagtatgttttccctcagaattccctcagagttgttgtgttgttggttaaataggatttagagaggcgaacttgggaccctaaccgccatctttgacactgttttgtgagaaaatgtcttccatgttccaaaccaccaatctctcaaatagaatcctctttataaaactaagaacatctggtatgagaagggatggtattgtcaaaaacagaaaggtgtgaatgatttgtgcctcttttcaagatgtaaatatttgtctcatggtacattattaatgttatggattgaatctctagccatataactagttatgagaagtcagtaaagaacaataaggaaaaccggttccagttctgccaccagctaactaaaggacctttgaaatggcttttatttcctgggtttgatttattcatcttgtgaaataaagggagagatggaaagaatctctgcagctcctgattttatgatcttctaactctaaaattatcacaaaaatttctattgaaaactgtcacttatcatgtaagggaggggagttgtagtataagttcttttggttacattagaaacaaacttggccgggcgcggcggctcacctctgtaatctcagcacttcgaaagaccaaggcaggtggatcaacctaaggtcaggaattccagaccagcttggccaacgtggtgaaaccctgtctctaccaaaaatacaaaaattagccgggcatgggggcgcgtgcctgtaatcccagctactcaggaaactgaggcaggagaattgtttgcacccgagaggcagaggttgcagtgagccgagatcgcgccattgcactgcagcctgggtgacaagagtgaaactccgtctcaaaaaaaaagaaaccaacttgaactcgcttgactaaaaaaggaaaaatttgtaataaaatacggggctgttgcagagtagcccaagaaaggaaggaagccaaattccagggagggattagtacttggaactgaaatgtccttttcttggccatatacatttttcctatatatacttcattcttttttattatggactctgatattctgtctatctccaaggcagtaaatgggtaccacacagctgccaggtgtggtacccattccagacgtatgcaagggttaattcatcatctctgaatcccaattccacatcaaaggaaaaaaaattggaccagctagtaccagttatctactcctcatctcctataaccaggaaggtcacaagggagaatcatgactgctggctgaagcctgcatctttgggtaaacagggcaattaattcccagagaacaaggacatcatggatagttaaggcaaccagataggtgcttatcctctaggtctccatccaaaatggagtaatgacacctactttcgtgttttaagatttaaacgcagtaacatatgtaaagtgcagagtctgatgttcgagtccacaacgatgtaaataatgcaaaaccagtggattactcatgcttaatttatattttacttggaaatttatttcctttttcttggttatctctctaaataaggtaacttttttatacattttctttttatatgtatttattctttttttttttttttttgtgacggggtctcactctgtcaccaaggctgaaatgcagtggtgcgatctcagctcactgcaacctccactttccaggctcaagtaattctccagctgcagcctcccaagtagctgggactacaggcgagagccaccaacccctggctaatttttgttttttttaatagagacagggttttgtcatgtttcccaggctggtcccaaactcctgagctcaaagcgatccgcccacttcggcttcccaaagtgctgggattacaggcatgagccactgcacccagccaaaataaggtagctattaagaagtgtttgtattcttagagccaacactaactgagtgtgtgcatacaagtgtgtgtgcatgtgtgtgtattttaggtgctggtaagagacagaatggaagtgggaatttcaagagtgtgtttagtgttagcagaaatgcatcccaggaatttgaaagtttccataactgatctaaaattggatcatcttcaggtggtttatagaaaattgactatatgtcacatccttcccttattgttgactccattccatttttcagacatagttacctttttagtatacaggtgatgtattctacaggtatgtttacatgaccattgacattaataaacctttttaatattattggttaatcttcagcttttctgcataatggattcaggagtattattcccatttaattaccaaggaagatgaatcacgaagcataatgatccttcatagtactcactatttgcctatttaaaataagtcgtaaatatatattatctttgttggttttttggtagtggttggcatgctcttactatattattgaggcaatctgagaaatgacaaaggggaaatagccattaagatacaggaaattttctaaagatcatttaagagactactttatataactatgcaaataaattggaaaacctagataaaatgtataattttgtagaaaaatatgatttaccaaatgaacaccagtagatatagaaaatttaagcagactaatttatatagaaaaattatagaaagttatcaaaaaggacccctatttgaaaaaaaaagcaaaaaaccagatagttttataagaaaccctactgctttcagaaaacagatattactactgcttcttaaactgttctagaatttaaacttcaaattgtacagagctagaaaaaagcaagctgtagaattgaaaataagtcagaacaaatgaactgaatagtacatcagattgcaatatataacacagagaaaaataattactcttgaacatagtactcttaactttttacctcgctggtagggtacattttaagaaccaagaggattacaatgaaatctgaaactttataatagttttattgttggtaatttaaaagctgttttatgtatagtgcagcatcaagcaaattagtatgttcatggtattagaaactaagactttcaggaatagatatggcatacaaatataaagtcaaaaattaaggattttttaagttttagagtgatttatttgggttttattttggagtatggaaatgtggaactagatagaggtggtagttgcacagcattgtgaatatactaagcatgactgaattgttcactttaaagtgtttacttttatgttatatgaattttgcctcaataaattaaaacaattttgttaaagacataggagtctggctttgttcatagcaaaacgggttgtattagactatttctcctgtgttaaaaattatgaaccctcgataaaatacgaaaaaaggtatttgaaggccttgtagagcaaccaaaagcaggcagaaactagagggacgtcaacccttaaaagaagggaatcatactgggtgtgatcacatttatatagcctttcttccaaccgctttccagtcatgtggcatagacaacgatatagaactcaaagcaaaaagacagtcttaactgacttaaggggtcagaggtcagatagattcaaaaataagaaggatgtctaagaaaggagagaacccaaaaagggaaccccaaaatccacatgtaaactccccttaaattcttggttgactcttcaaccatggatgtgtaggaaagattccaaggaaatcaatgaaaaggaacagccagcaaaaagcagcaaggctgagaagaaattttggctgctggccaccaaggagagacagagtttggagtatgagcctcatcacgttagaggggcttggtaaagaccttgaacctttccactaaaatcacagaagggctactccttaggaatagagactatatcccaggaattagaaatttactataactaaggcctaaagcaaaatagacttaccctaaaaaagtataaaaatcaagcctctctaaacagctgtaaactgtacatcagcagtccccaccctttttggcaccagggaccagcttcatggaagacagtttttccatatgcaggagcaggggatggtttcgggatgattcaagcacattaaatttatatgcacttcatttctattattattacattgtaatatataatgaaataattatgcaactcaccgtaatgtagaatcactgggagccctgagcttgtttcctacaactggacattctcatctggggatgatgggagatggtggcagatcatcaggcattagattctcataagaagcatgcaacctagatcccttgcacgcgcagttcacaaaagggcttccactcctatgagaatctaatgccaccactgatctgatagcttgggcagtaatgtgagcgataaggagtggctgtaaatacagatgaagctttgctcactggcctgccaatcacctcctgctgtgcagcccaattcctgacaggccgtggagcagtacaggtgcatggctccaggtgttggggacccctgctgtacataatctttgcaagggcacatgaatatactaaactctcttcaccaagatacactatattctgggccataaaacaagtctcaataaatacaaaggattgaagtcctaccaaggattggaatcatatagagtatgggggttttgtttttgttgttttatagagacagactttcgctttgttgcccaggctggtctcaaactcctggcctcaagtgatccttcctgttcccaaaatgctgggattacagatgagagctactgtgcccagcccctacagagtatgaaaatagaaatcagtaacagaaatctggaaaacctatacatgtttgaaaattaaacaagacttgttagtaatccttgggtcaaagaactcacaaaggaaattagaaaatattttaactgaacaataatgaaaatacaatatattaaaattttaagatgccattaaagcactgcttaaaggaaaaattatagatttgaatatttatttttaaaaaagatttaaaatcggtgattttagtttccaccttaataatatctacccattatattgaatattgacagtgaaaaaaataatattcactcagttgttttttaaagatttagaaggaagatttctcattctgatgaagagctacaaaaaacctcaagctagcatcatacttaaatatcaaagtcttcccccataagattggaaacaaggcaaggatatttacactctgtttattcatttgagtaatagatgtcctagccagggtaataataagtcatgaaagaaatgaaaggcttaaagattgcaaagaaagaagtaaaatatccttatttgcagatgacacgattatttatatagaaaatcctggcctggcacagtggctcactcctgtaatcccaccactttaggaggctgagttgggcagattgctcaagctcaggagttgcagaccatcctgggcaacatggctaaaccccgtctctaccagaaagtacaaaaattagccaggcatggtggctcatgcttgtagtcccagctactcaaaaggctgaggtgggagagttgcttgagcccaagaggtcaaggctgcagtgagacgtgatcacatcactgcactccagcctgggtgacaaagcgagaccctgtctcagaaaaaaaaaaaaaaaagaaagaaagaaagaaagaaataatcctaaagtatctacaagaaagttattatgtcaaagaaattaatatagtggggtcacaaaatacaggtgggtcagtatacaaaaattcagtgtatcagtaattgtatttctatactataagcagtaaacaataggcaaatgacatttttaaaaattccttttctaagtacaccaagaagcctaaaaaccttagaaataaactttataaaagaggcacaacagctctatacagaaaactacaaaaacattgctgaaagaaaatcaaaataaatggggatttttcatcagttggaatactcaatattattaaaatgtttgttcttccaaaattctacggacataacacagtccctgtcagaaacccaacaggcatttttgtagcagttgatcagttgcttctaaaatttatgcagacatgcaaagaactcataaaacagtcaaaaaatctttacaaataacaaaattgggagactcacactaccagatttcaacagtaaaggggaaaataaaaacaggttagtgggctttatctaatcagctgaaagccttaatagaacaaagattgacctcctctgagcaaaaaggaattttgaccgcaggttgcctttggactcaagatgtatttcttccctggatctccagactgccagtctaccctccagattttaaacttaacaagcctctacgagcatatgagccagttccttaaaataaatctcgagctctctctctctctttctctctctgtctgccccctgtaccacttttccccatacacacatacacacacacacacaccctattggttctttttccctggagaacccttacatcttaactaagtaatcaaatttagcatcaaaaagtatgagacaaactaacattacacagcataaactatgagggattcttgccaaaagtattaaaccttatccaatcaagtatttgttttattttatttttactttctgaggcctggcagaaccaatcaagtctgacttctggttttctaaaaatacaggagttagagaaagaaattggactacactcagacaaattcagaatgtgagaactttctttgtgcttattttttttttaatatttaaaaaaagagacagggtcttgccattttgcgcatgctggtctccatctcctggcctcatgctatccttctgcctctgcctcccaaagtgctgggattacaggtgttagccaccacacccagccagaatgtgagaactttctagaaaacaattggcctggcacctttttaaaaaagtattatatgtcaagagactacagaaacataactatatgtaatgagtatccattataaaattctcagtttgaaaaaaattctatgaaagacatttgggagacaaataaagcaaataacccaatttaaaaatgggtaaaggatctgaatagatatttttccaaagatgatatacaaatgatcaacaagcacatgaaaagatgttcaacagcattagctatcagagaaatgcaaataaaaaccacaaagaaatgccactttacacccactaggatgactataatcaaaaatataataacaagtgttgctgaggatatggagaaattggaaccaacatacactgcttgtgggaatgtaaagtagtacagctgctttggaatacagtttggcagttcctcaaaaattaaacatagagttaccatatggcccagcagttcatctcttaggtatgtaccaagagaaatgaaagcacatgtcgatataaaacttgcacatgaatgttcgtagcagcgttattcataatagccggaaggtggaaacagctcaatgccatcaaccaatgaatagataaaccaaatgttaccacattcatacaatggaatattattcagccataaaagtaatgaagtactgacacatactacagtgcagacgaactttgaaagcattatgctaagtgaaggaagccagacacaaaagagcagatagtatatgattcagtttatatgaaatgtctagaacaggtagttctgtagagacagaaagcagattgctggtcaccaggagctgagggatgtgtatagattttctttgtggggtgaccaaaatgttctgaaattagatagtggtaatggttatacaactttgtgaatatactaaaaactactgaattatacattttaaagaggtaaatttttatggtatgtgaattacatctcaataaagctgctaaaaataaaatagtagtcaaaaaggccccagttttctaactggagtctccttgtgtggcaataactcttacccaagacttctgttggtcgcatgaaaggggagcattcaaacttgttcatatacttccactggcttttgagaccttataaggcagatgccttccctagtacatacaagaatccaggaactaagaatgcactcaatgtagacccttataagctgatatctattttccactggaaagaagtggttcccctgcatctgagacttcccagaactgaaagcatcaaaggagcagctatctgaacctttccagtagcagctgctatgcactagtcggaggagtgtatgccaccacagatcaaatcccatgttaacaaacttatgccagtggaaatttcagtataaccaaatattttgaaaatctcaatcatttaaagtaataatatgtaataaaatgctagtgtagtaagagaaatgggatagtctcttggaattgattgtaatgggatatgacatctgtcattgtcaataggctgaattttagtcatcttagagacagaaaatgtaaaggataatagtttgcagtgtagttagagatgagaaacaataaaatgatggtaagtactagatgaataattttaaaaatgctatagtaattcaaaatttgctactagtgtccatttatagagcacctactttgagcatgaaaagttcccgggtactgtagacggaatgacataaaggtcgcctctgcctaaagtccattatttaaaagtttggtcagtttttctaaaactgctttccatttttaacaagcttatattcgtaaaagccaaaagtactgttttcttttgttctgtaatagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctgtaagtaaaaaataataatagaagcacaatttaaaaacatgacttatgctttcctttctcattttgtccacctttactgtagattttttttttttttaagagagacaacctttcgctctgttgcccaggctgcagtgcagtggtgccttcatagctcactgtaacttcaaactcctgggttcaagtgatcctgcctcttcaacctctcatttctaggactacaggcggcacaccaccatgtagggctaatttttaaattttttgtagagatggggtctcactgtgttgcccagactggtctcaaactcctggcctcaagtgatcctcccacctcagcctcccaaagtacggagattacagtcactgtacccagcctactgtagttttgtttgtttgtttgtttgtttgttttttaagatggagtctcgctttgtcgcccagactggagtgcagtggcgcgatctcggctcactgcaagctccacctcctgggttcacaccattctcctgcctcagcctcctgagtagctgggagtacaggcgcctgccactgtgccctgctaatttttttgtattttcagtagagacagggtttcactgggttagccaggatggtctcgatctcctgacctcatgatcctcccgcctcggcctcccaaagtgctgggattacagatgtgagccaacgcgcccggcctgtagatttttttataacatctttgtaaaagaattcagatgatatacccaaataacaaacagtagttaacagcttgtaggtttgcccagtccataaggccctgaatgattaggctcctgcctctctttggagccttgtctcatacgtgtctctgagatgtacaatacattccacccttacagaccttcaccatttattcattcattccatcttgcaacagatattgattgagttctgtggtgtacctaactctttcccattttagggtctttacacaagctcttccttttgccagaacactcttttctttcctcatttcctggctaactcttactcatccattagcctctttctcaaagccttctgtggccatcactacccacaaagtaggtaggtcttctcttacaggtgctcaaagaatgtatatatacttcattttctagtgtcattcatggttgtaattaaatactgttttaacttttgcttccacaactaggagctaaacccctgagggcatggactttgctgttttccgctgtgtctgcagtgcctggcagagtgtcttaacacttagcagttcctgagtaaaggaatgtctgctgaatgaataattgaagatagtcatcactatttcttctaacaatggcagttacacataaacggatgtgaatgagctgttcttcggcttgtttgaccttacacaatgttccttaaatagcagaatttgaactgggccaaaaaaaataattctcctactggccctgtcacactgtctgaaattttcctgtttctattcctccaagctaaagccttctacaggaaaacaaataagtaccactgaacctgtattctaaatgctggtcttctaacaaagattccaaaggaatgagacacgggcctgtttttactaagagacttgaattaaaaaaagaataatgggttctgcctaaacattatctgccaccaccacacctatatctaatggggagtaatttggcaatgactgttttaaaataagtttctggtgattggccagtaatacattattctggttttttttcttagagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaagggtatttaattttctttgtaaaaattaaatgttgttggtgttcccgaggagtaatgtatttgttttcagcatcaaaaagagcatttttatattttataagcagaaaatgaccataattaacaatattttatgtaatgattatttcaagaatagttttactgttctttagaaatgcttgttcacactaatatttttactattatttagatttgctttttctccatagtggatttataccattggacctattttctgtgatttaaggagaaaatagtattctgggaatatgaattttaattccttcattaccgttaagtttactttataatctaaagcaagtctttataactgtttctatttctttttcagttaaagtatttttaagcctagattttcgttttcttttaaatgattggtttatagaaagcagagaaacgtcattgatgctagattgataattgcacataatatttgaaatctttaatgttattcctttattttctatcttttgatctcatttcacagtggcaaaaataaaaacacagtcattaaagctttgattgatagtgttaactaaactcaaaagcacgcagccttgtatttatagaacaactgatcatgtacatatcttaatttaaaattatacacatcattttggagtaatgatttgtaaccatcagaacactgctttttttcctcttcaattgtttttctcttattctttagctctaagaaaatggaaagtgttatttttttcatacataccatacttaatacacttaaattagtcttgcccttttaaaaaaagcaccttcctcaaaatacttttgcaacttttctcttggaattgttttcagaaccatttacccatgcaaggaaacttatgtcatgattaccaattccttgaccctgcgtgatttattctttctgtttgtttgttttcctctcctttgtttccatactgtcctgatttgctgcttcctgcatagctgtgacccaatcagaggaggcacagatatgctgggctaaagccagtacacagtggggagaaagtctttgagcagcacataaaagcagctgtcagtgcccagagtataactaattgaccaataaagtgaccaacaaaggccataagtgagaatataaaagatgacgtctgtttcaaggtacttcatgtaggttttgaaaaataagctaaggaaagataagcttgtgaaaacaccccctttgttttgtccttccttcctttctttcctttcctctccttccctcccttcctccccagactgatctcaaacttttggcctcaagcagtcttcccaccttggcctccagaagtgctgggattataggcaagagttaccgcgcccagccatacctcttcattctctatcagagacacattatccagtggaaactgcattaccctgagatccgagagacttaggtgctagttccaacatgtgacctagcacaaatcacctatgttaatgggcctcaaagttccttagctataaataatagttaacattgtgccaggtattgcttcatatgcttcacaacaaggtttttaactgttaattttcacaaaagtcccttgagtttggtattgttattatctgcattttatagatgaggaaatggaggcatagaaaggttaagtgacttgtacaagatcattcaactaatatgtgacagaactaaaatttgaacctaagcagcctgactctagaatccacattcataaccacattattttgtgccctcaactcctatgttatctgatagaacaatttccacgtggtacctatgaccactttctgttctgatattcagttaaagaaatgaaataattatgaaagaccaattaacttttaattttacttcttcagtgtgatagagctttactttgtcctgatttttttttccagccacgtaacttaaccaaggtgggataatttggattagacagtgaacgcttgcattgttgtagctggtaatcattaaatttcagatttcagtgttcttggtctttctccagcgtcaagttacacatcataaatttaggcaagtttacaggtgcagtagtgaaagcttatttacaagactaacacaaatccaccttttccaagtcaatggcatgaaaattcaagcagtcagcgaaaacgttcctgcaactcaatgattctcttctaatttgggtaatcactggagattttatgaactgaattcagtgaagtaatagctggagttgttttcaacttgaagtaggcaacacattaaaagagatttggagaaatttttttcttgtgctgctctttacaaaaaagaaaaacttttaatttgagaagatatgaggctcctttagtttcagaatgtatttcaatcctcccttctccaaaaaacagtccttgggattatataatatatgcattagagctttaattccttctctgagctgcctaatctctatatagcacagtagtactgtatttggtcttgtgctacagtttttatgctcgtttcgtcctttctactagattgaagttattcaaaagtagagaccatgtttctcttatatttttatctcttacagcaccttacattgtaaaaatatttgcatgtagtcattgctcagtagaactttgtattttgatgaatatattggcttacattagaaaatgaatcaccctgcagtgaaattcctcttatgttagtctgtttaaaattctcctgtgttccttttttacctgactatagaacctgtcagtatcaagttgctgccactggccaggtgcagtggctgatgcctgtcatcttagcactttgggaggctgaggtgagaagattgcttgaggccaggaatttaagaccagcctgggcaatacagtatacacacacacacacacacacacacacacacacacacacgcacgcacatatatgtgcacacgtgtatatataaatttatatatctataaatttatatatatttatagatctacaaatttatatatataaatttatattaaaaatttgtatatatataaaatatatttataaatatataaatatattaaaaatttatatgtatataaatatatatttataaatatataaatatattaaaaatttatatgtatataaatatatatttataaatatataaatatattaaaatttatatgtatataaatacatatttataaatatatatatacataattatatatatttatatataaatatatataatttttatatatatatttatatataatttttatatataaattatatataaattttatatatatatatataaatatatatatgcacacatatatatatatataattttttgtaaaattagcctgccatggtggcacacgcctatagtctcagctactcaagaggctgagatgggaggatcacttaagcccaggaggtcagggctgaagagactatgggttgcaccactgtactccagcctgggtgacagagtgagaccctgtttcttaaaaaaaaaaaaagaaaaaaaagtagctgcctgcctctttatttaatctattgacccacaacagtatacatattatgtttttcaaacatttactttgtctttctaggtaatttaaatgctttatcatttctttaagtcagcttcttagttctgatgataattatagtttctgtacacaatacagatgattaaatttttactccatgataattttattttgatcagttgttttactatatggatcttaatttttcttacctagaaaagataagctacaaacactaacatttttaaagccagaatcaattttaaaatataaagagcattataaaggattaatggaataacagtaatttggaaactattcaatgaaaattagaactttccagctgtagaaatggtcctgtcatttcccacttacccatctccactctgacatattcttctcttacaaatttgtctgtataaaaataggctgagtagatagctctacaatcagaacataatggttttctaattaatatcatcctcagaactgtttttttcccttagatttacatttctcattaattgaggaagaaagactgacgttatttacctaaatacttttgagaatattattttaatcacagcaactagaaattcttatgttcattttacagattttgccataataggaaatcttttttgtgtgtttcccaaatattaagtttctgttagcaaaagtacattgtagaaaactataaaattctgaaaaggacaaagaataaattataaacaggtaagtttagataggttactcagcttattttctgtaagaatgtctggctattgcaatctaagcttatttcttcctgtatctccttttgcaatagattttgaaaagccatggtaaagatgaagaatgtgttttggaagcagaaaataaaaaactagtagaagaccaggagaaactgaaaactgaattaaggaagacttcagatggtaactttgtgtacatgtgaaaaagtaaaaagactagcatgatattttatgctgtacacttcactgtttttcctaaaacaaaactaatgcctaaatgttcttctaagataccgagaatgacctatttataaattcttgttcaaatatgaagataaaacattatgtcagccaagagaaacatgctctgttatacagaaaaacatgtaggtgtttcagatctgtgttgtaaatacagatgttcttgccttagcaaaagagctgtgttcctaaaaagttgtttataaatgtgtttttataaaaagaatcacatttttccatcatcgtatattcctcctctcagagaagcaattgtaggggaacagttttcttacaagaaaatatattgtttatttcaagcactaatatattctacctgttagacataaggaaagcgttccttgaaagaggtgggtaggcacagagtaggcaacaatatctgggatgtcagctaagaatttgagtgcctccttcccacataacattgcagtgtaggcttgaagtggagcatcccaactccattttcctgaaggcagcaatttcttctacattaaaaaaaaaagttttgctagtgtttttttcttagtcaaagaacaaattatttttgttgcatctgcacagcacagaaaagtagataacccaaattcagtgtcatccaagaaaactcagtgtaagtttgtggcttgatgatttgcaacatttctgcatacaacagatagttttttatgttggccagacactgagaaacctcactttcagttggtgttaaggtacgttgtttggatagggtttacttcaatcagggtgtatttgaatttgagatgaaaaacataaaaataaaagctaattctgtgaatagaacagaaatccactggagaatatttatgtgatacaaaattctttagtcacgttcctccttattatttcaagtgaaaaaaagaagacagttcagaagcaataagttaaaaaataaattacccttatagacaaagtggtatattatgtagttggcatagtatagcccaaaattcaagaatcttctagttggtactgttgccttttctgtaattccaaaagatttcgaacatgatcaagaaatgttattgtttatatgaaaatgaatttaatagttacctaccgtttacaacagacatttcagaagagaaactagtgttcttttttaaccctgcataaaatattgctaccaattcttttgaagaatgaaaccatctatttccaaaacacaaaaatattctttcaaaatcctgctttcttttttctgtatccaccaagaatctcttttcttatgttgtaagcagggtggcacaaaaataaaagatagacaagagtgtatgtgtgctacacttctcttaaccctgcacaattgagtttctcctttcacctttcaaaaattccagctctgagatattttgagttttaactctttaaatctggcataaaacttaacttagtattacatgagcatttctttaaaagacaaaatcagattttagaaaaaatgaactctttgacaatgtaagcattgtgtttacaatctgataacaactgataccagcttctgtgtttgaagtatagactgcagagctactttcaaagtgaattagtgttcaggtaaaggcagattttacctgttcgagtgtgtcctgtttggttccagcaagacatataatattttatgaacatgttttatttaccctaagtttttttaaaaaataacatttgtaatgaccttgagaagatcagagttccgtttctaaagaaggtgtttccttggtcatgttctgttgacctaaaccagttaaattcagtaaggtaagaactaagaaaatatatcaattaatagtgcatgatttggatgaattcagtggtacaatgctttgtgcacagtaccactcaaaaatgttcattgatttctaaatattgagggtgttaaggtgacaaggcttaagaaagatttagaaagagatcttacatttgaaaattgagttaaaaaaaagcaatttttttttttagaggaaaatagggtgttttccatatgaattttcttatcctttgtgttacttaaatctaagtgaaacattttctcccaagtgtattattggaaacaaaacgtaaatacaaatgtttatttaagctagttagccccaaatttaaaaagtggcattctgaaggcagctactgagaacactctatcagtagtggcaaacaccttcagtttttaacctccaactcctattttgaccaaagtttgtaaactattaccggtgcttccgtgcagtaatatcaccctagcacagacattgcatttagtggaaaaaccttctgatgtccaaagagattgattttaaaggtctcttccaggaaaactacttattttcataaatgaataccttcttttattcttttttttttttttttttttttttgagatgaagtctcactctgtcgcccaggctggagtgcagtggtgggatctggctcactgcaagctctgcctcccgggttcacgccattctccagcctcagcctcccaagtagctgggactacaggcgcctgccgccacgcctggctaatttttttgtatttttagtagagatggggtttccccatgttagccaggatggtctcaatctcctgaccttgtgatctgcccgcgtcggcctcccaaagtgctgggattacaggtgtgagctactgcgcccggtctcctttattcttataactagaaatatgtagcattcagtcattgtatgcatccaagcaatgataaaagtaaatatcgtttaaaaagtgattgagctgcatgtggaaatgtctgttcttcattcttttaggagcaggaatacatatagatataaaaaacatcccatattttaaaaggaattcttagggcttgccaatcttgtagtaaaggttgaattagcagtatatgtcttctacataaaggaaaagagaaaacagtaattgggggaaatttcttgaccatgcctttcttctgtttgttcctgctttcctttgttccttctttgtttcatcagcaatttttttttttttttttttttgagacagagtctcactgtcacccaggtgggagtgcagtggtgcagtcttggcttactgcaacctcgaactcctggactcaggagatcctcccgcctcagcctcctgagtagctgggactacatgtgtgcaccaccatgcccgcctaatttttttgattttttgtaaagacagggtctcgctttgctacttagtctggtcttgaacttctggcttcaagcccttcctcctcagcctccaaaaacgctgggattacaggcatgaactgctgtgcctgggcctcagcaatttttaaaagaacttttcaagtaattcagtcgttgtaaagtcatttaatgtggagcataattaacactttccttaaaaagtgtgcctcttgaggataaagcaaactttaaataaatttcttaaagcatatactaacaatcagaaactgagtgtaaagacctattatgggtacctaagtattagcagcacgcaatagagatactagatttggaccaggaaacagaacccttagtcccctacttaaaataatgataattcaactctcttcctggataaatgctttcatatcaccttgacttacgttgaacaaaactaaaattaccttttgcagaccaactttgatacccttgaagatgttaagttttttttactttttattgccagttaacatagggaccagatagtgaaaaatagctgaagtgtttttccagagaaattggagatcaagacaagatagaaaattacaggggaattgctgatctgtatacccaaaaccctaaattcctgcctcttcagtgttaagaataagacataagctttgtatacaagtttaaaaccatatgatttccagtttcttacaaatgaaccatatattcatctaaaaataaattctaagtttaccctaagcatgttttacagttgtaaatttttgtggacgtgaacttagttatcttttacttacagttatatcaaagcccccagcttattttaaaattattaatgcttaaaaacagtttgctgtttttagtcattttgttgttgttgttgttgttgtttttttttttttgctttgttgccttttaatgcacttttgtgatttaaataagaaaaaaacatattatttgttttcatgtctggaagtttctgtttctttgacacctttgtcccttcttgtatcaactgaaaaaaaaaactgcattaagaaagaataatatagtttatttgatggttgtgccagtaggcaatatataattaatagtattttaattatttaaagtaaataaaactcatgaccaatccttttagttaggtaaataaaggatttattagtatttattagttcatctctgtgttatcttcacatattgatgttattgtcaaaacagaaaaaagggtttgcttgctatcagagtacttttcttggactaatatataatgatgatattgcatcctgtttggttccctgttacattcccatttagttgtgatgtttccctttcttgtgagcttcttatctgttatcaaggcctatactcataaactatgtgtctttcagtaaccaggaggaatagctatagggaagatattaagacagaaattcaaagataccttatatattattcacagtactagcaaacataacgatatctaccctgaggagaagcttttataatctccacagagggacattaaagcaagagaaaacagtttgttctcagaagagcttgtagtccagatggtaaaccaaacatatgtccataaagggattcatttcctccccagtgtgaaacatgggctagtctaccaaaaacatgagtggagagtgctaaatgcatactgaatcaaggaatgttccaggtgttaaagatgtaatcaagcacaattctctaaatgtgttgatggacatagaatggcagaaaaatgagtgaaatgatactactgttctgagtgagaagagcaaagcaaaaagcagagtggtctgtttgaagtcgatgtgtcacactaggtgcagtgaatgattgtgctgtatggttgaggggtccattgatgtagcccctaaaagatcgaaggagataattactttgaatgccttggtgttcttttctactgtcttattccatacctagatatgcatgtttactacaatccttcatggtaaatacttttctaatgatatcagcttatggcaggttcatgtttatggccaagtgagttacaaaaattaaactgtacaactctagttttaaaacactttcaattaggaaaaaacactaaactattaatagtggttttccttagcatgtacaacaaatgactttttcctagagtttaaattattttctacaatgaatttcttttgcttaatgaaaaagatagctttttattgtaaaaagaatttaaaaataaaaataaaaaacctcttccaaatacccaggtaatctagggcggtagttttttggcttgaattatctaattaattggctgtattccaactttactttgttggtagaccctaaatattagaagctgttcatatagcttttgctaagttatatgaattacattgcaaaatctgaggatacactgggtaatcttggtgaagtcattgactctttttaggcatagttttctcttttgtaaaatgagagactgaactagttaaactttaatgtctattatatagctccaaataatgtaattaagcaaaactgactatcaagaattattttcattgttggctttttgacccttcaaattatatttatttttcatgagaaaaatcttttcacagtaacttccctttctccaaacttaataagctcagcaggtgattaagccacattcttcacttttgaagaatgtttcatgcaatcttaggatctttaggacaggatctggcaggttttatgcatctgttagctcacaacacaagtgtgctatgtaaaatgggaacacaagtgtgctatgtgaaatggggccacaagtcttaaatgtagggcattgggagaagagaggatatgccagtaaacagaaccaattctcattagtgttagagcgtggctgtttgtttagaacatttattagaactattgatatggaataataaaactttgcagaagaaatgatttaagaaattagcatgttcttttcattataattatgttagggaaataaaaaatgggactagatctctagaggtcttcccagctctgagagcctttgttataaaagggagtatttatctggagcaccttttacttttttttattttatcaaagttttacatatacatatttttaaagcaaaatagtaacacaaggcttataatgaaaaagagcagtctcctgaggccctgtccccagaagcaactacattcaactcctttagaaatgtcctctgaggccgggcgcagtggctcacgcctgtaatcccagcactttgggaggccggggcaggtggatcatttgagctcaggagtttgaggccagcctggccaaatatggtgaaacactgtctctactaaaaatataaaaattaaccggatggtagtggcacgtgcctgtaatccccactacccgggaggctgaggcagaagaatcgcttgagcctgggaggcacaggttgcagtgatccaagattgtgccactgcactccagtctgggcaacagagtaagatcctgtctcaaaaataatgttctctgatatgtgcctccaggtttctaaatgcagtgtttaggtagttttttcttgatctttcagtatgggatattatctttgactttgttatagggaagacgaggacttagacctctttatctcacccagtttccctcctggctcctcatacttcccatccccctccatcctttcaatttaaatatatcataacttttactatatcatattattacaactatatattcatcatcattatgaggatttcctttgcctctttcctgtattgataccctctttcctgaattccatgttttctttctttttctttttttttttttttttccgagacagattctccctttgtagtgcaggctggagtgcagtggcgcaatcttggctcactgcaacctccgccccccaggtcccggttccagcaattctgcttcagcctcccgagcagctgggattacaggcacacaccaccatgcccagctaatttttgtatttttagtagagatggggtttcaccatgttggccaggctggtcttgaactcctgacctggtggtccgcctgcctcggcctcccaaagtgctggaattgcagatgtgagccactgtgcccggcctggattccatgttttctacttttgtataggttttgaaagtcacagaggtgccagctttcatcacattgtatcaagagtacatattattaacataacttatcagttttgatgttgaccttgatcacctggctaaaatagtgcttgtctagtttctgaactgtaaagttcctcttttccctcctttttccataccgtaatctttgtgaatcactgttcacagcccacacttcagaaatggggatcagtgtgcaaatgagtggattaaaaaaaaaaaaataagaaagggaagttacgctcaacctccttgaaagcagagtatctgtgtaaattgtttggaattctacacagatttgtctgttgtctaccatttgtttgtcagtatggactcataggtatttattttataatttgggttataatttaatactactttagtttattgttcaggttgtccagctttcaccattgggagctctttcatttggctcctgtgtccctttgacacatttccattttggatatttgtttgtttgtttgtttgtttgtttgtttcatttttggagcacttccttactttctggcattacaagatactccaggcttatcttgaacatttcctgccccattcttagaatcaatgtttagggattttttttaattgggctggattctttggtactatttatttatattttatttttgattctggagtagtatgagatatttgtaacatgagtatattttcatcaaaatatttcaagaatggtctctttgctttgttttggctatcctgagtattttggtttttgattgacggtgtttttatcaagattactatcaggtgactaaagtaacactttgtattgttcacctgacatttatcatttccaagtgaactgtttacacacaagtgaatttttcaaatgcttaaagcttacacttttcatttattcattctttcattccttcaaggagcatattttaagcacttaccaatactaggcaatatgctaggtactcagacagataagacacagctctgtttcttgagtagtccatagtctagtaagggcatagttgcccttcaattcaatacgtggtgtggtgaaacttgagttgtagtagaagccaacactggagatcgacactttcttgacattttaaaggatgacattaattagccagatgaagtaggaggagatggacaaggtgttataacaaaaatgagcagcatgtaaccaaaggagtatggcacttttgaggtactacaaggagctcaaggcaactggagtgtaaaagaagatggaaccagtggagagagttgagcagtaggcctagaagccatcctgaagggcctcatatgccctgtttgtacgttaacattttcagggcactcttagagggtttttaggcacaagagcaatcactttgacagcattatagacaatggattcaagtagacgggcaactacgtgagaaatccacttaataatctaatctggaaatgaggacagtggtcacagagctggagtggaaggtatggattggagagctataaaggaacttaacagctatcaacaaactttatcaacagatgggtgtgaggttaaaagagattaggtgttgattgaagtgatgaataaaacgtaaatctttacctacacagacctcacaatataggcatgtacaaaagaaggataatataattaaaccacagtttatgtccttactgaacagaagtttgtatgtctactttccaagtatcttggaagcattactgtagattaacaatccaataagtgatcattggcaaaggagtagtacatgtgaggattaaatactgaatagctccagtgtatcacactcttgaattctcagaaagagaaccaaataaattggaaagaaaccaacactagacatatggaaatttttcaaataaaatatgttttcctctggctcagtccttacagctgttgtacaacagcccaactttagctgtcatgccagtgcctctaaaaacttccatttcctggcagagctttactggcagtgtttctatctctggtcgaaatcacagtgatacaatacatttacacggtacattagtctcaccagctcctcccacttttgcaaatagttccgtaagtgaacgtttgacacttggaaagacaacaaatgtttttgcttactatgtgtcactgtaacattagttgaagtcattttctatattaataaatgatgcaagtgcctttaaaaatatctaatggaccataacctaggacataacagtctcttattgaatctagccagtattcttagcaaatatctcagtatttccataaagccactggcaagtgatagcagcccgtttttgcagttaagaaaattgcagtagcaacttagatgtatcatctaaagcctccttgtccaataatatttttcttatatatgctgtttccaaaataatatgcctcaaaataaaataagcatattcacatgtcagataacaagtttatatagtcccttggttacagatgcagttgcaaaaggaggtggaaggcatccaaaacacaataatttttataaaatgagataaaggactgggaaacagtccaagatgtgtctagacaataatagcctcccctaattggagtgatagtattcattagatttattaatatccactgaaatacaaaatgaaataagaaacacattttataccttggcttagtaagtggcagaaaaacagtatttgtctgcatttgttccgttaataactttataccagtagtaaccagaagaaactcctagataggctgtacaagtggttttctagcttcttttaaaaaggaactactgggttgatatctaagatatattaaatttattaaataacttcttaatgtcagaaattcaagtataaattgtttttgacattaagaccaactcctgttcattacaagcacctgaccaactgtcttaatagaaagtactctagactcagtagcttataaacaacagaaatttatttctcacggttctggtggctaagaagtctgagatcaaggccccaataaattaggcctctgatgagggcctgtttcgtgattcgtagatggtaccatcttgctatgttctcacataatggaaagggaaaggcagctctctggggcctctttttattagtgcacgaatcccattaatgaggaccccacccttatgacctaatcactccccagccacgcctcccaatacgatcacattggtaattaggtttcaacatatgaattttgtggagagacaagcattcggaccataacaacaacattcttaaaactaccattgtaggccaggggcagtggctcacaactgtaatcccagcactttgggagcctgaggtgagagaattgcttgagcccaggagttcaagacctgcctgggcaacatagtgagacctcatctctacaaaaaatttaaaaattggctggggtggtagagcaagatgttgtctcaaaaaaaaataaacaccattgcaggctagtcagccactattagattgtggaatctactgtgtattttatgtaccagaaatccagggtcttaaacttttttgctgagctctgaagataccaccaccatgcatcatattttcaagtagcctctaggaaatgccttgtagaacccaaattgaaaactaacgtataactctttatgttgtgaaggtggtcctaatgaaatctaaccatccccaaaagtgtcttccatacctgactcatacctttagcaagtgacatcacattaaatttgtcaaaatcagtctttaataccttatttagaattatgcagctatagaaggaacatggaggaaattatagagctgtgctgcccaatatggctagccactagctcacatgtggctgtttaaatttaattgaacttaaattgaaaatataggtcctcacttaaactagccacatttaaagttcacaatagccacatctaagtagtgactaccgtattgacaacgcagatgtagaactatgtagaacatttgacaatactgtctagaaagtactgatacaaaaagcactttagttgataatggcttatatatttatataaaaatgcctatatgatgacttctcaagagaaaagattgtttataactggaacctataattttatttcattgtgccagaaaagtagcttttaaatttataaattctacttttttcccttaaactcctaccctaaaatacttccaaatgtagaacttctgaaggctacatatgatatagagctacttcaggattcccagagtttggaaaaatgatttctgaaagcactatatgagataaaagtttcaagtatgacaactctaatttttctaccccattttgtacagctcttctacatattttgctcattagcaccttcttcacaatgtattgttttatatatatatatatatatatatatatatatatatatatatatatatatttattttacttctatctaaggccctgaatctgctgacatatgacttgtagctccttggtaggtaaaggtcaatatatagtaattcttgtgtgccattatcttgaggagcaggatgtttgcatagactaaattgtcttcctatatattgctgctttagttacaaaggttaaaattgtaagtataaaatggaaaaaccagtgagggacagaggaactttggatgtaatgggcctctggatgccctgagaagcatttaatatcacttatattcatatgtaagtggatgcatgacctgaatttattcatgaggaaacatcagacaaaaacaaagtgaaagaacattctatctaaaaagtggcctgtattctttaaaatgtcagtatcatgaaagatggggagaagagggctgtgataatggtagggaattattccagattaaaagaaattaaagagatatgataactaaatgcaatatgtgatcttgcactgtatcctggactagcagtggagaaaatgcttaaaggacatgattaagacagttccaaaaactggcatatggatgataaattagatttaaagtattgtattcatattaagtttcctaaatttggtgactatactatggttatgttagataatattttgtttctgggaaatacattcacagaaatgtattgaagagtagaggggcacgatgcctgcaccttattctcaaatgagtcaagaaaataatagtgtgtgtgaagagagagaatatgataacaaatgtagcacaatgttaacagtggatttgagtaaagactatacaggagttctctatttaagccttgtaacttttctataaatttgaaattattctgaaataaaaataaaactattcgatattttctagccctttctaaggcacaaaatgatgtgatggaaatgaagatgcagtcagagagactttcgaaagaatatgatcaactcctgaaagaacactctgaacttcaggtgggtgtgacatgcactttatgcacctaaatgttttgaaatagtaattacctaagtaaattatttgggttatttgtccttaactaatcaagatgatgtacttaatcctggctttgttaaacgatttaaagaagccagatttttacctagagggtaaagattaggacattgcaggaaaatacaagataattttaaggaattgctgacttgcatacttacagcattccagttttggtgaatttttaagcaaaagaagccacaaaaatggcagcattggaaaacagactggttctagaaaaggtgagttttgctctttgggatgtttgccatattcatgccaaaatgaggccaaaatttcaagttccacatcacactactcttgtctcagtgttttagacatattaggacaagactttagcattcaaatttatcatttacctccaaatgttgatttgaaagatggaaatgggaaaaaaatgtttcattgttaaagccacaaagtcagatctgggccataggttttctttctctttctctctaattcaataaaagaaatggtcatccctgttaggcttgtctttcctccctcccttctgctgccagccagtaacctgaattgatttctcagacacactctgatcaattggggaagagaccattccagagacagccctggccttccctcccagtttctcccaagacagactggttgggcttgtcttcaaaatttggcagcctttgtggctttcagtcagggctttttacaaataatagctttttatttcactgtacacatttccctgcatcttaatggtcatggtatctccaagactcagcactgttcctggcacaaggcaagcatacactatactcatagactttgtagtcagacctacttggaatacctacctatacctggctgcatgctaggttttttatcttaggcaggttatagcatccctttggggctcacttctttcatctataaaaattgaaacaataatgatgcctggctcactggattgttaagagaactaaataaaatgtgtaggttttttagcactatgcctagctgacagtaaacactcaagaaatgataggtattatcatcatcatctgtattacttcctctgtaggaattttgctgaaagaatgacttattctcaaccaaccactttggccttggtttagagccagtaattaagtaacccaaagcacatatttgtaatctgatattcccagttggtttgcatgtttggtttaactagcctactttgacaatagcaaaagacaaggtagccagagaagggtgaataccctgtatgctccaatcccaggacactgagggctcagttcacatggcctggagcagataggtagattgtcagcaagaccaccccttccccgtctcaaaaatagagaccctaaaattgctgacctcattggggcatgataattattcgtggtatctttcaaggtccaccttggaaagtgaagaagtcacttcagagacctcttgcctagaaatacaacattttccccctatttgtgagattagggtttactcagccaggttgagtatcgacattagtggactttgccatgatgtcagacatgcttagatctttgaatggagaaaggaaaaccagaagtatgccttcagtttcttatggccagtgtccattgttgaatgtctccattgttgaatgtctccattgttgaatgtctccattgtggtaacagccattggttctcttaattctgaagaatatatataacagtgagatttcctcaacccatttcctccccacagaaaagccacagtcagcctggagctgctgcattcttggtaaaggaagtagaaagcttttaagagtgattcctggctgagcgtggtggctcacacctttctttaatcccagcactttggaaggctgaggcgggcggatcatgggagatcaagaccatcctggctaacaaggtgaaaccctgtctctactaaaaatacaaaaaattagccgggcatggtggcaagtgcctgtaatcccagctactcgggaggctgaggcaggagaatcacttgaacctgggaggcagaggttgcagtgagccgagatcgcgcttttgcactccagcctgggtgacagagcgagactccatctcagaaaaaaaaaaagtgattccttcccaagaaaatagttgttataatagttgtcatacctgtttctgtggaaaagaccccatcccagattatgccagacaccatgccgagagtagggccttgtttgatagcacttcaggacttgatctaatttctgcttgtatccagtttttgaaatatttaatagatgtcatttgttgagagtatgctctggactaagcacttggctaagggcttcgtatatgttgttttgtttactctccatgacagctcaataattgaaagtattttaatatccctattttgtgaatgaggaaactgagacccagagatgttatataatttatcgaaagtaactagaaagtgatagcattcaaagtcagagaatctttctccagaacctccatcattaaccactatgttctttggcctttgctgatcattggattgtgttcttggatccattctcctctcaccactgctttactctgtatctctgggaggcccgtttccaaggctcccttgctgtctgactcagtctgggcaggtttagccagtggcaggcactagaagactgaaggcaggaggaaggggaaagccagggatttcttctactctttctgctatagaggccttctcctttatgactccagttccttccctctaggtcccactgggcagcttctacatactggccttcgcacctgggctccataaccctcatccctccagcccaagaagtggtggtggcttttctgctattgataatcccagaggtgccttaccaccctgtttggtgtgtgtactttttcatcacctgtaaaaccaatttcccataatatctctgttggaaggaaaacaaaatctcagctccatagtttaccacttctgtaacccacaggtgactcatttgacatctatgctcctcaggtactttactacttaaataaaggttgtaataccttatgaaaattaaaccagatcctgtataagaaagcactttatatatttataatcaagaatgctatttattatgtcctgactggttacatttttttccttcacctacccatcccccaccgttgtccaatatgagaccctgtataagattctcagatttagatatcattaagagccccattttgtttgtttgtttgttttttgagacagtgtctcactctgtcaccaagactggagttcagtggcacaatctcagctcgctgcaacctccacctccccaatttaatcgattcttgtgcctcagccttctgagtgactgggactacaagcacatgccaccatgcgcagctaagttgggtatttttagtagagacagggtttcaccatgttggccaggctggtctcgaactcctgacctcaagcgatccgcccacctgggccttccaaagtgctgggattataggctcgagccaccgtgcccagccaagaacccttttctttaactcttgtgctttaatgttcgtctgagccctgcttgagaagcaaaagatagttacagatcctctatggtaaaaagctctatcaaattgtcctcatgaatttacttctgttgtcaaactaatcttagatattgaattatatgctaaggttctttggaactagcttcctgaattttacacagttgacatattttcattggaacaatcataaaacgaaagatcattaaaatattaaggaaacaaaggttaaagagggaaacgctgatttctttactgtaaatagatcccaatttgcatcttttaaatccttttggatttccccatctggtcccctccctgttataggcactaaataaatattagaaaacagtcccttcaaaacatgtagtcctttccttatttgccctgcctctcttctaaaaaaaaagaaaaacagaactaactagagattattggctgcacaaacccatcagcacctgccagtttttaaatttcattttggaaaatcagccatcacttaagggacttgtccataatagcttcattaaagctttgttttttatcaaaagggggccacatatgtaaacttgtggaagtaatttacctcctctactcttgtctttttatttgattgcaaaagttaatgttattaaagttgctatggaagcattaatgttcagcctgaacaagagcttgacgaacttctttatacaagcaataacactctgcaaccccattttatgagatatttttcatgatgtagacatttactttcttagcacaagtgatctcttaagattaatttcttttccattttccttcagttttaaatgatgtaatatagtaatctttataacatgatcagccaagtataatttgagaagtcagttctgttggcaaatatctgaaggacaaaaccaaagccaccctagctgaggtttttgtcccttccttctttcatttaccaaaaaccttaattgggttaacagtaggggaattttagaaatcatgttttcctaatgtaacctgtgaaacaaaagcaaaatagattaaggcaaggggaaaaatgaacttaccaagagtgttctttttcctaagtaaaaaccacaaattttatagttttttaaattttagactttctcaatcctttttttcacatttaattattctcataagtatacatagaagagagaatgttttttaaaagtccttgtcatgtctatgaatctgtttctctttgctgtactacataaatcatatttttttccttacaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccggctgtggctccagagtctgtgccctttaccaccgtgcccaactgtttcacatgctgtgtttggtagtttttcctagtactctccttaataatggtggtgtttagcaaattgtattacataaataaatatttatttcatggattgagttatgttgcatattaaattactttccttcccattgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttctggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctctgtgggctggttcagttctgcattcccattccagtgtccactgccttctcgctatccctcccatctgtgcgccaccaccagcttatccccagccctgctaacatgacaaactattgtgcatttgagtgcccactatacaatgtgtgaatataaccgtgcttttaagcattgactttaatgtctgggatgatccgtctagagtccatggaaccctcctgtgttttttcatccctttcttagtaatcttggaaatccacttatgaaattctttttctaacatttctttgctgaacggcatttttaaaattactttcacggtgtttctttccagtttgatctctacacaaacacaactttattacttgcaccagaaatgatttcaaacactttaggaactgtggtaggcttaattatgacttcccaaaagatatccctataccaatccctggaacctggaaatgttctcttctatagcaaaagatatgattaagttaaagtcttgagatggagagattattctgggtaatctgggagtgccctaaatgcagctacatctatgcttatatagaagcaaagggagatattaccacacagaagaggagaaagcacagtgaccacagaggcagagattggagtgatggagccgcagcaaaggaatgctgacagccaccagaagctggaggaggcaaagaacagattcttccccagagcctcttccagcaggagcatggccctacagataccgataaaactgatattggacttcctggcctccagaactatgggaataaatttattgtttcaagctatcaagtttgtgattatttgttactgctgccatagtaaattaatacaggagcatgcaggacagatctgtaatggcctgaactgaatttcaaggggtgtggaaaacagttactctttaacaccactccgtcttccccattagccatttggataagtcaaagatagccttagccatctcctatcttagttacttttctccttcaactgtattttgccattgtcgttgccattgcctctgcctaactgcaagccatcatcatctctcacatggactatgacgacctcctcatctccctgtatcttctctaatgcttctctcatatacatgctctcagcagccacctggtttaaaacaaaaacaaaaaaaacactaatcatgtcattccctgcttgtcttcccgttctttccaactgtcattccctgcttgtcttccaattctttccaactgcagttaagatcaaaccaccaagacctcaccaggctcccatctacttttcagcctcaactcagtccacctgctctgccaatcacacctgtttctttttgttgttctttccctaggatatagatcctggcatacctgcattctgattcttcttggaacaagccaaattctttcccctgtcagtacgtttgcatgtgtagtacatgttgcatcccaggcctgtctgccttcttaccctattttattttcatcatagcacttactaccatctgaaatgatctcatttatggtttgtctcctcagtgattaacacagttcctgcacacagtaaatcagtagttctcaacaggaagtgaagaggtcatcctgaggggaacatttagcaatacctagagacatttctggttgtcataaccaggggaatgctcctagtggatagaagtcagggaggctgttaaacccattccacaatgcacaggactggaacaaagaatgatctctcactcagaatgtcagtgttgccaaggtggagacatcctgcagtagatgcttgtggcagagggtactggttgtaccccagtatccattctttcattcacctgtgttaatacatgctccagttttgtatttttttttataaacagctgtcaagcataaagataacattttccatctccttgtatgtaagtggaaataggactgtcatgtggggccagtttcttttttttcttcctctgtcctgctgcttgaaacatatgctgctatcttagatcatgaggtcgaggccatgcaaagtggagcaacaaggagctgtgtccctgacgccataagcaccacacctgtcctgaattgctgtgaatgacaccagctaactacaatgcattgtctcaacatcctagacataataaaaagccataaatatgtttgtcctatgcagcacaaaacctttgtatctttgccttttatgttgggatcttaattaaaaattacatcctctactgtc

SEQ ID NO: 1835 - DNA, 43342 bp, Homo sapiens
tagacctggaccccggcaccctcccgccggggccgcacttagcagtggaaagtctgtcctcctgaagaagttgcgctccgacctccaagcatcaggtcaaaagtctaactcattctctgacctgccgccaattagaaaacaactgttgccaataaacgtggtcgcgccgcctgtgacctcagccgggacggacccgcgggcgggagcctgcggggcgtgaggcggggtggggccctggctcccctcccccgcccagccgcggcgtctgacgtcccgcgcgtcggcggccgcggagcagcgcagggagccaggcgggctgccggcgggtaagggcttctgcgacccggggacccgtggggcgtaggccgcggagggagagcgccgctgcctggtctggagaaccccgcggagctggcctggcccgacccggcccggcccggtccgcggcgcggtggtcgagggcccgcggcgccttctgggagcgggagggccgggaagccgggcgttggtggagggaggcgttgggcttctgtcgccgcgaagctggcggaaaaggcagtggccagcgagccgcctcgccagttcccacgactcccagggaggtggcgacacccgcttcccgggccacccttttccccttcctgaccggggtccgtgcttgccttcccaggtgggggaaggtggaacactgtccatcccctggacaaaaacgctgcgcctcggggccttgaacccggttttgtttgaaaggaagcaagagaaaataagtgtttttccatttaggtgtgaagaaaaaaatgacactccaatgggctgcagtggcaacctttctttatgccgaaataggactcattttaatcttctgcctaccttttattcctcctcagaggtaggaaaccttcaaatcgttaactaataaatattggatcgctcttaatgtaaaatggaaaaagttttctgaacattaaaaagtttcgaaagtctttgaaaataaactcacctaacgaattaggtagtatataatgacaatattaaaataacattttatataaaactctgttacgtgtacaagtgaaataactttttcttcccttctaaaagaaaaggcgcctatacttttgattctgttgattacagatataataaagcaacgattatacttttaacacctgccctgccttgtctcaggttttacctttgttttattgccctgaattggagccatgaactaaataaatataagtggataaatcatgtttacagtacagcatgggtgtaaaagtgtttcactgaggcactggaacagcaatttagaaaccaaagccaataaattattcttagttttcgcctttgtaaccgttagtttcattaatgacaattttactacttttgatttcacataaaattaatgaatgtatattaaaagtgctgaatgtgaaaagtatcacaaccatgtattagcattagttcgttagtgacggaacttctaaggtcttgaagaaccaagtacagtgtttcaagccaagcagtggttcattttacccttgcagtaatctactttttagtcgtttaattttagatccagaaatttgatagtatgaatggggaaatacacatgtaataaaaatattgcaagatatttgttcatactcctggcataaaagaaagtatttcataagtgagatcctagagataacccactaaagtgtattaaaatcccaggactgggagaaacttcttaaagtttcaccttagctcagggtccagatagtctttcacaactcctaacttgctccttacctgcctggatttctgctctcttctgtccttctctatcagctaagctaagctcagtaagttgtttcttactaaagaaaaaaaattgaatcatactgtagggtctttgatcttatttgatccattccacccatgttctatatatcacgtactgagacccaggagggcaagtagcctacggttacctagctggtaagtgacagattctagaaaaaaatctggctcttagtccagtgttctttctactccatcatgctgcctctcatcctgtaggttttgtttcaaactcagtaacaccctgttttgctttttggtaatatttgcaatgatagaatcctatatactcaagagaaagaaagattttgtatataaacatctaatttatagataaggcttaagggtttgcaaagaaggaaaaattgtcagttgatctttactccatcagagtgatctgtaacttatggatcaatatttttcttcctgccaaataaaaattttacccatcctgatcaagtagctattagatagatgtgtgtatatttgcatatgatatataaatgtgttctcatgtacagatataaagaaaatacggtatgtatgcacgcagatcatttacaatatgtcctatgtgtgtatccacatctttttatcttttatatttgtatcaccataatctttaaagaaaatatttcatcatttagtctctattattttcttacataacccagtggttaaaggcacatgctcagaaatcaggtcacctataactgcatgttactaaccttgggcatgctcttgatcctctctgatctgtttccccatctgtaaaatggaggtagtactagtgtctaccccttacggtagttgttgtaattaaatgagataaaacatgtaaaagtacttagaaccataatatagtgagaacacaataggtattagctatgataaggtgctcaactgctagttgttccctatgagagatctcttacattcccttttacaccacaccaaaccttgaagaaataagtaaatttacatttggacctagatcaaggtattaccacttatgttctcttaaaaatataaaattttatattgcataatttaaatattggctgtataaaatgcttggacttggaagcagagacaaaatgaaccgattcatctgtatgaatctccctcaacccaccaatttcaagtagttacttgaagttgtcctaatcttaaatcttaaatgtgtcctaatcttaaagtgaaactgtttttttcaagttgtaagtgcttgaagctatttaagtgcttactacatttttctgcctcctttcaactaaagtgttactcatttaaattgcccttgtacaaagtttgttacctttcctattgcgtgatggattattttgccactttgccatttataacccatgctttcttaccactgtctttgtttatactgttcaatccacctagactatttccccatctcatttcctctatgttcacatctttatctgtagtaattacatggttttatatatatatatatagtgtgtgtgtgaaaattatcaagctacatatttaagattttttcaatttatgtgtataatacctgggtagtttttataattccctcatggttaaagtagagaaacttttagttggagtatacgttaaaattgtactatataaaaatcagtatgcagagttagaccccactcctgaaatgttgccaattgttagaacaatatatctttatttctaagtcatttctctgaccatgaaaaagatacagagtagtagcttctatcaacaatataatattttactactgcaagaattcctttttaaggttttgctcatgtatggtttacttttagaatatttaagccaccagacagaggataatcaaatatcaggttattattaaatttgaaagagttgttttttaattcatgagatattctgtcatgtcagaattaataaattttaaaattaaatttctgtaattttcacttgctacacaattactaaaatgttacttcagtatttaaaaagtatttcaaaactttattttagtttttttatacctaatataattgtattgctttacagatggcagaagattttttcatttaatgtctggggtaaaattgcaactttttggaacaaggctttccttaccattatcatcctattgattgttctatttctaggtaagtactagatcccttctttgaataaatataactttttttaaatgaatttctttttaattaatagagttgatgttacaattggtgtacagttgactttatatagtatattgatagtacatagagtggatactgatctattgatacacagttgatagatactaccattctgtatgttcaagcttaagtttcaacagggcacaatgattcttaaccccttctaggttattttaagatttaaatgctgtatattaatgcataccttgctgttcagagttaccagactttatttttcatggtgttgtctctcctttgttactgtgatgtcctaggcacccaggagcttagctgttagaaaggcaaataaaagaatagaatcattaggctctccaaaggagtcttagatgcagggtgtgcatttggactggattaaaaaataaacatggccgggcgaggtggctcaggcctgtaatcctagcactttgggaggccaaggcgggaggattgcctgagtccaggagtttgagactagcctgggcaacatagcaaaaccttatctttacaaaaatgtaaaaattagccaggtgtggtgatgtgcacccatagtcccagctactcgggaggctgagagactggaggattgcctgagcccagaagttcaagtttgcagtgaactattgcactccagcctgagcaacagagcaagatccttccttaaaaaaacaaacaaacaaacaaaactgcaacatagatttggggactaccgcaaaaatttgaatatggagtgattgtataatattagggaatttttgttaactttagttgtgataacagcattgttacatagcagggtcagcaacctatatagcctgtgggccaaatacctatttttgtaaataaagttttattgggaaatgaccatgcccatttgtttacataatgtctgtactcgtttttcagcatgttttaaattttcatggtaacagtattttaaaaattaaaagtagacctttaggttcttgtcaaaccagaagttccatgagtcttagtaatcaccatgtttttccagttgttactgagctcagagaaattgagtgacttgtctaagattatctagctacttcttgaaatgccccttcttgcacagagtatgttttccctcagaattccctcagagttgttgtgttgttggttaaataggatttagagaggcgaacttgggaccctaaccgccatctttgacactgttttgtgagaaaatgtcttccatgttccaaaccaccaatctctcaaatagaatcctctttataaaactaagaacatctggtatgagaagggatggtattgtcaaaaacagaaaggtgtgaatgatttgtgcctcttttcaagatgtaaatatttgtctcatggtacattattaatgttatggattgaatctctagccatataactagttatgagaagtcagtaaagaacaataaggaaaaccggttccagttctgccaccagctaactaaaggacctttgaaatggcttttatttcctgggtttgatttattcatcttgtgaaataaagggagagatggaaagaatctctgcagctcctgattttatgatcttctaactctaaaattatcacaaaaatttctattgaaaactgtcacttatcatgtaagggaggggagttgtagtataagttcttttggttacattagaaacaaacttggccgggcgcggcggctcacctctgtaatctcagcacttcgaaagaccaaggcaggtggatcaacctaaggtcaggaattccagaccagcttggccaacgtggtgaaaccctgtctctaccaaaaatacaaaaattagccgggcatgggggcgcgtgcctgtaatcccagctactcaggaaactgaggcaggagaattgtttgcacccgagaggcagaggttgcagtgagccgagatcgcgccattgcactgcagcctgggtgacaagagtgaaactccgtctcaaaaaaaaagaaaccaacttgaactcgcttgactaaaaaaggaaaaatttgtaataaaatacggggctgttgcagagtagcccaagaaaggaaggaagccaaattccagggagggattagtacttggaactgaaatgtccttttcttggccatatacatttttcctatatatacttcattcttttttattatggactctgatattctgtctatctccaaggcagtaaatgggtaccacacagctgccaggtgtggtacccattccagacgtatgcaagggttaattcatcatctctgaatcccaattccacatcaaaggaaaaaaaattggaccagctagtaccagttatctactcctcatctcctataaccaggaaggtcacaagggagaatcatgactgctggctgaagcctgcatctttgggtaaacagggcaattaattcccagagaacaaggacatcatggatagttaaggcaaccagataggtgcttatcctctaggtctccatccaaaatggagtaatgacacctactttcgtgttttaagatttaaacgcagtaacatatgtaaagtgcagagtctgatgttcgagtccacaacgatgtaaataatgcaaaaccagtggattactcatgcttaatttatattttacttggaaatttatttcctttttcttggttatctctctaaataaggtaacttttttatacattttctttttatatgtatttattctttttttttttttttttgtgacggggtctcactctgtcaccaaggctgaaatgcagtggtgcgatctcagctcactgcaacctccactttccaggctcaagtaattctccagctgcagcctcccaagtagctgggactacaggcgagagccaccaacccctggctaatttttgttttttttaatagagacagggttttgtcatgtttcccaggctggtcccaaactcctgagctcaaagcgatccgcccacttcggcttcccaaagtgctgggattacaggcatgagccactgcacccagccaaaataaggtagctattaagaagtgtttgtattcttagagccaacactaactgagtgtgtgcatacaagtgtgtgtgcatgtgtgtgtattttaggtgctggtaagagacagaatggaagtgggaatttcaagagtgtgtttagtgttagcagaaatgcatcccaggaatttgaaagtttccataactgatctaaaattggatcatcttcaggtggtttatagaaaattgactatatgtcacatccttcccttattgttgactccattccatttttcagacatagttacctttttagtatacaggtgatgtattctacaggtatgtttacatgaccattgacattaataaacctttttaatattattggttaatcttcagcttttctgcataatggattcaggagtattattcccatttaattaccaaggaagatgaatcacgaagcataatgatccttcatagtactcactatttgcctatttaaaataagtcgtaaatatatattatctttgttggttttttggtagtggttggcatgctcttactatattattgaggcaatctgagaaatgacaaaggggaaatagccattaagatacaggaaattttctaaagatcatttaagagactactttatataactatgcaaataaattggaaaacctagataaaatgtataattttgtagaaaaatatgatttaccaaatgaacaccagtagatatagaaaatttaagcagactaatttatatagaaaaattatagaaagttatcaaaaaggacccctatttgaaaaaaaaagcaaaaaaccagatagttttataagaaaccctactgctttcagaaaacagatattactactgcttcttaaactgttctagaatttaaacttcaaattgtacagagctagaaaaaagcaagctgtagaattgaaaataagtcagaacaaatgaactgaatagtacatcagattgcaatatataacacagagaaaaataattactcttgaacatagtactcttaactttttacctcgctggtagggtacattttaagaaccaagaggattacaatgaaatctgaaactttataatagttttattgttggtaatttaaaagctgttttatgtatagtgcagcatcaagcaaattagtatgttcatggtattagaaactaagactttcaggaatagatatggcatacaaatataaagtcaaaaattaaggattttttaagttttagagtgatttatttgggttttattttggagtatggaaatgtggaactagatagaggtggtagttgcacagcattgtgaatatactaagcatgactgaattgttcactttaaagtgtttacttttatgttatatgaattttgcctcaataaattaaaacaattttgttaaagacataggagtctggctttgttcatagcaaaacgggttgtattagactatttctcctgtgttaaaaattatgaaccctcgataaaatacgaaaaaaggtatttgaaggccttgtagagcaaccaaaagcaggcagaaactagagggacgtcaacccttaaaagaagggaatcatactgggtgtgatcacatttatatagcctttcttccaaccgctttccagtcatgtggcatagacaacgatatagaactcaaagcaaaaagacagtcttaactgacttaaggggtcagaggtcagatagattcaaaaataagaaggatgtctaagaaaggagagaacccaaaaagggaaccccaaaatccacatgtaaactccccttaaattcttggttgactcttcaaccatggatgtgtaggaaagattccaaggaaatcaatgaaaaggaacagccagcaaaaagcagcaaggctgagaagaaattttggctgctggccaccaaggagagacagagtttggagtatgagcctcatcacgttagaggggcttggtaaagaccttgaacctttccactaaaatcacagaagggctactccttaggaatagagactatatcccaggaattagaaatttactataactaaggcctaaagcaaaatagacttaccctaaaaaagtataaaaatcaagcctctctaaacagctgtaaactgtacatcagcagtccccaccctttttggcaccagggaccagcttcatggaagacagtttttccatatgcaggagcaggggatggtttcgggatgattcaagcacattaaatttatatgcacttcatttctattattattacattgtaatatataatgaaataattatgcaactcaccgtaatgtagaatcactgggagccctgagcttgtttcctacaactggacattctcatctggggatgatgggagatggtggcagatcatcaggcattagattctcataagaagcatgcaacctagatcccttgcacgcgcagttcacaaaagggcttccactcctatgagaatctaatgccaccactgatctgatagcttgggcagtaatgtgagcgataaggagtggctgtaaatacagatgaagctttgctcactggcctgccaatcacctcctgctgtgcagcccaattcctgacaggccgtggagcagtacaggtgcatggctccaggtgttggggacccctgctgtacataatctttgcaagggcacatgaatatactaaactctcttcaccaagatacactatattctgggccataaaacaagtctcaataaatacaaaggattgaagtcctaccaaggattggaatcatatagagtatgggggttttgtttttgttgttttatagagacagactttcgctttgttgcccaggctggtctcaaactcctggcctcaagtgatccttcctgttcccaaaatgctgggattacagatgagagctactgtgcccagcccctacagagtatgaaaatagaaatcagtaacagaaatctggaaaacctatacatgtttgaaaattaaacaagacttgttagtaatccttgggtcaaagaactcacaaaggaaattagaaaatattttaactgaacaataatgaaaatacaatatattaaaattttaagatgccattaaagcactgcttaaaggaaaaattatagatttgaatatttatttttaaaaaagatttaaaatcggtgattttagtttccaccttaataatatctacccattatattgaatattgacagtgaaaaaaataatattcactcagttgttttttaaagatttagaaggaagatttctcattctgatgaagagctacaaaaaacctcaagctagcatcatacttaaatatcaaagtcttcccccataagattggaaacaaggcaaggatatttacactctgtttattcatttgagtaatagatgtcctagccagggtaataataagtcatgaaagaaatgaaaggcttaaagattgcaaagaaagaagtaaaatatccttatttgcagatgacacgattatttatatagaaaatcctggcctggcacagtggctcactcctgtaatcccaccactttaggaggctgagttgggcagattgctcaagctcaggagttgcagaccatcctgggcaacatggctaaaccccgtctctaccagaaagtacaaaaattagccaggcatggtggctcatgcttgtagtcccagctactcaaaaggctgaggtgggagagttgcttgagcccaagaggtcaaggctgcagtgagacgtgatcacatcactgcactccagcctgggtgacaaagcgagaccctgtctcagaaaaaaaaaaaaaaaagaaagaaagaaagaaagaaataatcctaaagtatctacaagaaagttattatgtcaaagaaattaatatagtggggtcacaaaatacaggtgggtcagtatacaaaaattcagtgtatcagtaattgtatttctatactataagcagtaaacaataggcaaatgacatttttaaaaattccttttctaagtacaccaagaagcctaaaaaccttagaaataaactttataaaagaggcacaacagctctatacagaaaactacaaaaacattgctgaaagaaaatcaaaataaatggggatttttcatcagttggaatactcaatattattaaaatgtttgttcttccaaaattctacggacataacacagtccctgtcagaaacccaacaggcatttttgtagcagttgatcagttgcttctaaaatttatgcagacatgcaaagaactcataaaacagtcaaaaaatctttacaaataacaaaattgggagactcacactaccagatttcaacagtaaaggggaaaataaaaacaggttagtgggctttatctaatcagctgaaagccttaatagaacaaagattgacctcctctgagcaaaaaggaattttgaccgcaggttgcctttggactcaagatgtatttcttccctggatctccagactgccagtctaccctccagattttaaacttaacaagcctctacgagcatatgagccagttccttaaaataaatctcgagctctctctctctctttctctctctgtctgccccctgtaccacttttccccatacacacatacacacacacacacaccctattggttctttttccctggagaacccttacatcttaactaagtaatcaaatttagcatcaaaaagtatgagacaaactaacattacacagcataaactatgagggattcttgccaaaagtattaaaccttatccaatcaagtatttgttttattttatttttactttctgaggcctggcagaaccaatcaagtctgacttctggttttctaaaaatacaggagttagagaaagaaattggactacactcagacaaattcagaatgtgagaactttctttgtgcttattttttttttaatatttaaaaaaagagacagggtcttgccattttgcgcatgctggtctccatctcctggcctcatgctatccttctgcctctgcctcccaaagtgctgggattacaggtgttagccaccacacccagccagaatgtgagaactttctagaaaacaattggcctggcacctttttaaaaaagtattatatgtcaagagactacagaaacataactatatgtaatgagtatccattataaaattctcagtttgaaaaaaattctatgaaagacatttgggagacaaataaagcaaataacccaatttaaaaatgggtaaaggatctgaatagatatttttccaaagatgatatacaaatgatcaacaagcacatgaaaagatgttcaacagcattagctatcagagaaatgcaaataaaaaccacaaagaaatgccactttacacccactaggatgactataatcaaaaatataataacaagtgttgctgaggatatggagaaattggaaccaacatacactgcttgtgggaatgtaaagtagtacagctgctttggaatacagtttggcagttcctcaaaaattaaacatagagttaccatatggcccagcagttcatctcttaggtatgtaccaagagaaatgaaagcacatgtcgatataaaacttgcacatgaatgttcgtagcagcgttattcataatagccggaaggtggaaacagctcaatgccatcaaccaatgaatagataaaccaaatgttaccacattcatacaatggaatattattcagccataaaagtaatgaagtactgacacatactacagtgcagacgaactttgaaagcattatgctaagtgaaggaagccagacacaaaagagcagatagtatatgattcagtttatatgaaatgtctagaacaggtagttctgtagagacagaaagcagattgctggtcaccaggagctgagggatgtgtatagattttctttgtggggtgaccaaaatgttctgaaattagatagtggtaatggttatacaactttgtgaatatactaaaaactactgaattatacattttaaagaggtaaatttttatggtatgtgaattacatctcaataaagctgctaaaaataaaatagtagtcaaaaaggccccagttttctaactggagtctccttgtgtggcaataactcttacccaagacttctgttggtcgcatgaaaggggagcattcaaacttgttcatatacttccactggcttttgagaccttataaggcagatgccttccctagtacatacaagaatccaggaactaagaatgcactcaatgtagacccttataagctgatatctattttccactggaaagaagtggttcccctgcatctgagacttcccagaactgaaagcatcaaaggagcagctatctgaacctttccagtagcagctgctatgcactagtcggaggagtgtatgccaccacagatcaaatcccatgttaacaaacttatgccagtggaaatttcagtataaccaaatattttgaaaatctcaatcatttaaagtaataatatgtaataaaatgctagtgtagtaagagaaatgggatagtctcttggaattgattgtaatgggatatgacatctgtcattgtcaataggctgaattttagtcatcttagagacagaaaatgtaaaggataatagtttgcagtgtagttagagatgagaaacaataaaatgatggtaagtactagatgaataattttaaaaatgctatagtaattcaaaatttgctactagtgtccatttatagagcacctactttgagcatgaaaagttcccgggtactgtagacggaatgacataaaggtcgcctctgcctaaagtccattatttaaaagtttggtcagtttttctaaaactgctttccatttttaacaagcttatattcgtaaaagccaaaagtactgttttcttttgttctgtaatagatgctgtgagagaagtaaggaaatattcctcagttcataccattgagaagagctccaccagcagacctgatgcctatgaacacacacagatgaaactttttaggtctcaaagaaatctttacatttctggattttccctatttttttggctgtaagtaaaaaataataatagaagcacaatttaaaaacatgacttatgctttcctttctcattttgtccacctttactgtagattttttttttttttaagagagacaacctttcgctctgttgcccaggctgcagtgcagtggtgccttcatagctcactgtaacttcaaactcctgggttcaagtgatcctgcctcttcaacctctcatttctaggactacaggcggcacaccaccatgtagggctaatttttaaattttttgtagagatggggtctcactgtgttgcccagactggtctcaaactcctggcctcaagtgatcctcccacctcagcctcccaaagtacggagattacagtcactgtacccagcctactgtagttttgtttgtttgtttgtttgtttgttttttaagatggagtctcgctttgtcgcccagactggagtgcagtggcgcgatctcggctcactgcaagctccacctcctgggttcacaccattctcctgcctcagcctcctgagtagctgggagtacaggcgcctgccactgtgccctgctaatttttttgtattttcagtagagacagggtttcactgggttagccaggatggtctcgatctcctgacctcatgatcctcccgcctcggcctcccaaagtgctgggattacagatgtgagccaacgcgcccggcctgtagatttttttataacatctttgtaaaagaattcagatgatatacccaaataacaaacagtagttaacagcttgtaggtttgcccagtccataaggccctgaatgattaggctcctgcctctctttggagccttgtctcatacgtgtctctgagatgtacaatacattccacccttacagaccttcaccatttattcattcattccatcttgcaacagatattgattgagttctgtggtgtacctaactctttcccattttagggtctttacacaagctcttccttttgccagaacactcttttctttcctcatttcctggctaactcttactcatccattagcctctttctcaaagccttctgtggccatcactacccacaaagtaggtaggtcttctcttacaggtgctcaaagaatgtatatatacttcattttctagtgtcattcatggttgtaattaaatactgttttaacttttgcttccacaactaggagctaaacccctgagggcatggactttgctgttttccgctgtgtctgcagtgcctggcagagtgtcttaacacttagcagttcctgagtaaaggaatgtctgctgaatgaataattgaagatagtcatcactatttcttctaacaatggcagttacacataaacggatgtgaatgagctgttcttcggcttgtttgaccttacacaatgttccttaaatagcagaatttgaactgggccaaaaaaaataattctcctactggccctgtcacactgtctgaaattttcctgtttctattcctccaagctaaagccttctacaggaaaacaaataagtaccactgaacctgtattctaaatgctggtcttctaacaaagattccaaaggaatgagacacgggcctgtttttactaagagacttgaattaaaaaaagaataatgggttctgcctaaacattatctgccaccaccacacctatatctaatggggagtaatttggcaatgactgttttaaaataagtttctggtgattggccagtaatacattattctggttttttttcttagagttttgagacgtctggttacgcttattactcaactggcaaaagaactgtcaaacaaaggtgtacttaaaactcaagcagaaaatactaacaaggctgccaaaaaatttatggaagaaaacgaaaaactaaaaagggtatttaattttctttgtaaaaattaaatgttgttggtgttcccgaggagtaatgtatttgttttcagcatcaaaaagagcatttttatattttataagcagaaaatgaccataattaacaatattttatgtaatgattatttcaagaatagttttactgttctttagaaatgcttgttcacactaatatttttactattatttagatttgctttttctccatagtggatttataccattggacctattttctgtgatttaaggagaaaatagtattctgggaatatgaattttaattccttcattaccgttaagtttactttataatctaaagcaagtctttataactgtttctatttctttttcagttaaagtatttttaagcctagattttcgttttcttttaaatgattggtttatagaaagcagagaaacgtcattgatgctagattgataattgcacataatatttgaaatctttaatgttattcctttattttctatcttttgatctcatttcacagtggcaaaaataaaaacacagtcattaaagctttgattgatagtgttaactaaactcaaaagcacgcagccttgtatttatagaacaactgatcatgtacatatcttaatttaaaattatacacatcattttggagtaatgatttgtaaccatcagaacactgctttttttcctcttcaattgtttttctcttattctttagctctaagaaaatggaaagtgttatttttttcatacataccatacttaatacacttaaattagtcttgcccttttaaaaaaagcaccttcctcaaaatacttttgcaacttttctcttggaattgttttcagaaccatttacccatgcaaggaaacttatgtcatgattaccaattccttgaccctgcgtgatttattctttctgtttgtttgttttcctctcctttgtttccatactgtcctgatttgctgcttcctgcatagctgtgacccaatcagaggaggcacagatatgctgggctaaagccagtacacagtggggagaaagtctttgagcagcacataaaagcagctgtcagtgcccagagtataactaattgaccaataaagtgaccaacaaaggccataagtgagaatataaaagatgacgtctgtttcaaggtacttcatgtaggttttgaaaaataagctaaggaaagataagcttgtgaaaacaccccctttgttttgtccttccttcctttctttcctttcctctccttccctcccttcctccccagactgatctcaaacttttggcctcaagcagtcttcccaccttggcctccagaagtgctgggattataggcaagagttaccgcgcccagccatacctcttcattctctatcagagacacattatccagtggaaactgcattaccctgagatccgagagacttaggtgctagttccaacatgtgacctagcacaaatcacctatgttaatgggcctcaaagttccttagctataaataatagttaacattgtgccaggtattgcttcatatgcttcacaacaaggtttttaactgttaattttcacaaaagtcccttgagtttggtattgttattatctgcattttatagatgaggaaatggaggcatagaaaggttaagtgacttgtacaagatcattcaactaatatgtgacagaactaaaatttgaacctaagcagcctgactctagaatccacattcataaccacattattttgtgccctcaactcctatgttatctgatagaacaatttccacgtggtacctatgaccactttctgttctgatattcagttaaagaaatgaaataattatgaaagaccaattaacttttaattttacttcttcagtgtgatagagctttactttgtcctgatttttttttccagccacgtaacttaaccaaggtgggataatttggattagacagtgaacgcttgcattgttgtagctggtaatcattaaatttcagatttcagtgttcttggtctttctccagcgtcaagttacacatcataaatttaggcaagtttacaggtgcagtagtgaaagcttatttacaagactaacacaaatccaccttttccaagtcaatggcatgaaaattcaagcagtcagcgaaaacgttcctgcaactcaatgattctcttctaatttgggtaatcactggagattttatgaactgaattcagtgaagtaatagctggagttgttttcaacttgaagtaggcaacacattaaaagagatttggagaaatttttttcttgtgctgctctttacaaaaaagaaaaacttttaatttgagaagatatgaggctcctttagtttcagaatgtatttcaatcctcccttctccaaaaaacagtccttgggattatataatatatgcattagagctttaattccttctctgagctgcctaatctctatatagcacagtagtactgtatttggtcttgtgctacagtttttatgctcgtttcgtcctttctactagattgaagttattcaaaagtagagaccatgtttctcttatatttttatctcttacagcaccttacattgtaaaaatatttgcatgtagtcattgctcagtagaactttgtattttgatgaatatattggcttacattagaaaatgaatcaccctgcagtgaaattcctcttatgttagtctgtttaaaattctcctgtgttccttttttacctgactatagaacctgtcagtatcaagttgctgccactggccaggtgcagtggctgatgcctgtcatcttagcactttgggaggctgaggtgagaagattgcttgaggccaggaatttaagaccagcctgggcaatacagtatacacacacacacacacacacacacacacacacacacacgcacgcacatatatgtgcacacgtgtatatataaatttatatatctataaatttatatatatttatagatctacaaatttatatatataaatttatattaaaaatttgtatatatataaaatatatttataaatatataaatatattaaaaatttatatgtatataaatatatatttataaatatataaatatattaaaaatttatatgtatataaatatatatttataaatatataaatatattaaaatttatatgtatataaatacatatttataaatatatatatacataattatatatatttatatataaatatatataatttttatatatatatttatatataatttttatatataaattatatataaattttatatatatatatataaatatatatatgcacacatatatatatatataattttttgtaaaattagcctgccatggtggcacacgcctatagtctcagctactcaagaggctgagatgggaggatcacttaagcccaggaggtcagggctgaagagactatgggttgcaccactgtactccagcctgggtgacagagtgagaccctgtttcttaaaaaaaaaaaaagaaaaaaaagtagctgcctgcctctttatttaatctattgacccacaacagtatacatattatgtttttcaaacatttactttgtctttctaggtaatttaaatgctttatcatttctttaagtcagcttcttagttctgatgataattatagtttctgtacacaatacagatgattaaatttttactccatgataattttattttgatcagttgttttactatatggatcttaatttttcttacctagaaaagataagctacaaacactaacatttttaaagccagaatcaattttaaaatataaagagcattataaaggattaatggaataacagtaatttggaaactattcaatgaaaattagaactttccagctgtagaaatggtcctgtcatttcccacttacccatctccactctgacatattcttctcttacaaatttgtctgtataaaaataggctgagtagatagctctacaatcagaacataatggttttctaattaatatcatcctcagaactgtttttttcccttagatttacatttctcattaattgaggaagaaagactgacgttatttacctaaatacttttgagaatattattttaatcacagcaactagaaattcttatgttcattttacagattttgccataataggaaatcttttttgtgtgtttcccaaatattaagtttctgttagcaaaagtacattgtagaaaactataaaattctgaaaaggacaaagaataaattataaacaggtaagtttagataggttactcagcttattttctgtaagaatgtctggctattgcaatctaagcttatttcttcctgtatctccttttgcaatagattttgaaaagccatggtaaagatgaagaatgtgttttggaagcagaaaataaaaaactagtagaagaccaggagaaactgaaaactgaattaaggaagacttcagatggtaactttgtgtacatgtgaaaaagtaaaaagactagcatgatattttatgctgtacacttcactgtttttcctaaaacaaaactaatgcctaaatgttcttctaagataccgagaatgacctatttataaattcttgttcaaatatgaagataaaacattatgtcagccaagagaaacatgctctgttatacagaaaaacatgtaggtgtttcagatctgtgttgtaaatacagatgttcttgccttagcaaaagagctgtgttcctaaaaagttgtttataaatgtgtttttataaaaagaatcacatttttccatcatcgtatattcctcctctcagagaagcaattgtaggggaacagttttcttacaagaaaatatattgtttatttcaagcactaatatattctacctgttagacataaggaaagcgttccttgaaagaggtgggtaggcacagagtaggcaacaatatctgggatgtcagctaagaatttgagtgcctccttcccacataacattgcagtgtaggcttgaagtggagcatcccaactccattttcctgaaggcagcaatttcttctacattaaaaaaaaaagttttgctagtgtttttttcttagtcaaagaacaaattatttttgttgcatctgcacagcacagaaaagtagataacccaaattcagtgtcatccaagaaaactcagtgtaagtttgtggcttgatgatttgcaacatttctgcatacaacagatagttttttatgttggccagacactgagaaacctcactttcagttggtgttaaggtacgttgtttggatagggtttacttcaatcagggtgtatttgaatttgagatgaaaaacataaaaataaaagctaattctgtgaatagaacagaaatccactggagaatatttatgtgatacaaaattctttagtcacgttcctccttattatttcaagtgaaaaaaagaagacagttcagaagcaataagttaaaaaataaattacccttatagacaaagtggtatattatgtagttggcatagtatagcccaaaattcaagaatcttctagttggtactgttgccttttctgtaattccaaaagatttcgaacatgatcaagaaatgttattgtttatatgaaaatgaatttaatagttacctaccgtttacaacagacatttcagaagagaaactagtgttcttttttaaccctgcataaaatattgctaccaattcttttgaagaatgaaaccatctatttccaaaacacaaaaatattctttcaaaatcctgctttcttttttctgtatccaccaagaatctcttttcttatgttgtaagcagggtggcacaaaaataaaagatagacaagagtgtatgtgtgctacacttctcttaaccctgcacaattgagtttctcctttcacctttcaaaaattccagctctgagatattttgagttttaactctttaaatctggcataaaacttaacttagtattacatgagcatttctttaaaagacaaaatcagattttagaaaaaatgaactctttgacaatgtaagcattgtgtttacaatctgataacaactgataccagcttctgtgtttgaagtatagactgcagagctactttcaaagtgaattagtgttcaggtaaaggcagattttacctgttcgagtgtgtcctgtttggttccagcaagacatataatattttatgaacatgttttatttaccctaagtttttttaaaaaataacatttgtaatgaccttgagaagatcagagttccgtttctaaagaaggtgtttccttggtcatgttctgttgacctaaaccagttaaattcagtaaggtaagaactaagaaaatatatcaattaatagtgcatgatttggatgaattcagtggtacaatgctttgtgcacagtaccactcaaaaatgttcattgatttctaaatattgagggtgttaaggtgacaaggcttaagaaagatttagaaagagatcttacatttgaaaattgagttaaaaaaaagcaatttttttttttagaggaaaatagggtgttttccatatgaattttcttatcctttgtgttacttaaatctaagtgaaacattttctcccaagtgtattattggaaacaaaacgtaaatacaaatgtttatttaagctagttagccccaaatttaaaaagtggcattctgaaggcagctactgagaacactctatcagtagtggcaaacaccttcagtttttaacctccaactcctattttgaccaaagtttgtaaactattaccggtgcttccgtgcagtaatatcaccctagcacagacattgcatttagtggaaaaaccttctgatgtccaaagagattgattttaaaggtctcttccaggaaaactacttattttcataaatgaataccttcttttattcttttttttttttttttttttttttgagatgaagtctcactctgtcgcccaggctggagtgcagtggtgggatctggctcactgcaagctctgcctcccgggttcacgccattctccagcctcagcctcccaagtagctgggactacaggcgcctgccgccacgcctggctaatttttttgtatttttagtagagatggggtttccccatgttagccaggatggtctcaatctcctgaccttgtgatctgcccgcgtcggcctcccaaagtgctgggattacaggtgtgagctactgcgcccggtctcctttattcttataactagaaatatgtagcattcagtcattgtatgcatccaagcaatgataaaagtaaatatcgtttaaaaagtgattgagctgcatgtggaaatgtctgttcttcattcttttaggagcaggaatacatatagatataaaaaacatcccatattttaaaaggaattcttagggcttgccaatcttgtagtaaaggttgaattagcagtatatgtcttctacataaaggaaaagagaaaacagtaattgggggaaatttcttgaccatgcctttcttctgtttgttcctgctttcctttgttccttctttgtttcatcagcaatttttttttttttttttttttgagacagagtctcactgtcacccaggtgggagtgcagtggtgcagtcttggcttactgcaacctcgaactcctggactcaggagatcctcccgcctcagcctcctgagtagctgggactacatgtgtgcaccaccatgcccgcctaatttttttgattttttgtaaagacagggtctcgctttgctacttagtctggtcttgaacttctggcttcaagcccttcctcctcagcctccaaaaacgctgggattacaggcatgaactgctgtgcctgggcctcagcaatttttaaaagaacttttcaagtaattcagtcgttgtaaagtcatttaatgtggagcataattaacactttccttaaaaagtgtgcctcttgaggataaagcaaactttaaataaatttcttaaagcatatactaacaatcagaaactgagtgtaaagacctattatgggtacctaagtattagcagcacgcaatagagatactagatttggaccaggaaacagaacccttagtcccctacttaaaataatgataattcaactctcttcctggataaatgctttcatatcaccttgacttacgttgaacaaaactaaaattaccttttgcagaccaactttgatacccttgaagatgttaagttttttttactttttattgccagttaacatagggaccagatagtgaaaaatagctgaagtgtttttccagagaaattggagatcaagacaagatagaaaattacaggggaattgctgatctgtatacccaaaaccctaaattcctgcctcttcagtgttaagaataagacataagctttgtatacaagtttaaaaccatatgatttccagtttcttacaaatgaaccatatattcatctaaaaataaattctaagtttaccctaagcatgttttacagttgtaaatttttgtggacgtgaacttagttatcttttacttacagttatatcaaagcccccagcttattttaaaattattaatgcttaaaaacagtttgctgtttttagtcattttgttgttgttgttgttgttgtttttttttttttgctttgttgccttttaatgcacttttgtgatttaaataagaaaaaaacatattatttgttttcatgtctggaagtttctgtttctttgacacctttgtcccttcttgtatcaactgaaaaaaaaaactgcattaagaaagaataatatagtttatttgatggttgtgccagtaggcaatatataattaatagtattttaattatttaaagtaaataaaactcatgaccaatccttttagttaggtaaataaaggatttattagtatttattagttcatctctgtgttatcttcacatattgatgttattgtcaaaacagaaaaaagggtttgcttgctatcagagtacttttcttggactaatatataatgatgatattgcatcctgtttggttccctgttacattcccatttagttgtgatgtttccctttcttgtgagcttcttatctgttatcaaggcctatactcataaactatgtgtctttcagtaaccaggaggaatagctatagggaagatattaagacagaaattcaaagataccttatatattattcacagtactagcaaacataacgatatctaccctgaggagaagcttttataatctccacagagggacattaaagcaagagaaaacagtttgttctcagaagagcttgtagtccagatggtaaaccaaacatatgtccataaagggattcatttcctccccagtgtgaaacatgggctagtctaccaaaaacatgagtggagagtgctaaatgcatactgaatcaaggaatgttccaggtgttaaagatgtaatcaagcacaattctctaaatgtgttgatggacatagaatggcagaaaaatgagtgaaatgatactactgttctgagtgagaagagcaaagcaaaaagcagagtggtctgtttgaagtcgatgtgtcacactaggtgcagtgaatgattgtgctgtatggttgaggggtccattgatgtagcccctaaaagatcgaaggagataattactttgaatgccttggtgttcttttctactgtcttattccatacctagatatgcatgtttactacaatccttcatggtaaatacttttctaatgatatcagcttatggcaggttcatgtttatggccaagtgagttacaaaaattaaactgtacaactctagttttaaaacactttcaattaggaaaaaacactaaactattaatagtggttttccttagcatgtacaacaaatgactttttcctagagtttaaattattttctacaatgaatttcttttgcttaatgaaaaagatagctttttattgtaaaaagaatttaaaaataaaaataaaaaacctcttccaaatacccaggtaatctagggcggtagttttttggcttgaattatctaattaattggctgtattccaactttactttgttggtagaccctaaatattagaagctgttcatatagcttttgctaagttatatgaattacattgcaaaatctgaggatacactgggtaatcttggtgaagtcattgactctttttaggcatagttttctcttttgtaaaatgagagactgaactagttaaactttaatgtctattatatagctccaaataatgtaattaagcaaaactgactatcaagaattattttcattgttggctttttgacccttcaaattatatttatttttcatgagaaaaatcttttcacagtaacttccctttctccaaacttaataagctcagcaggtgattaagccacattcttcacttttgaagaatgtttcatgcaatcttaggatctttaggacaggatctggcaggttttatgcatctgttagctcacaacacaagtgtgctatgtaaaatgggaacacaagtgtgctatgtgaaatggggccacaagtcttaaatgtagggcattgggagaagagaggatatgccagtaaacagaaccaattctcattagtgttagagcgtggctgtttgtttagaacatttattagaactattgatatggaataataaaactttgcagaagaaatgatttaagaaattagcatgttcttttcattataattatgttagggaaataaaaaatgggactagatctctagaggtcttcccagctctgagagcctttgttataaaagggagtatttatctggagcaccttttacttttttttattttatcaaagttttacatatacatatttttaaagcaaaatagtaacacaaggcttataatgaaaaagagcagtctcctgaggccctgtccccagaagcaactacattcaactcctttagaaatgtcctctgaggccgggcgcagtggctcacgcctgtaatcccagcactttgggaggccggggcaggtggatcatttgagctcaggagtttgaggccagcctggccaaatatggtgaaacactgtctctactaaaaatataaaaattaaccggatggtagtggcacgtgcctgtaatccccactacccgggaggctgaggcagaagaatcgcttgagcctgggaggcacaggttgcagtgatccaagattgtgccactgcactccagtctgggcaacagagtaagatcctgtctcaaaaataatgttctctgatatgtgcctccaggtttctaaatgcagtgtttaggtagttttttcttgatctttcagtatgggatattatctttgactttgttatagggaagacgaggacttagacctctttatctcacccagtttccctcctggctcctcatacttcccatccccctccatcctttcaatttaaatatatcataacttttactatatcatattattacaactatatattcatcatcattatgaggatttcctttgcctctttcctgtattgataccctctttcctgaattccatgttttctttctttttctttttttttttttttttccgagacagattctccctttgtagtgcaggctggagtgcagtggcgcaatcttggctcactgcaacctccgccccccaggtcccggttccagcaattctgcttcagcctcccgagcagctgggattacaggcacacaccaccatgcccagctaatttttgtatttttagtagagatggggtttcaccatgttggccaggctggtcttgaactcctgacctggtggtccgcctgcctcggcctcccaaagtgctggaattgcagatgtgagccactgtgcccggcctggattccatgttttctacttttgtataggttttgaaagtcacagaggtgccagctttcatcacattgtatcaagagtacatattattaacataacttatcagttttgatgttgaccttgatcacctggctaaaatagtgcttgtctagtttctgaactgtaaagttcctcttttccctcctttttccataccgtaatctttgtgaatcactgttcacagcccacacttcagaaatggggatcagtgtgcaaatgagtggattaaaaaaaaaaaaataagaaagggaagttacgctcaacctccttgaaagcagagtatctgtgtaaattgtttggaattctacacagatttgtctgttgtctaccatttgtttgtcagtatggactcataggtatttattttataatttgggttataatttaatactactttagtttattgttcaggttgtccagctttcaccattgggagctctttcatttggctcctgtgtccctttgacacatttccattttggatatttgtttgtttgtttgtttgtttgtttgtttcatttttggagcacttccttactttctggcattacaagatactccaggcttatcttgaacatttcctgccccattcttagaatcaatgtttagggattttttttaattgggctggattctttggtactatttatttatattttatttttgattctggagtagtatgagatatttgtaacatgagtatattttcatcaaaatatttcaagaatggtctctttgctttgttttggctatcctgagtattttggtttttgattgacggtgtttttatcaagattactatcaggtgactaaagtaacactttgtattgttcacctgacatttatcatttccaagtgaactgtttacacacaagtgaatttttcaaatgcttaaagcttacacttttcatttattcattctttcattccttcaaggagcatattttaagcacttaccaatactaggcaatatgctaggtactcagacagataagacacagctctgtttcttgagtagtccatagtctagtaagggcatagttgcccttcaattcaatacgtggtgtggtgaaacttgagttgtagtagaagccaacactggagatcgacactttcttgacattttaaaggatgacattaattagccagatgaagtaggaggagatggacaaggtgttataacaaaaatgagcagcatgtaaccaaaggagtatggcacttttgaggtactacaaggagctcaaggcaactggagtgtaaaagaagatggaaccagtggagagagttgagcagtaggcctagaagccatcctgaagggcctcatatgccctgtttgtacgttaacattttcagggcactcttagagggtttttaggcacaagagcaatcactttgacagcattatagacaatggattcaagtagacgggcaactacgtgagaaatccacttaataatctaatctggaaatgaggacagtggtcacagagctggagtggaaggtatggattggagagctataaaggaacttaacagctatcaacaaactttatcaacagatgggtgtgaggttaaaagagattaggtgttgattgaagtgatgaataaaacgtaaatctttacctacacagacctcacaatataggcatgtacaaaagaaggataatataattaaaccacagtttatgtccttactgaacagaagtttgtatgtctactttccaagtatcttggaagcattactgtagattaacaatccaataagtgatcattggcaaaggagtagtacatgtgaggattaaatactgaatagctccagtgtatcacactcttgaattctcagaaagagaaccaaataaattggaaagaaaccaacactagacatatggaaatttttcaaataaaatatgttttcctctggctcagtccttacagctgttgtacaacagcccaactttagctgtcatgccagtgcctctaaaaacttccatttcctggcagagctttactggcagtgtttctatctctggtcgaaatcacagtgatacaatacatttacacggtacattagtctcaccagctcctcccacttttgcaaatagttccgtaagtgaacgtttgacacttggaaagacaacaaatgtttttgcttactatgtgtcactgtaacattagttgaagtcattttctatattaataaatgatgcaagtgcctttaaaaatatctaatggaccataacctaggacataacagtctcttattgaatctagccagtattcttagcaaatatctcagtatttccataaagccactggcaagtgatagcagcccgtttttgcagttaagaaaattgcagtagcaacttagatgtatcatctaaagcctccttgtccaataatatttttcttatatatgctgtttccaaaataatatgcctcaaaataaaataagcatattcacatgtcagataacaagtttatatagtcccttggttacagatgcagttgcaaaaggaggtggaaggcatccaaaacacaataatttttataaaatgagataaaggactgggaaacagtccaagatgtgtctagacaataatagcctcccctaattggagtgatagtattcattagatttattaatatccactgaaatacaaaatgaaataagaaacacattttataccttggcttagtaagtggcagaaaaacagtatttgtctgcatttgttccgttaataactttataccagtagtaaccagaagaaactcctagataggctgtacaagtggttttctagcttcttttaaaaaggaactactgggttgatatctaagatatattaaatttattaaataacttcttaatgtcagaaattcaagtataaattgtttttgacattaagaccaactcctgttcattacaagcacctgaccaactgtcttaatagaaagtactctagactcagtagcttataaacaacagaaatttatttctcacggttctggtggctaagaagtctgagatcaaggccccaataaattaggcctctgatgagggcctgtttcgtgattcgtagatggtaccatcttgctatgttctcacataatggaaagggaaaggcagctctctggggcctctttttattagtgcacgaatcccattaatgaggaccccacccttatgacctaatcactccccagccacgcctcccaatacgatcacattggtaattaggtttcaacatatgaattttgtggagagacaagcattcggaccataacaacaacattcttaaaactaccattgtaggccaggggcagtggctcacaactgtaatcccagcactttgggagcctgaggtgagagaattgcttgagcccaggagttcaagacctgcctgggcaacatagtgagacctcatctctacaaaaaatttaaaaattggctggggtggtagagcaagatgttgtctcaaaaaaaaataaacaccattgcaggctagtcagccactattagattgtggaatctactgtgtattttatgtaccagaaatccagggtcttaaacttttttgctgagctctgaagataccaccaccatgcatcatattttcaagtagcctctaggaaatgccttgtagaacccaaattgaaaactaacgtataactctttatgttgtgaaggtggtcctaatgaaatctaaccatccccaaaagtgtcttccatacctgactcatacctttagcaagtgacatcacattaaatttgtcaaaatcagtctttaataccttatttagaattatgcagctatagaaggaacatggaggaaattatagagctgtgctgcccaatatggctagccactagctcacatgtggctgtttaaatttaattgaacttaaattgaaaatataggtcctcacttaaactagccacatttaaagttcacaatagccacatctaagtagtgactaccgtattgacaacgcagatgtagaactatgtagaacatttgacaatactgtctagaaagtactgatacaaaaagcactttagttgataatggcttatatatttatataaaaatgcctatatgatgacttctcaagagaaaagattgtttataactggaacctataattttatttcattgtgccagaaaagtagcttttaaatttataaattctacttttttcccttaaactcctaccctaaaatacttccaaatgtagaacttctgaaggctacatatgatatagagctacttcaggattcccagagtttggaaaaatgatttctgaaagcactatatgagataaaagtttcaagtatgacaactctaatttttctaccccattttgtacagctcttctacatattttgctcattagcaccttcttcacaatgtattgttttatatatatatatatatatatatatatatatatatatatatatatatatttattttacttctatctaaggccctgaatctgctgacatatgacttgtagctccttggtaggtaaaggtcaatatatagtaattcttgtgtgccattatcttgaggagcaggatgtttgcatagactaaattgtcttcctatatattgctgctttagttacaaaggttaaaattgtaagtataaaatggaaaaaccagtgagggacagaggaactttggatgtaatgggcctctggatgccctgagaagcatttaatatcacttatattcatatgtaagtggatgcatgacctgaatttattcatgaggaaacatcagacaaaaacaaagtgaaagaacattctatctaaaaagtggcctgtattctttaaaatgtcagtatcatgaaagatggggagaagagggctgtgataatggtagggaattattccagattaaaagaaattaaagagatatgataactaaatgcaatatgtgatcttgcactgtatcctggactagcagtggagaaaatgcttaaaggacatgattaagacagttccaaaaactggcatatggatgataaattagatttaaagtattgtattcatattaagtttcctaaatttggtgactatactatggttatgttagataatattttgtttctgggaaatacattcacagaaatgtattgaagagtagaggggcacgatgcctgcaccttattctcaaatgagtcaagaaaataatagtgtgtgtgaagagagagaatatgataacaaatgtagcacaatgttaacagtggatttgagtaaagactatacaggagttctctatttaagccttgtaacttttctataaatttgaaattattctgaaataaaaataaaactattcgatattttctagccctttctaaggcacaaaatgatgtgatggaaatgaagatgcagtcagagagactttcgaaagaatatgatcaactcctgaaagaacactctgaacttcaggtgggtgtgacatgcactttatgcacctaaatgttttgaaatagtaattacctaagtaaattatttgggttatttgtccttaactaatcaagatgatgtacttaatcctggctttgttaaacgatttaaagaagccagatttttacctagagggtaaagattaggacattgcaggaaaatacaagataattttaaggaattgctgacttgcatacttacagcattccagttttggtgaatttttaagcaaaagaagccacaaaaatggcagcattggaaaacagactggttctagaaaaggtgagttttgctctttgggatgtttgccatattcatgccaaaatgaggccaaaatttcaagttccacatcacactactcttgtctcagtgttttagacatattaggacaagactttagcattcaaatttatcatttacctccaaatgttgatttgaaagatggaaatgggaaaaaaatgtttcattgttaaagccacaaagtcagatctgggccataggttttctttctctttctctctaattcaataaaagaaatggtcatccctgttaggcttgtctttcctccctcccttctgctgccagccagtaacctgaattgatttctcagacacactctgatcaattggggaagagaccattccagagacagccctggccttccctcccagtttctcccaagacagactggttgggcttgtcttcaaaatttggcagcctttgtggctttcagtcagggctttttacaaataatagctttttatttcactgtacacatttccctgcatcttaatggtcatggtatctccaagactcagcactgttcctggcacaaggcaagcatacactatactcatagactttgtagtcagacctacttggaatacctacctatacctggctgcatgctaggttttttatcttaggcaggttatagcatccctttggggctcacttctttcatctataaaaattgaaacaataatgatgcctggctcactggattgttaagagaactaaataaaatgtgtaggttttttagcactatgcctagctgacagtaaacactcaagaaatgataggtattatcatcatcatctgtattacttcctctgtaggaattttgctgaaagaatgacttattctcaaccaaccactttggccttggtttagagccagtaattaagtaacccaaagcacatatttgtaatctgatattcccagttggtttgcatgtttggtttaactagcctactttgacaatagcaaaagacaaggtagccagagaagggtgaataccctgtatgctccaatcccaggacactgagggctcagttcacatggcctggagcagataggtagattgtcagcaagaccaccccttccccgtctcaaaaatagagaccctaaaattgctgacctcattggggcatgataattattcgtggtatctttcaaggtccaccttggaaagtgaagaagtcacttcagagacctcttgcctagaaatacaacattttccccctatttgtgagattagggtttactcagccaggttgagtatcgacattagtggactttgccatgatgtcagacatgcttagatctttgaatggagaaaggaaaaccagaagtatgccttcagtttcttatggccagtgtccattgttgaatgtctccattgttgaatgtctccattgttgaatgtctccattgtggtaacagccattggttctcttaattctgaagaatatatataacagtgagatttcctcaacccatttcctccccacagaaaagccacagtcagcctggagctgctgcattcttggtaaaggaagtagaaagcttttaagagtgattcctggctgagcgtggtggctcacacctttctttaatcccagcactttggaaggctgaggcgggcggatcatgggagatcaagaccatcctggctaacaaggtgaaaccctgtctctactaaaaatacaaaaaattagccgggcatggtggcaagtgcctgtaatcccagctactcgggaggctgaggcaggagaatcacttgaacctgggaggcagaggttgcagtgagccgagatcgcgcttttgcactccagcctgggtgacagagcgagactccatctcagaaaaaaaaaaagtgattccttcccaagaaaatagttgttataatagttgtcatacctgtttctgtggaaaagaccccatcccagattatgccagacaccatgccgagagtagggccttgtttgatagcacttcaggacttgatctaatttctgcttgtatccagtttttgaaatatttaatagatgtcatttgttgagagtatgctctggactaagcacttggctaagggcttcgtatatgttgttttgtttactctccatgacagctcaataattgaaagtattttaatatccctattttgtgaatgaggaaactgagacccagagatgttatataatttatcgaaagtaactagaaagtgatagcattcaaagtcagagaatctttctccagaacctccatcattaaccactatgttctttggcctttgctgatcattggattgtgttcttggatccattctcctctcaccactgctttactctgtatctctgggaggcccgtttccaaggctcccttgctgtctgactcagtctgggcaggtttagccagtggcaggcactagaagactgaaggcaggaggaaggggaaagccagggatttcttctactctttctgctatagaggccttctcctttatgactccagttccttccctctaggtcccactgggcagcttctacatactggccttcgcacctgggctccataaccctcatccctccagcccaagaagtggtggtggcttttctgctattgataatcccagaggtgccttaccaccctgtttggtgtgtgtactttttcatcacctgtaaaaccaatttcccataatatctctgttggaaggaaaacaaaatctcagctccatagtttaccacttctgtaacccacaggtgactcatttgacatctatgctcctcaggtactttactacttaaataaaggttgtaataccttatgaaaattaaaccagatcctgtataagaaagcactttatatatttataatcaagaatgctatttattatgtcctgactggttacatttttttccttcacctacccatcccccaccgttgtccaatatgagaccctgtataagattctcagatttagatatcattaagagccccattttgtttgtttgtttgttttttgagacagtgtctcactctgtcaccaagactggagttcagtggcacaatctcagctcgctgcaacctccacctccccaatttaatcgattcttgtgcctcagccttctgagtgactgggactacaagcacatgccaccatgcgcagctaagttgggtatttttagtagagacagggtttcaccatgttggccaggctggtctcgaactcctgacctcaagcgatccgcccacctgggccttccaaagtgctgggattataggctcgagccaccgtgcccagccaagaacccttttctttaactcttgtgctttaatgttcgtctgagccctgcttgagaagcaaaagatagttacagatcctctatggtaaaaagctctatcaaattgtcctcatgaatttacttctgttgtcaaactaatcttagatattgaattatatgctaaggttctttggaactagcttcctgaattttacacagttgacatattttcattggaacaatcataaaacgaaagatcattaaaatattaaggaaacaaaggttaaagagggaaacgctgatttctttactgtaaatagatcccaatttgcatcttttaaatccttttggatttccccatctggtcccctccctgttataggcactaaataaatattagaaaacagtcccttcaaaacatgtagtcctttccttatttgccctgcctctcttctaaaaaaaaagaaaaacagaactaactagagattattggctgcacaaacccatcagcacctgccagtttttaaatttcattttggaaaatcagccatcacttaagggacttgtccataatagcttcattaaagctttgttttttatcaaaagggggccacatatgtaaacttgtggaagtaatttacctcctctactcttgtctttttatttgattgcaaaagttaatgttattaaagttgctatggaagcattaatgttcagcctgaacaagagcttgacgaacttctttatacaagcaataacactctgcaaccccattttatgagatatttttcatgatgtagacatttactttcttagcacaagtgatctcttaagattaatttcttttccattttccttcagttttaaatgatgtaatatagtaatctttataacatgatcagccaagtataatttgagaagtcagttctgttggcaaatatctgaaggacaaaaccaaagccaccctagctgaggtttttgtcccttccttctttcatttaccaaaaaccttaattgggttaacagtaggggaattttagaaatcatgttttcctaatgtaacctgtgaaacaaaagcaaaatagattaaggcaaggggaaaaatgaacttaccaagagtgttctttttcctaagtaaaaaccacaaattttatagttttttaaattttagactttctcaatcctttttttcacatttaattattctcataagtatacatagaagagagaatgttttttaaaagtccttgtcatgtctatgaatctgtttctctttgctgtactacataaatcatatttttttccttacaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttccagtgtttagacatgaaatcatcttccttgtctcatgaaaacctaaatataaaaaaaaggaaaatactggagtttttatttctcttgtctttgttacatcctctgtttattataattttagcaccaacttcacacctagctaatttttttcatcataaagtggatgaaatgagcaagtacctaaaaattttatttcagataaaagtcaggagttactgctaaaaaacagacatgtaggagacattcaacaggagtatgaaatgagagttagaccatatgggctgacaacaccataaataacaagaaaagggagtgctgaaataggagagaacagagcaaatgttagctcaaagtatagacttagaaatatcaaagtaagagctatctggataaatatatagatattgagtgcttggaatcctagcctactatgtgaaaattaagtctaatgtcagaataacttacagaaaaatagaaaatgcacagctttaaaatgggcagagttaaaatctattcccagctttatcacttatttagccatgctagcctaggcctctatttccttgtctccaaaatgagaataataaaatttaggtcaggattactatataaactaagataatacagtgattctcaaagttgttcagactgtatagtaaggagaaagtctggttgcactttgaagagcttgaagatttgaaagattcccaaaaaagcattttaaagtttacatttaagggaccttggacctcaaccctctcaagtttacaagtctgaaactttagacatcaaaagtttgagcagtttttccaaggcaacattgatagttagattcagggccaggctgtaagtctagaatttagatatcctgatcccccagataccgctcttctggttatacacagaccagctataatttgctaaacataaaatattgcagtgtattagccggctgtggctccagagtctgtgccctttaccaccgtgcccaactgtttcacatgctgtgtttggtagtttttcctagtactctccttaataatggtggtgtttagcaaattgtattacataaataaatatttatttcatggattgagttatgttgcatattaaattactttccttcccattgtcaataatgacttctttatgtcttaggctgtattataaattcaaacacaggaatgttattcttgcctttttccatcagaattacctaaagttttattagactttccccctacttgcaaatctgcctggaggttctggtctttaggaagtagcacttagcaagttctggataagcactccagaatttgggatgagttatccttgttgtttgtccagctctatcttggaccccagtgctgctaattagattcatgccttgttctttagggcataagttcctctcttggctatttttcctagtatgctgagaactaggattccctttcagtgacagagtcctgccctggaaccccaatcaagagcctaaagtttaactactctctgagatattagcctgatgccagcagcctgcctggatctctaaatattacccattctgggagttgttagtggtctctgctttcctgcagtgtcactcctgcttcctcattgggcctgctagccacagctacttggatgtacccgaacctgttgccttgccctacctctgtgggctggttcagttctgcattcccattccagtgtccactgccttctcgctatccctcccatctgtgcgccaccaccagcttatccccagccctgctaacatgacaaactattgtgcatttgagtgcccactatacaatgtgtgaatataaccgtgcttttaagcattgactttaatgtctgggatgatccgtctagagtccatggaaccctcctgtgttttttcatccctttcttagtaatcttggaaatccacttatgaaattctttttctaacatttctttgctgaacggcatttttaaaattactttcacggtgtttctttccagtttgatctctacacaaacacaactttattacttgcaccagaaatgatttcaaacactttaggaactgtggtaggcttaattatgacttcccaaaagatatccctataccaatccctggaacctggaaatgttctcttctatagcaaaagatatgattaagttaaagtcttgagatggagagattattctgggtaatctgggagtgccctaaatgcagctacatctatgcttatatagaagcaaagggagatattaccacacagaagaggagaaagcacagtgaccacagaggcagagattggagtgatggagccgcagcaaaggaatgctgacagccaccagaagctggaggaggcaaagaacagattcttccccagagcctcttccagcaggagcatggccctacagataccgataaaactgatattggacttcctggcctccagaactatgggaataaatttattgtttcaagctatcaagtttgtgattatttgttactgctgccatagtaaattaatacaggagcatgcaggacagatctgtaatggcctgaactgaatttcaaggggtgtggaaaacagttactctttaacaccactccgtcttccccattagccatttggataagtcaaagatagccttagccatctcctatcttagttacttttctccttcaactgtattttgccattgtcgttgccattgcctctgcctaactgcaagccatcatcatctctcacatggactatgacgacctcctcatctccctgtatcttctctaatgcttctctcatatacatgctctcagcagccacctggtttaaaacaaaaacaaaaaaaacactaatcatgtcattccctgcttgtcttcccgttctttccaactgtcattccctgcttgtcttccaattctttccaactgcagttaagatcaaaccaccaagacctcaccaggctcccatctacttttcagcctcaactcagtccacctgctctgccaatcacacctgtttctttttgttgttctttccctaggatatagatcctggcatacctgcattctgattcttcttggaacaagccaaattctttcccctgtcagtacgtttgcatgtgtagtacatgttgcatcccaggcctgtctgccttcttaccctattttattttcatcatagcacttactaccatctgaaatgatctcatttatggtttgtctcctcagtgattaacacagttcctgcacacagtaaatcagtagttctcaacaggaagtgaagaggtcatcctgaggggaacatttagcaatacctagagacatttctggttgtcataaccaggggaatgctcctagtggatagaagtcagggaggctgttaaacccattccacaatgcacaggactggaacaaagaatgatctctcactcagaatgtcagtgttgccaaggtggagacatcctgcagtagatgcttgtggcagagggtactggttgtaccccagtatccattctttcattcacctgtgttaatacatgctccagttttgtatttttttttataaacagctgtcaagcataaagataacattttccatctccttgtatgtaagtggaaataggactgtcatgtggggccagtttcttttttttcttcctctgtcctgctgcttgaaacatatgctgctatcttagatcatgaggtcgaggccatgcaaagtggagcaacaaggagctgtgtccctgacgccataagcaccacacctgtcctgaattgctgtgaatgacaccagctaactacaatgcattgtctcaacatcctagacataataaaaagccataaatatgtttgtcctatgcagcacaaaacctttgtatctttgccttttatgttgggatcttaattaaaaattacatcctctactgtc

SEQ ID NO: 1836 - DNA, 43342 bp, Homo sapiens; identical to SEQ ID NO: 1835

SEQ ID NO: 1837 - DNA, 81554 bp, Homo sapiens
cctacagcacttccggccagagcctcaagcttcgctgctgggcagttggctggaggggctgctgctgggaacacctggagtctccgcgggcaggtgagcttcagaggttcggggagctttcggaacgagcattcctggccggtgcgtcaccctgcagtgctcttggccttttcttcctttcctggaatcttcccagattgccagagccgggcgttgcctgctccgtgcgctgggaggcggtccagccggctgggttggggccaccctgcgcctcctggaaggccttatttaggagtagccgcacgtgatctctagcattttaagcttctctcagagaattggcatgtcactttggaagaggtgaaaatggtacaggcgaccaacgacttttacaaggtgtcaccttagaggaacagcctcgtccttccgaatcagttaacattggtgatgacagagaaataacgttaaataggtggagagcacttaaagtaactgtttgttcttttgagacagtcttgctctgtcgcccaggctggactgcagtggcgcggatctctgatctcggcttactgcaacctccgcctcctgggttcaagcgattctgctgcctcagcctcccgagtagctgggattacaggcgcgtgccaccacgctcggctaatttttgtatttttagtagagacagggtttctccatgttggccaggctgctctcgaactcctgatctcagatgatccacccgcctcggcctcccaaactgctgggattacaggcgtgagccaccgcgcccggcctaaagtaactatttttacttggtgtttactaccaaatggggactgttctaagttgtgggtggatccaaatgatggtgtgacagccttatcctcagagaagcagtcctggcaggaagacggggttaacaaattgccaaactgttagagaaagttagtggaggtagagatgaagagagaagacttttcttttctctggcattaatttagccacggccgctgtgttttgatacttgcttcaaacgtttttcatattcttaagttttaacttttctgtatgctcatattttatatactgttgtaaacagcatatctctgggttttttttttaatctaagtggacagcctgctttttttttttttttttttttttgatatggagtcttgctctgtcgcccaaggctggtgtgcagtggcccaatctcagctcactgcaaccacgcctcccaggttcaagcatatctcccacctcagcctcccgagtagttgggatgacaggtgtgtgccaccatgcccagctaatttttttttttttgtatttgtagtagagatggggtttcgccatgttggccagactggttttgaaggcctgacttcaggtgatccacctgcttcagcctcccaaagtgctggggctacaggtgtgagccaccgtgcccagcccagtctgccttttgactagcaggtttattggatttacattcattgtcactactgaaatatttgtctagatgaaaatctttggtatcatccctgattaatctcttccatatatatcagcaaatcctatggactctccacctttaaaatctgtccacactcccaggctcttgttatcaccttcacttgttcaagttacgttgtctcgtacttgaattactgcagtagtttctgctctttcctcttttagtctgtttgcatcacagtatctcggttgatcctttaaaaaaaaatcagatttatgtctttcctctcaaaaatcctccaaggactacacatttcacctggagtgaaagccaaagtcggccgggcgtggtggctcatgcctgtaatcccagcactttgggaggccgaggtgggtggatcacgaggtcaagaggtcgagaccatcctggccaacatggtgaaaccccgtctctactaaaaatacaaaaattagccgggcgtggtggtgcgtgcctgtaatctcagctactcaggaggctgaggcagaagaatcgcttgaacccgggagacagaggatgcagtgagccgagatcgtgccactgcactccagcctggcgatagagcaagactctgtctcaaaaaaaacaacaaaaacaaaaaaaacaaaaactggctgggcgcagtggctcaagcctgtaatcctggcactttgggaggccaagactggtggatcacctgaggtcaagtgttcaagaccagcctggccaaagtggcgaaaccccgtctctactaaaaaaaaacacaaaaaattacccaggtgtggtggtgtgtgtctgcaatcccagctattagggaggctgaggcaggagaattgcttgaacctgggggcaggcgcggaggttgcagtgagccgagattgtgccattgcactccagtctgggcaacaagggcaaaactctgtctcaaaaaaaaaaaaaaagccgaagtcttcagagtggattattcatcgaaggtcctatgtgacctagccctgcttcactgctgatctcatgtcgttctcatctcctgtttgctctactgtatggtctcctcaagcgcatcctagcctcaggatatttgcacttgctattcctttccctcatatgtccacatggctcagttctttacctctctcatattttggggacctttaccttctcagtaaggccttctctgacaagccactgccatctttaacatttccattgcactcgttatccttgtgcttatcatcatatgacatgccatgtgatagagtcatttatctggtttattatgttttctctcactggcatagaaggtttatgagggcaggtatttttctgttttgtttactgctgtattctttttttttttttttttctgagacggattcttgctctgttgcccaggctggagtgcagtggtacgttctcggctcactgcaacctctgcctcctgggttcaagcaattctctgcctcagcctcccaactagctgtgattacaggcgcatgccaccatgcctggctaatttttgtatttttagtagagatggggtttcaccatcttggccaggttggtcttgaactgctgaccttgtgattcacccgcctcagcctcccaaagtgctgggattacaggcgtgagccactgcacccggcattttttttttttttttgggaagatctcttattgtacttccctgtaaaatccattactgttttattccaattgcctaaaatagtatctggcttttagcagacactccataatataattgttgattgaatgaatttggggtttttgcaccatcttctacacttcatatttttatgcttttttcctccttgtcttttcttttttttttttttgagatggagtcttgctctgtcgctcaggctggagtgcaattgtgtgatgtcggctcactgcaacctccgcctcccgggttcaagcgattctcctgcctcagtctcctgagtagctgggattacaggcgcacgccaccacgcccagctcttttttgtatttttagtagaaatggggtttcaccatgttggtcaggttggtcttgaactcctgacctcatgatccgcccgcctcagcttcccaaagtgctgggattacaggtgtgagctatcacgcctggcttttttttttttttttttttttttttttttttttgagacagagtggttgctcttgctgcccaggctagagtgcaattgcatgatcttggctcaccgcaacctccgcctcctggcttcaagcaattctgccacctcagcctcctcagtagctgggattacaggcatgcgccaccatacctgactaattttgtatttttagtagagatggggtttctccatgttggtcaggctggtcttgaacttctgacctcaaatgatccacctgcctcagcctctcaaactgctgggattacaggcgtgagccaccgcccccggccactcttgtctttttttttttccctttttttttttttttgagacagggtctccctctgtcacccaggctgtagtgcactgacacgatcttggctcactgcaagctctacctcccgggttcaagtgattctcccacctcagcctctgagtagctgggattatacgcgtgtgccaccatagcctggctaatttttgtatttttattagagatggggtttcatcatattggttaggcttgtctcaaactcccaacctcagttgatccacccacctctgcctcccaaagtgttaggattacaggcgtgagctacagcacccggccccacctttttttctgagacagagttttgctcttgtcacccaggctggagtgcaatggcacgatctcggctcactacaacctccacttcccggattcaagtgattctcctgcctcagcctcccaagtagctgggattacagggacccgccagcatacccagctaatttttgtttttttagtagaggtgggggtttcaccatgttggccgggctggtctcgaactcctgacctcaggtgatctgcctgccttggcctcccgaagtgctgggattacaggcatgagccactgtgcctgccctttttttcattttttcatttttttgtacaatagggtctccctctgttgcccaggctggagtacagtggtgtgatcagggctcactgcagcctcgaactcctgggctcaggtcatcctccaacctaagcctcccaaatacattggcctataggcgtgcaccaccacacccagctgatttttatattttaatttttaattttgctgtgcatatttagctgggattacagacgcactccacctcgccaggctaatttttgtatttttagttgcaacgggatttcaccatagtggcaaggctgctctggaactcctgacttcagatgatcctcctgccttggcctcccaaagtgttgggattacaggcgtgagccaccgctcctggctggctttgtagaaccttaaacatatttatctatcttaagaatttttcccaaggaaatacttcataaggtaatattttaaaaatcaaagctgtttttagctgttttctttggagttgtaaataaacagcattagagaaatgattggctgggtgcagtggttcacacctataatcctagcactttggaaggctgagacgggagaatctcttgaggccagcagtttgagaccaacctgggcagcatagagagatcccttctctaccaatagaaaagagagagagagagaggctgggcacggtggctcacgtctgtaattccagcactttgggaggccgaggcgggcggatctcgaggtcaggagatcgagaccatcctggctaacatggtgaaaccacgtctctactaaaaatacaaaaaattagccgggcgtggtggtgggtgcctgtagtcccagctactggggaggctgaggcaggagaatggcgtgaacccgggaggcggagcttgcagtgagctgagattgcaccactgcactccagcctgggcgacagagtgagactccgtctaaaaaaaaaaaaaaaaaaaaaaagagagaaattattaagtaaattgtggtatcatacttggatattgagatgattaatgtgttgactctgtggctgtatagaaaaatgtttatggacaaatgttaatatggccagttgaggtagctcaaacctgtaatcccagcactttgggaatcctcaggaggattgcttgagcccaggagttaaagaccagcctggataacatagtgaggccctactttattttaaaggaagttaataaaagaagtagaacaaattatatgtctcagtggtagtaaaattctgcttacatgttaatgaaaattttgaaagggcacttaaaactagtaaaaaactcatttttagggtaatacaattgtagtaaaatttaaacatttaaattttatgatcggaagatggtagtaaatcagaaatggctttggaatttctttcattgcaaccttaatagtaagcaacagtctttcccatgaaagggacagaaaaaaaagaatgtaacgtctacatttttttttttctttgagacgcagtctcactctgtggcccagtctggagtgcaatggcacgatcttggctcactgcaacctccgcctccagggttcaagcaattcttgtgcctcagtctcccaagtaggtgggattacaggcactcaccaccatgcccggctaatttttgtatttttatttttatttatttttatttttattttattttattttatttttgagacggagtctcgctctgtcgcccaggctgaagtgcggtggcgcgatctcggctcactgcaagctccgcctcccgggttcacgccattctcctgcctcagcctcccgagtagctgggactacaagcgcccgccaccacgcctggctaatttttttgtatttttagtagagacggtgtttcaccgtgttagccaggatggtctcgatctcctgacctcgtgatcctcccgcctcggcctcccaaagtgctgggattacagacgtgagccaccgcacccagacttgtatttttattttttaaattttaaaattttatttatttttttgagactgagtctttctttgttgcccaggctggaatgcaatggcataccttggctgactgcagcctccgcctcttgggttcaagcctccagagtagctgggattacgggtgcttgccaccatgcctggctaatttttgtatttttagtagagacaggtttcaccatgttggccaggctggcctcgaactcctgacctcagataatccaccctcctcggcctcccaaagtactgggattacaggcgtgagccactttgcctagcctacactgttaaatgaatgcttttcagaccattgtaccccacgtgcaggtcaggccacatctggaatgtggcgttcagttctagatatcgcaatttaagcatggaatcagtaaatcagttacagaggaaaactggaatgctataaggagggtttaaggagctggaaatgtttaccctggtagagaggtttgggagatgaagacaggaagcagggaaagcagaaatggtaacaaatggccttccatatttatttatttattttttgagactgaatctccctctgtcgcccaggctgaagtgcagtggtgcaatctgggctcactgcaacctccgcctcctggattcaagtgattctcctgcctcagcctccctaggagctgggattacaggtatccgccaccacacctggctaatttttgtatttttagtagagacggggtttcaccatgttggccaggctggtctcgaactcctgacctcaggtgagtcacccaccttgtcctcccgaagtgctgggattacaggtgtgagctactgtgcccagctggccttccacatttaaatgttgtctgggaaagggaatatattgattctctgtagctacatagggcagtagtagaaaattactaggtgaaaatgatagagatgtagatttctttttttttcttttttttttttttttttgagatggagtctcactctgttgcccaggctggagtgcagtggtgcgatctcggctcactgcaagctccgcctcctgggttcacaccattctcctgcctcagcctcccgagtagctgggactacaggcgcccaccaccacgcccggctaattttttgtatttttagtagagatggggttttgctgtgttagccaggatggtctcaatctcctgacctcatgatccgcctgccttgtcctcccaaagtgctgggattacaggcatgagccactgtgcctggcctagagatgtagatttcatctttttaaagaagaataacaagagtcactccaacatttaagtgggctatcttcattagttagcaagtgtgtgtattttaaaaagtcattccatctgaaccaagccttagtcagcacccagatagacctaactaagagcaacatgccactcacattcaggtgattaggagagggcccagtgcaggccattacagagaacttaactaggcagcagctgactgcaggtcattttgactggatactaaaatggggctgggggtgggggagtgatcaaagtggttgtcctagcaacaggcaataagggtgcagagtgggccagtaacagcatcaagtaggtctaacatcaggaaacagggacccactggttactagctagaagaagagggtaaaggctttggaactaaggcataggtcaccaagacatggatccagtttctaggtcttcacggaagatcatggtatcaagaaagacattattagaaacgttcagagactagacaggatcatcaaaaatactgacttgaggctgggcgcagaggttcacacctgtaatcccagcactttgggaggccgagatgggtgaatcacctgaggtcaggagttcgagaccagcctgaccaataaggtgaaaccccatctctattgaaaaaaaaaatacaaaattagccgggcttggtggcacatgcctataatcccagctactctggaggctgaggcaggagaatcgcttgaacccgggcggtggaggttgcagagctgagatcacgccattgcactccaacctgggtaacagagcgagactcttctcaaaacaaacaaacaaaaacacctgacttgacacagagactgttaattactgaccttagaccttatacctaatgatctcattggtcatgtctgtgggcacagcatacaggtaggaatggaaaaaaaaaattgttactggagattaagtaggatcaagcatgtgaaggaattcatgagttacctacagatgttagattaataatgagaatggcttcctagtgtcttcaatcctcattcctgctattacactctctggttttacttcccattgatggctgcccccttcttctcaccaagccattctcactgttagcctgatctgcagggtgatgtagtagtacccttaagctgagccccagctggaaagagcctcagactgattatggggccttgtgagtttctggatttagataatccctatacagtctagttcatggagccaagatttggcctagtactttaatttcttgtaggagtggagttctgcagtcattttattcgtccctcttcttagggactagagctctgaatctgagcacaggtttttgggtagtgctgtgtctctggccagacctcttagcttactaaaacataaattccccatgcctggtctgacccgtatgttgatcctgccatcacatcatctaaactggccggcacagtggctcacacctgtaatcccagcacttggaggccgaggtgggaagatcacttgaggtcaggagtttgagaccagcctggcccacatggtgaaatcccgtctctactaaaaatacaaaaattagctgggcctggtggcggccgcctgtaatcccagttactcaggagggtgaggcggaagaatcgcttgaacccgggagatggaggttgcagtgagctgagattgcaccagcctgagcgacagagtgagactccgtctcaattaaaaaaaaaaaatcatctaaactgctttgacttttctcaccaactttgggctcggagattatttctcttttgcttttcaacactactgggcatgtttagatctggatcctggcccccttcccaatggccctgtcctcctttatttaaatagacaaaattcagctccattttgaaagtaggattcttttcacaacaattgggaaaaatgattttttttgttttgttttttgtgagatggaattttgctctgtcgccaggctggagtgcagtggcacgatcttggctcactgcaacctctgcctcccgcattcaagtgattctcctgcctcagatggccaagtagctgggactacaggcgcgcactacatgcccaactaatttttttgtatttttagtagagacagggttttaccctgttggctgggatggtatcgatctcttgaccttgtgatctgcctgccttggcctcccaaaatgctgggattgcaggcgtgagccaccgcgcccagcctaatgttattgtttttacaaaatatttgaggagctgattgagaggaccttatgcagaaacttaataaacttaaaatcatataatgtgagattgaaatgcttagattattctgtaatatggaaatagcaggtctaatgtaacagacaactccagtaacagaggaaatgtctacctattctttttttttttttgagatggggtcttgctctgtcacccaggcagaagtacaatggctcgatctcggctcattgcaacctctgcctcccgggttcaagcgattctcctgcctcagcctcctgagtagctgggattacaggcatcgcgccaccacgcctggctagtttttgtatttttagtagagacggggtttcaccatggtggtcaggctggtctcgaactcctgaccttgtgatccacccgcctcggcctctcaaagtgctgggattacagacatgagccaccactccccttccatctacctgttcttaaaataaaaaaaacccataaaggtggagaggtaataataacaaaggcctcagatatctatataccaatggagtttgtgggtagtcagtaatgtattctaaccccagatggcatgtaacagcatatgttttttcttttgttttgtacacatattatatatgataatattaaaatagaaaaatactttgttcaatagttatgtaacttgtcgtttaaaaatccttgtacttcaacactgttatcttttatttgtgtttttttgtttgtttgttttgagacaggctctagctctgttgcctaggctggagcagagtggcatgatcttggcttactgcagcctcagtcttctgggctcacatgatcctcccacttcagcttcccaagtagctgggactacaggcgtgtgccacaatgcctggctaatttttgtatttttttttggtagagataagtttcactatgttgcccaggctggtctcgaattcctggcctcaggtgatctgcctgccttggcctcccaaagcgctgagattacaggcatgagcaaccgtgcccagccaacactgctagctttttaaaacagaaagtgagttttatttaggccggccgcggtggctgatgcttgtaattccagcattttgggagactgaggtgagtggatcacttgaggtcaggagttcaagaccagcctggccaacatggtgaaacaccatctctactaaaaattcaaaaattagctgggtatggtggcgtgtgcgtggtggcgtgtgcctgtaatcccagttactagggaggctgtggcaggagaattgcttgaacccagcaggcagaggttgcagttagcagagatcgtgccactgcactccagcctgggcaacagagcgagactctgtctcaagaaaagaaaaaaagaaagtgagttttatttagacaaagatgaaggtttggaaattaaccatatttgtgcttgcaaaaggggcacggatttttaagccctagtctcacaggctctctctgcagcatctgatactgttgcttgattattcctgctttaaactctgtcccttggattccaaggcatcaggtagctgctcttcttttttcttttctgttttttctttctccgacttcttagggatttcttctttcttaactattatgtttttgcaggattctgtcattgatccccttttctttctagctgataccctttcattctcatctactttcatgctatcagttataagctctgtgctgacaacccctaaaaacatgtttctaggccgggcgcagtggctcatgcctgtaatcccagcactttgggaggcagaggagggtggatcacctgagatcagaagtttgagaccagtctggccaacatggtgaaaccccgtctatactaaaaatacaaaacaattaaacagcatggtggtgggtgctgtaatcccagctacttgggaggctgaggcaggggaattgcttgaaccagggaggtggaggttgcagtgagccgagatcgtgccacagcactccagcctgggcaacagagtgagacaccatcttaaaaaacaacaacaagaacaaaaaaaacacatttctagcgcaaatgtatcgtttgagctagagacccacatccgtcatcaccctctataggcactttaagtatactgacttctctcccaaacttgaaccttctcttataggccaggcgcggtggctcacacctgtaattttaccactttgggagactgaggttggtggattgctggagctcaggagttggagaccagcctgggcaatgtagcaaaaccccttctctactgaaaatacaaaaattggctgggtgtggtgaagcacatctgtggacccggttactctggtggctgaggcacaagaacccttgagcctggaaggtgggggttgcagtgagccgagattgcgccactgcactccagcctgggcgacagagcaagactgtgcctcaaaaaaaaaaaaaaaaattcctttaaaggaattgtattaagttcttatcagtgttgtatttttcttcctagatctcatattttggattctggatatattataatgagtgacactttgacagcggatgtcattggtcgaagagttgaagttaatggagaacatgcaacagtacgttttgctggtgttgtccctcccgtggcaggtaagcaattattgtgtgtgtgtgtgtgtgtgtgtgtgtgtgtgtgtgtgtgtgtgtgtgtgtgtattttgcagctgtttctgtgtaagcttctcagtagcactttataccacaaattttgacgaaattaacaactaatttataggtgcctcctgtatccagttttatctgagtgacagtatcctgtggtatctatgattttgtttaattatatgccatttaattatttagtgttgctatcttatataaaatcaaccttaaaatatcttctgaggaaactataaacagctaaaagtcttgaaacctcataaacctcaactcaagtaatttttttgaaatttcttttgtcattaatccacgtgtgtaggtatctaatatagtttaaactgatacacattacaatttttgttaccttttttttaaacttattttttggtataaatttacctatgtttctacagcattattttgcaatatttcttctttttttgattttgcgtatttcttaattattacatttagtataatatatagtttgtttaattgttccccatttttggatgttaatttctagtttttagagtaaataataatgtagtagacttactcataagtcttagtcaacaaaaatttgactgttttctgtgtattttgagacagagtttcgctcttgttattcaggctggagtgtagtggtgcgatgttggctcaccgcaacctctgcctcctgggttcaagcgattctcctgcctcagtctctcgagtagctgggatttcaggcatgtgccaccacacccgactaattttgaatttttaggggagacagggtttctccatgttggtcaggctggtctcgaactcctgaggtgttctgcctgcctcggcctcccaaagtgctgggattacaggtgtgagccaccgtgcctggccaataaggaggctttctatgaactgggcaactgctggaaccaagctgatatgggtttactagctgattgcaatgtgcccagaattagaatatttatccatatttttacattacccatccctcttgtttcttctgagctgcagccagagatcaccagttggttcacaggaataagcagggttagcctaaattgaagaaacaaacttaaaaacaactaatgagactagaatctaatgacaaatgccccatagttcttgaaacataatttttctctctagtttccaagttttactaaagacaagtcatggtaagactgatttgcttgggccgggcacggtggctcacacctgtattcccagcactttgagaggccaaggcgggcggatcacaaggtcatgagattgagaccatcctggctaacacggtgaaaccccatctccagtaaaaatccaaaaaattagccggatgtggtggcgggcacctgtagttccagctactaagggagactgaggcaggagaatggcatgaacctgggaggtggaggttgcagtgagccgagaccacgccactgcaccccagcctgggcgacagagcgagactccttctccaaaaaaaaaaaaaaaaaaaaaaaaaaagactgatttgctttattgtaattggcctgattatttgtataaagtgcagcaagaataattatttttcttttttttctttttttaattttttaattgtatttttattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtcctcagagtgtgatgttcaccttcctgtgtccatgtgttctcattgttcagttcccacctatgagtgagaacatgcagtgtttggttttttgtccttgtgatagtttactgagaatgatgatttccaatttcatccatgtccctataaaggacatgaactcatcattttttatggctgcatagtattccatggtgtatatgtgccacattttcttaatccagtctatcattgttggacatttgggttggttccaagtctttgctattgtgaatagtgtcacaataaacatacgtgtgcatgtgtctttatagcagcatgatttgtagtcctttgggtatatacccagtaatgggatggctgggtcaaatggtatttctagttctagatccccaaggaatcgccacactgacttccacaatggttgaactagttgacagtcccaccaacagtgtaaaagtgttcctatttctccacatcctctccagcacctgttgtttcctgactttttaatgattgccattctaactgatgtgagatggtatctcattgaggttttgatttgcatttctctgatggccagtgatggtgagcattttttcatgtgttttttggctgcataaatgtcttcttttgagaagtgtctgttcatgtccttcgcccactttttgatggggctgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtcctggcccatgcctatgtcctgaatggtattgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacatggcgatgcgggctcttttttggttctatatgaactttaaagtagttttttccaattctgtgaagaaagtcattggtagcttgatggggatggcattgaatctgtaaattaccttaggcagtatggccattttcacgatattaattcttcctacccatgagcatggaatgttcttccatttgtttgtatcctcttttatttcattgagcagtggtttgtagttctccttgaagaggtccttcatgtcccttgtaagttggattcctaggtattttattctctttgaagcaattgtgaatgggatttcactcatgatttggctctctgtttgtctgttattggtgtataagaatgcttgtgatttttgtacattgattttgtaacctgagactttgctgaagttgcttatcagcttaaggagattttgggctgagacagtggggttttctagatatacaatcatgtcatctgcaaatagggataatttgacttcctcttttcctaattgaataccctttgtttccttctcctgcctaattgccctggccagaacttccaacactatgttgaataggagtggtgagagagggcatccctgtcttgtgccagttttcaaagggaatgcttccagtttttgtccattcagtatgatattggctgtgggtttatcatagatagctcttattattttgagatatgtcccatcaatacctaatttattgagagtttttagcatgaaggttgttgaattttgtcaaaggccttttctgcatctattgagataatcatgtggtttttgtctttggttctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcctggctttggtatcaggatgatgctggcctcataaaatgagttagggaggattccctctttttctattgattggaatagtttcagaaggaatggtacctgttcctccttgtacctctggtagaattcggctgtgaatccatctggtcctggactctttttggttggtaagctattgattattgccacaatttcagagcctgttattggtctattcagagattcaacttcttcctggtttagtcttgggagggtgtatgtgtcgaggaatttatccatttcttctagattttctagtttatttgcgtagaggtgtttgtagtattctctgatggtagtttgtatttctgtgggatcggtggtgatatcccctttatcattttttattgcgtctatttgattcttctctcttttctttttattagtcttgctagcggtctatcaattttgttgatcctttcaaaaaaccagctcctggattcattagatttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgttgtcccagagattctggtatgttgtgtctttgttctcgttggtttcaaagaacatctttatttctgtcttcatttcattatgtacccagtagtcattcaggagcaggttgttcagtttccatgtagttgagcggttttgagtgagtttcttaatcctgaattctagtttgattgcactgtggtctgagagacagtttgttataatgtctgatcttttacatttgctgaggagagctttacttccaactatgtggtcaattttggaataggtgtggtgtggtgctgaaaaaaatgtatattctgttgatttggggtggagagttctgtagatgtctattacgtccgcttggtgcagagctgagttcaattcctggctatccttgttaactttctgtctcgttgatctgtctaatgttgacagtggggtgttaaagtctcccattatcattgtgtgggagtctaagtctctttgtaggtcactgaggacttgctttatgaatctgggtgctcctgtattgggtgcatatatatttaggatagttagctcttcttgttgaattgatccctttatcattatgtaatggccttctttgtgtcttttgatctttgttggtttaaagtctgttttatcagagactaggattgcaacccctgcctttttttgttttccatttgcttggtagatcttcctctatctttttattttgggcctgtgtgtgtctctgcctgtgagatgggtttcctgaatacagcacactgatgggtcttgactctttatccaatttgccagtctgtgtcttttaattggagcatttagtccatttacatttaaagttaatattgttatgtgtgaatttcatcctgtcattatgatgttagctgtttattttgctcgttagttgatgcagtttcttccagccttgatggtctttacaatttggcatgattttgcagtggctggtaccagttgttcctttccatgtttagtgcttccttcaggagctcttttagggcaggcctggtggtgacaaaatctctcagtatttgcttgtctgtaaagtattttatttctccttcacttatgaagcttagtttggctggatatgaaattctgggttgaaaattcttttctttaagaatgttgaatattggctcccactctcttctggcttgtagagtttctgccaagagatccgctgttagtctgatgggcttccctttgtctctggctgcccttaacattttttccttcatttcaactttggtgaatctgacaattatgtgtcttggagttgctcttctcgaggagtatctttgtggcattctctgtattttctgaatctgattgttggcttgccttgctagattggggaagttctcctggataatatcctgcagagtgttttccaacttggttccattctccccgtcactttcaggtacaccaatcagacgtagatttggttttttcacatagtcccatatttcttggaggctttgttcatttctttttattcttttttctctaaacttcccttctcgcttcatttcattcatttcatcttccatcactgataccctttcttccagttgattgcatcagctcctgaggcttctgcattcttcacgtagttcttgagccttggctttcagctccatcagctcctttaagcacttctctgtattggttattctagttatacattcgtctaaatttttttcaaagtttttaacttctttgcctttggtttgaatttcctcctgtagctcggagtagtttgatcgtctgaagccttcttctctcaatttgtcaaagtcattctctgtccagctttgttccgttgctggtgaggagctgtgttcctttggaggaggagaggcgctctgctttttagagtttccagtttttctgctctgttttttccccatctttgtggttttatctacttttggtctttgatgatggtgatgtacagatgggtttttggtgtggatgtccttcctgtttgttagttttccttctaacagacaggaccctcagctgcaggtctgttggagtttgctagaggtccactccagaccgtttgcctgggtatcagcagcagtggctgcagaacagcggattttcgtgaaccgcgaatgctgctgtctgatcgttcctctggaagttttgtctcagaggagtacccggccgtgtgaggtgtcagtctgcccctgctgggggtgcctcccagttaggctgctcaggggtcaggggtcagggacccacttgaggaggcagtctgcctgttctcagatctccagctgcatgctgggagaaccactgctctcttcaaagctgtcagacggggacatttaagtctgcagaggttactgctgcctttttgtttgtctgtgccctgcccccagaggtggagcctacagaggcaggcaggcctccttgagatgtggtgggctccacccagttcgagcttcccggctgctttgtttacctaagcaagcctgggcaatggtgggcacccctcccccagccgcgctgctgccttgcagtttgatctcagactgctgtgctagcaatcagtgagactccgtaggtgtaggaccctccgagccaggtgcgggatataatctcctggtgtgccgttttttaagctcatcagaaaagtgcagtattagggtgggagtgacccgattttccaggtgccatctgtcacccctttctttgactagcaaagggaactccctgaccccttgcgcttcccaaatgagggaaagatgttacaggaaatggtctcaatccagaccccaaaagagggttcttggatctcgtgcaagaaagaattcagggccagtctgtaaagtgaaaacaagtttattaggaaagtaaaggaataaaagaatggctactccatagacagagcagcccctccaggggattctgatgcacaataaggtttggtgaaagccattgaacaagatacatgtggactctgccttcatggaggctgtggaagtctttaacatatacctaatctgtcaagggtttttactttcctggtattatttgtaaatgggaagagaaagtaatgtttaatgaataattactgtgtaccagacacttgaaagcatgctctcaactttgaatattccaataacaaccttaaaatatagatgttactattcctatgtttatagacaagaagaccaagtctcaggtcttaaaacttttatatagcagagctgggatttgaatctatccttcattgcccatgccctttcttctctgttacttcttttttttttttttttttttttgagatggagtctcacttttgttgcccaggctggagtgcaatggcatgatcttggctcactgcaacctccgcctcccaggttcaagtgattctcctgcctcagcctcccgagtagctgggattacggggacccaccaccacacccagctaatttttgtatttttagtagaggcagggtttcaccatgttggccaggctggtctcgaactcctgaccttaggtgatctgcctgcccaagcctcccaaagtgctgggattacgggcatgagccactgcacctggctctactctgttacttctaaggaatgtgaatattctcaggttcttgacatatgttgccaaattgttgtctgcaagtcagtcaatgtccggtacttggaaatttccaatattcacattctctgggaagcagacttagctagagatttacacttagaaagtttagtgttcagaaagttttttagggagtactttgggaccagtactcatggaagaggaaagagagtaagcaaggttgggcagagggctaagctgggctatggtacagcctcaacaaatatttcagctgtctcctttgggtgctctgaagatagagtggcctttcagagtctttcctagtggagatgaggggctgggtcattatacattagtgatgatctgtcactaggttctgttgaccctaggaagggggtgtgcccttgggcaagatgctttctacagtagacagttccataagagggcagacagttgagggctatttaccaaaagccagtcctcccagctattgggagataagtcccaattcttgaagacagggtggcatatcactagtacagtaatatagataaaagttttttaatgatagtttagcaaacgtgaagtttttaatttatttaaattttatttattaaattgcctgtgaatgtgacactttcttcatgcatgttttatcaggtaagtgcttctttctcccttgaaaattgtaattctgcagagagggagctactgtaaatttaagctttttgtttgtttgtttgtttgaggttgagtttcgttcttgttgcctaggctggagtgcaatggcacaatctcggctcattgtaacctctgcctcctgggttcaagtgattctcctgcctcagcctcccgagtagctgggactacaggcacctgccaccacacacagctaatttttgcatggtttttttggtagaaacggggtttcaccatgttggccaggctggtctcaaacacctgacctcataatctgcccatctctacctcccaaagtgctgggattacaggtgtgagccaccacgcctggcctgcatttagtttagaggtcatcttttggaattggtactaagatgcacagaaattgaacacagatttagtaataatttctgcggttacttcactggatgttgtagagctgttatgacaactaaatcagttagatgtttaaagcacttagaccagttaatcgtgcatattgttgtaaataaacattttaaaacttactttaaaaagaaatgcagactgggcgtggtggctcatgcctgtaatcccagcacttcaggaagccaaggctgtagatcacttgaagtcaggagtttgagaccagcctgaccaacatgttgaaaccctgtctctactaaaaatacaaaaaaaattagctgggttttgtggtgcgctcctgtagccccagctacttgggaggctgagacagcagaatcgcttgaacacgggaggaagaggttgcagtgagacgaaatggcatcactccattccagcctgggtgacagagtaagactgtctcaaaaaaaaaaagaaaaagaaaaagaaatgcaattgtactaatgttctgcaaatggcttcttgtaattggagatattatttcctgtgatagcatcatacaaagatttaaaaagtattacatcttaaactgttcagatggaataaagatgatatactgtggtgggcaggataatagcctcccaaagatgtccccagaacctctgattttgctaggttacatggcaaaggggaattagaattatagatggaattaaggttgctaatcagctgattttaagattgggagagtatccggtttatccagttgggctcagtgtaatcacaagaatcattagaagtagaagctaggctagacgcagtggctcacacctgtagtcccagcactttgggaggccaagtcggatggatcacctgaggtcaggagttcaagaccagcctgaccaacatggtgaaaccctgtctctactaaaaatacaaaaaatacaaaaattagtcagatgtggtggtgcatgccaataatccgagctacttgggaggctgaggcaggagaatcgcttgaacctgggagacggaggttgcagtgagctgagatcgtgccattgcactccagcctgggtgacaagagcgaaacgtctcaaaaaaaaaaaaaaaaaaaagtagaagctagaggcagaagaggcagtgtcagtgtgacgtgagaatgtttcagctggccattgtttattctgaagatggaagagggtcatgagctaaggagtgtgcagcctctaagcctctagaagctggaaaaactttcctcatatgataaggaagctatcatgtaaaggttcatcttacatttcttgctgttttctttctttcttttgctggcaaatatcattcaggggccacagtatgggctgcagcggtgttcattgctactgggttggtcttcgtttctgggcctttttaaaggacagagctgcctctgttggattaattcctacaagtagaatagatttaaggaagatatgagtagtttttatattattattagaaaatacaaaaaagaaaaggtttcaaaaatatagaaagtagagagaataagccaggcgtggtggctcacgcctgtaatcccaacactttgggaggcaggtggatcacttggtcaagagttcgagaccagcctgggcaacatggcgaaaccctgtctctactaacagtacaaaaaaaattagctgggtgtggtagtgggtgcctgtaatcccagctacttgtgaggctgaggcaagataattgcttaaacctgggacgtggaggttgcagtgagccgagattgcaccactgcaccccagcctgggccacaaagactccatctcaaaaaaaaaaaagcgtagacaaagaaagtagagagaatagtataatggacacctgtatatgcttgtcatgtcagtttaacaattgttaacatgttaccataccatatttgcttcatttccttttttttttttttttttttttttgagatggagtcttactctgtcacccaggctggagtgcagtggtacgatctctgctcactgcaaccactgcttcccaggttcaagcggttctcctccctcagcctcccaagtagctgggattacagacttgcaccactatgcccagctaatttttatatttttagtagagatggggttttcccgtgttggccaggctggtcttgaacacctgacctgaggtgatcaacccacctcaccctctcaaagcgctgggattacagatgtgagccactgcactcggcccatctcttattttttgcttaagcattttaaattatatacggagtagcatttcattcctaaatactttacattgtaattctaaaaaaaaaatacgttttcttacaaaactgtacagtttaaattgtgattcataggttgggtatggtggctcatgcctgtaattgcagcactttgggaggctgaagagggaggattgcttgagctcaggagtttgagaccagcctaggtaacgtaacaagatccctgtctctagcaaaaataaataaataaataaataagtacataaataaaaaataaaatcagccaggcatggtggcatgtgcctgtagccccagctacttgggaagctgaaatgggaggattgcttgagcccaggaagttgagcctgcagtgaaccgtgatcgtgccactgcactccaggctgggtgacagagcaagtctctgtttcagaaaaaagaaagttgtgattcatattgtcaaattgctgaacagaattttttttttttttttttttttttttttagacagagtctcgctcttgttgcccaggctggagtgcagtggtgggatcttggctcactgcaacctccgcctcctggattcaagcaattctcctgccttagcctgccgagtagctaggattacaggcacccccctccatgcccagctaatttttgtattattggtagagatggggtttcactgtgttggccaggctgatctcgaactgctgacctcaggtgatccgcccacctcagcctcccaaagtgctgggattacatgcctgagccaccacgcctggcccagaattgttttaaatcagtaaatccagattattgaaaaacttgattctatttcacatcttggtttaattctttagtccaaagtggtgtccattctttaagattttaagatggggtagtcacatgctcttttaatctgctgtcttttaacaaaattatttgccaggcatggtgactcaggcctgtagtcccagctactgggaggctgaggtgggaggattgcttgagcccataagttcatggctgcaatgagctataatccagcctgggcaacagagtgagatgctgtctctaaaaaaattaataaaaaaaaattctgctttagcttttttcttgattaattttagacatgagtttcttagcttcccatatagagaaaaatctaatttttatcccaccatttcctgtggttacactttgtttttcaccaaaatgaaatgtttgtttataaagacttctgtagcatttatttacctactattggcttttcacattatttatatactgagttataatgctagagatattttaaaaaatagtatttaatggtcgggcgtggtggctcacgcctgtaatcccagcactttgggaggccgaggtgggtggatcacaaggtcaggagatcgagaccttcctggctaacacggtgaaaccctgtctctactaaaaatacaaacaattagcctggtgtggtggcacgtgcctgtaatcccagctacttgggaggctgaggcaggagaatcgcttgaacccaggaggtggaggttgcggtgagccgagatggcgccactgcactccagcctgggtgacagagtgagactgtctaaaaaaaatagtatttattgattatatcttattattgttgttttattgctgttcttgttccagagttttaaatgtttttttttcatttactgtattgaaatatattgaaataataatacctggagaatagagttgacacaggtagtctggtagcaaatctcttcataaagtatgtacagcagtgatgttcttttagcagttgtatacacctttcagaagaatcatgcttttatcctcctacagagcaaatagatatatatgtattttaatatggtaatgacatgatatgttttcatgttctgggagtggatgaaggaaacagctaagcttactgactgttgcctaggggaacatctaaagattgtatcaaaccaaagttcctgcctttgacagacacaccgtggtatttaggtgaaaattgtagtgtaattaagtaggtaattaagttatttatttcatttagtgatttcagggtgcatattgtagtttacttattactaggatgcagccctacttaaaatttgtaacaaattttattttatttttatttatttttttgagacggagtctcgctctgtcgctcaggctggagtgcagtggtgcaatctcagctcattgcaagctctgcccgctgggttcacgccattctcctgcctcagcctcccgagtagctggaaatacaggcgcccaccactacgcccagctacttttttgtatatttagtagagacggggtttcaccgtgttagccaggatagtctcgatctcctgacctcgtgatccacctgcctcggcctcccaaaatgctgggattacaggcgtgagccaccatgcctggcctgtaatgaattttattatagacatttgataatttttgataatttctttttttttttttttttttttttttgagacaggttgtcactctgttgcccaggctggagttcagtagtgctatcatagctcactgtaactatagcttctgcacctgggctgaagtgattctctcaccttagcctcccaagttgctgggactacagatgtgcaccaccatgcccagctaattttttgtattttttagagagcgggttttgccaggctggtgtttagcacctgggctcaagcaatctgcctgcctaggcctcccaaagtgctgggattacaggtgtgaaccaccacacctagcccttattttttgagacagagtcttgctctgtagcccagggtggagtgcagtggcatgatcatagctcactgaagcctcaacctctggggcccaagtgatcgtcccacctcagtctcctgagtagttgggattacaggcactagccaccataccttgctaattttttgttgagacaaggtcttcctatggcgcccagactggacttgaactcctgggctcaagcgatcctcctgccttggcctccgaaagtgctgggatcacaggcatgagccacagttccaggccagcttatatatttgtaatgctgattactattccattgtctggatgtaccacggtttattcttcacctactaaaggatattttgttttctggtttggggaattatgagtaaagttgctttaaacatttgtgtgcaggtttttgtgtggacataaattttcaacttatttgggtaaataccaaggaggatgatttctggattgttggattaattcttttaatttttgtgggtacatagtaggtgtatatatttatagggtacaagagagattttgatacaggcatataatacataataatcacatctaggtaaatgaggtatccatcaccatttattctctgtttgttacaaacagcccaattatacccttttagttatataaagatgcacaataaattattgttgatggtagtcaccctgtcatgctatcaaacactagatcttatttatgctatctgtatttttgtgcccattaaccattcccactctctccccctgcccagccccccagcctttagtaaccatcattctacttcttcttcttcttttttttttttttaaggtggagtctcgctctgtcgcccaggctggagtgcagtggtgccatcttggcccacagcaacctccgcctcctgggttcaagcaattcttctgcctcagcctcccaagtagctgggattacaggtgtgcaccaccacacctggctaaattttgtatttttaatggagacggggatttgccatgttggccaggctgctctcgaactcctgacctcaggtgatccacctgccttagcctcccaaagtgctgagattacagacatgagccaccgtgcccagccccgttctacttgctatctccatgagttcaattattttcatttttttagctcctgcaagtaagtgagaacatgtgaggtttgtctttctgtgcttgacttatttcatttaacataatgacctccagttccacccatgttgttgcaaatgacaggatctcattattttttaaggctggatagtattttattgtgtatgtgtttattttctttttctttttctttttttttcttttgagacagagtctcgctttgccgcccaggctggagtgcagtggagcgatctcggctcactgcaagctccgcctcctgggttcacgccattctcctgcctcagcctccgagtagctgggactacgggtgcccaccaccacgcccggctaattttttgtatttttagtagagatgggatttcaccatgttagccaggatggtctcgatctcctgacctcatgatctgcccgcctctgcctcccaaagtgctgggattacaggcgtgagccaccgtgcccggcccttatgtgtttattttctttatccattcatctgttgatggacacttaggttgattccaaaccttggctattttgaatagtgctgcagtaaacataggagtgcagatgtctcttctatatactggttttctttctttttggtatataactagcagtgggattgctggaacatatggcagttctatttttagttttttgaggaatctccaaactgttctccatagtggttgtactaatttacattcccactaacagtgtgtgagggttcccttttctctagcatttattatatcctctcttttggataaaagtccttttaactggagtgatgtgatatctcattgtagttttgatttgcatttctctgatgatcagtgatgttgagcaccttttcatgtacctgcttgccatttgtatgccttcctttgagaaatgtctattcagatcttttgcccatttcttaatcggattaatagatgtttttcccattgaattgtttgagctccttattatattctggttattaatcccttattagatgagtagtttgtaaatattttctcccattctgtgagttgtctcttcactttgttgattgtttatttatttatttatttatttatttatttttcttttgagacaagagtctcgctctgtctccaagctggagtgcagtagcgccatcttggctcactgcaacctccaccgccctggctcaagcgattcttttgccttagccttccgagtagctgggactacaggggtgcgccaccacgcccagctaatttttgtatttttagtagagacggggtttcaccacgttggccaggatggtctcaatctctttttttttttttttttttgagacggagtcttgctctgtcgcccaggctggagtgcagtggcgcgatctgggctcactgcaagctccgcctcctgggttcacgccattctcctgcttcagcctcccgagcagctgggactacgggcgcccgccaggatgcgcggctaattttttgtattttttagtagagacagggtttcaccgtggtgctagccaggatggtctcgatctcctgacctcgtgaccttgtgatccacccgctttggcctcccaaagtgctgggattacaggcgtaagccaccgcgtccggcactttgttgattgtttctttcgctatgcagaacttttgtgatggattaattatttttaattcttgtgatgtcagtgaagttgggcctgattatgattggcttttcatgtggcttgagtccatggagaataggaaacaaattaggttgaccagagtaatcaggtttgtgtgacagctttattaatcattgtgaattaataaacctgtgtgctagtgtctggttcagtcttctgtgcatttggaattttcaaattgaggctatcagggtttgttcgccctggatgtagaaagcaaaaatctggatcttacacattcctgggatctgactggtgaggtatacccttataccatgtctgtccactctcttactcatactggtttctgtagttgctcctctatcattaatgtactggccccaggggaaaagcttgctaaaccatagatattcttcgtcagacttacagctaatcacagttgaatgctggccttgctccttctgtctgctttggcttgaaaaatgacttgtgctttgcagtgtgagagaatggccttattttgtgcattcttctttgtagcatccatcaattcaacccattctgatagtttctatgatgataacatttacttctttctttttttttttttttcttttgagatggagttttgttcttgtcgcccaggttggagtacaatggtgcgatcttggctcactgcaacctacacctcctgggttccagcaattctcccaactcagcctcccaactagctgggattacaggcacccgccaccacgcccggctaatttttctatttttagtagagatggggttttgccatgttggtcaggctggtctcaaattcctgacctcaggtgatccacctgacttggcctccataagtgctgggaccataggtgtgagccaccgtgcccgggtattggaaaatgttttcttttaatgagagcatttataccatttatgttttacttaattattgataatttgggtttatatctctcatcttactacttgctttttgtttgttttgctgacattctgttcctttttttctcccttcattggatgacgatgatgattatttgtggtgttttcttttttttttttttgagacaaggtcttactccattgctcaggctggagtgcagtagcactatctgcaaattctgcctcctgggttgaagcagtcctcccacctcagccttccgagtagctgggactacagctactgtagtcccagctactcggaaggctaaggcaaaagaatcgcttgagccgggcttatttttgtagtttttgtagagatgtggtttcactatgttacctaggctgatctcaaattccagagctcaagcaatcagccagtcttggcctcccaaagtgctgggatcatgggcgtgagctcccgtgcccagccactatttcttttctttttttcttttttgagacagagtctccctctgtcactcaggctggagtgcagtggctcaaccttggctcactgcaacctccatacctcaggctcaagcgatcctcccacctcagccttctgggtagctgggatcacaggcatgcaccaccatgcccaactatttttttgtatttttagtagagacggggttttgccatgttgcctaggctggtctcgaactcctgagctcaagcaatccacccgccttcacctcccaaagtgctgggattacaggcgtgagccaccaagcctagagatgattatttttaccttgtgtttcttctccattagtttggagttgtggtggtatgatatatattggtttttgttcatggttcctggttctcaactcccatacctcttgttacagtcttttgttataatattggtgtgtcaggcctcaggaaacaggatctctctcctgccctccattctcctgccccaaggcagaactctaatcttcttccaccattctgactgtgggtcataagaccctcccggagaggctcccacccctctacactagaggcaggaatgctaatgtctttgaacttctagatagctgaatctgtgaaggttcttgcatccatggagggcttggaagctccacagcccttcccctgtacctcgccttagcacacctcttcatctagattctttgcaatattttttataataaacctgtaaatgtaagtaagtgttttcctgagttctgtgagccgctccagcaaattaatcaaatacaaagagggggctgttggaaccccagctgtttgaagctggtcggtcagaagttccagacgcccaggctagtggctggtggtctgacactatgtccagtcagatagtgtcagaattgaattggcggacacccagatggcatcccctgcttggtgtgtggggaaaacccccacacattcggtcacagaagtcatctgtgctgatcgttgtagtgtgaggaatagtgtagcagaggaaagacatggtttggagagttttaacttatgcagtagttattcattttttatttttccttacacagcagttaattttttattatttagaggtaagtctagagattaaaatatgcatctctggtttacagaaatctagtctaataattatacctccttttggacccatgaaagaccttagaacatgccatttatcaccttcctaactcatatgtgtgacattttaaccgatgtttattttaaacccgaagaactgatattattactttacattgtctgtattactttaacttcacccatatatttacccttttcttgccttttatctccccactccttgtatctttaggcttctatctggtataattttctttttccttgaagactacctttattgggtttttgctgaaattgaaggaaaaaattatttttcctcttttttttttgagatggagtctcgccctgtcgcctaggctggggtgcagtggcgtgatctcggctcactgcaacctccgccttccgggttcacgccgttctcctgtctcagcctccggagtagctggggctataggcgctcgccaccgtgcctggctaattttttgtatttttagtagagacggcgtttcactgtgttagccaggatggtctcgaactcctgacctcgtgatccgcctgcctctgcctctcaaagtgctggggttacaggcgtgagccactgtgcccagccttttttttttttgagacggaattttgctcttgttgcccaggctggagtgcagtggcatgatctcggctcactgcaacctccgcctcccgggttcaagtgattctcctgcctcagcctcccgagtagctgggattactgtcatgtgtcaccacacctggctaattttgtatttttagtagagatggggtttcttcacgttggtcaggccagtctcgaccagtctcgaattcctgacctcaggtgatccgcccactttggccttgcaaagtgctgggactacaggcgtaagccactgtgcctgggctttttttttttttttaatttttattgtagccacatacataacataaagtttgccattttaaccacttttcaatttaacattttaaattgtggtgaaatatacgtaacataaaatttaccatctgaaccagttttgaatgtacagtttagtagtaactaccctaagtatctcatataagtggaatatggtatttgtccttttatggtggcttatttctcttagtgtaatgtcctcaagggtcagttttgtttagtgtgctcaataaattttagccattcttgttttctggagtggtggtttttgttggctttttcacccagacatgctatggcatttgctgattgaagtcctgagtataaggctaacttgtccattccctcctccccaagtggtatctgtgtgatatggtttccgctgcaaattggtatttgcttgcagaaaactggagcattgcctgtatcatcatctgttactcatttggtttttcttgttctgctaggaccctggttaggagtagaatgggacaatcccgagagaggaaagcatgatgggagccacgaagggactgtgtattttaaatgcaggtaacttttcattatgaatcagcacggtcatttagtcaagattatatttaatacttgaataaggagggatggagaggaagaaatgtttggctcatggagtagttatattatggaatttgttgtattccaaaaaggcagttattttatttgtggcttaattgctgctgtttgtagcatttttcccttttttaaaaaaattctgactcttgaccttatgcatggcgttgctttcttcgtcctttttttttttttttttttttttaacagtcctttaaattggatgaatgtaaacctttctggctcattaccaatttacaatccagtaagtaaataatagaaaagagaaacagcctagatttccagtaagaaggaattgattacacaaaatacagaacatctgaatagtggaatgttgagccaccattaaataaatttcttatcataggaagagttacatgtcacattgcatttctttgtctttttttttttttttttgagacggagtctcactctgtcgcccagctggagtgcagtggcacaatctcagctcactgcaacctccacctcctaggttcaagcaattctcctgcctcagcctcctgagtagctgggattacaggtgcccacgaccacgcctggctaatttctgtacttttagtggagacgaggtttcaccatattggccaggctggtcccgaactcctgaccttgtgatccgcccgcctcagcctcccaaaatgctgggattacaggtgtgagccaccacgcccggcctgtcacattgcatttctattattatttttgatcgcctgatgtcagaaaaactgcatgaagccctgaaaagggtgctggggagccttcaggcagagcctgtcttctaaatttttgttgttgttgttgatttttattagttttcaatttctgaaaacgatctttccctagtaagctgtttttccttaagtatggtacagtgaacacaatactgccctggaaatcagggggcctctagcctgtttttaacagtcttttttgtttgtttggttggtttatttgtttattttttgagacattgtctcgcctagactggaatgcagtggcatgatcatgactcactgtcaccctgaactcctgggctcaagtgatcttcgcgcctcagtctcctgagtagctgggactacaggcgtgcaccagcacacccagctaatttaaaaaaataaaaataaaaaagagatgaagtttttctatgctgcccaggctggtctcaaactcctggcctcaagcgatcctcccacctcggcttctcaaagtgctgggattacagatgtgagccactgcaccagccccacttttaacagtctttatggtcctgaacaagacaagtttactaacctttaaaatgaaggtcagaattaggtaaccacacagcatatctcctggtccactatttcataattttagaaagtcagggtgttcttaaaaggccaactctacttgtagacttgccatctctgaatttgttcagagctgttcaggttatatggttagggagaaatattttagccaggcccacagattccttaggtacctggaccatgaccttacaaaccctccagtgaaaggacttttttcttttttttgagatgtagtctcactctgtggccaaggctggagtgcagtggcgtgatcttggctcactgcaacctccacctccctggttcaagcaattcccctgcctcagcctcctgagtagctgggatcacaggcgaacgctaccacgtctggccaatttttttgtatttttagtagagacggggatttcaccaggttggccagactgttctcgaactcctgacctcaggcagtccactggcctcggcctcccaaagtgctgggattacaggtgtgagccaccaccccctgtgaaaggactttttatttggaacttaccccagcctacttccttcttgtaaaagcttgcccaaattgtccatacttttatggtctttaatggtctctggatacagtgatattttcaaagtcttggttgctctgagcagaaaaatcaagaattgcttcaagtcctgggtgatgcagggtttgtcctgaaatgctaatgggaagccttggttcagggacattgagtcagtatagtcatgcattgcttaatgaaggggatgtgttctgagaaatgcctgttaggtggtttcatcattgtgtgaacatcatagtatacttaacaaacctgcgtggtgtagcctactgcacacctaggctactgtatggcatagcctattgcttttaggctataaacctgtacagcatgttactgtgctgaatactgtaggcaattgtaacacaatggtaagtatttatctaaacatagaaaaggtacagtaaaaataaaaaattggccgggtgcgttggctcacgcctgtaatcccagcactttgggaggccaaggcaggcggatcacgaggtcaggagttcaagaccagcctggacaatatgatgaaaccctatctctactaaaaatataaaaattagccaggcgtggtggcgggcgcctgtagtcccagctactcaggaggctgaggcaggagaattgcttgaacctgggaggtggaggttgcagtgagctgaggtcgtgccactgcactccagcctgcgtgacagagcaagactccggctcaagaaaaaaaaaaaattaagcagtgtggggtggtacgggtggtatgtgcctgttagtaccagctacttgggtggctgagtcattaggattgtttaagcccaggagtttcaagaccagcctaggcaacacaatgagatctcatcataaaaaaaaaaaagatagaaaatggtatgcctgcatagggcacttagcgtgaatggaccttgtaggactggaagttgctctgggtaagtgagtgagtggtgagtgaatgtgaaggctgggacattcttgtaccctactgtagactttggaaacactgtagccttaggctacactaaacttagaagttttttctttctttaataataaattaactttagcttcctgtaacttttttatgttataaactttaaattttttttttttttgggatggattcttgctctgtcacccaggctggtgtgcagtggcatgatctcagctcactgcactgcctgggttccaacgattctcttgccttagcctcctgagtagctgagattacaggcatgcgccaccacacctgggtaatttttgtatttttagtagagatgggatttcaccatgttggccaggctggtgtcgaacccctgacctcgtgatcaaccctcctcagcctcccaaagtgctgggattataggcgtgagccaccatgcccggtactttttttttttttttttttggagacagagtcttgctccgtcacccacgctggagtgcagtggcacaacctcggctcactgcaacctctgcctcccaggttcaagtgattctcctgcctcagtcttccgagtagctgggactacaggcgcatgtcaccatgcccagctaatttttgtatttttagtggagacggggtttcgccatgttggccattctggtctcgacctcctgatctcaggtgatctgcctgccttggcttcccaaattgctgagattataggcatgagccactgcactggacctgagccttcttccagaatacctcctgaaggacctgcctgagggtagtttacaattaactttttttttttttttttttaataagtaggagtttgctgggcacagcagctcatgcctgtaatcccagcactttgggaggctgaggcaggaggatcacctgaagtcaagagttcgggaccaccctggccaacatggttaaaccccgtctctactaaaaacagaaaaattagctgggcatggtggcatgcacctgtaatcctagctactgggaaggttgaggcatgagaatcacttgaacctgggaggtggaggttgcagtgagccaagatcacaccattgcactccagcttggtcagcagagtgaaactgtgtctcaaaaaaaaaagaaaaaatagaaggagtacactctaacataatgataaaaagtatagtatagtgaacacttaaactagtaacatagccatttattatcattatcaaatattatgtactatacataattgtatgtgctatacttttatgtgactggcagtgtagtaggcttgtttacaccagcatcaccacaaacacgagtattatgttgtactacagcattaagacagctacagcttcactaggagataggattttttcagctccagtgtgattatgggaccactgtagcatatgcggtccattgttgatctacacgtcattatgtggtgcatgactgtatttggattcttagccttggaataactgcttacttcattatatcgtctagtgttgtgttgtcatgcctaaacatttacataattgaagtacatattatcttattataaataactttttaaaatttaaataggcactttgttgacattaaaaaattatatgagtaggtaatgttatctgtgaattccatttcaggatatttatggggcaatacaaaagagatcattgggtctgaagtggtggagaaccactggtctggactacaggaatttaactggtcctttagagtttgatgatttcatgtcatgttttagtttctctgatctcttttgtaacctaaggtaaatatagtaatctcctgagctattattacccataattaatatttgtaacattagcaattaatagtggtttacagtgtcaaaataaaaataaaatgtgcagatgaatgtctaagtgtaacattttatttgggaagcaagaattgcagttcagggcatccgcacagactagatcgtctttggtatatccaaagaacaaagaacaaagagaaacgtggattttttcttttagtttttgagacggagtctcactcagtcgcccaggctggagtgcagttgcaccatctcggctcactgcaacctccgcctcccgggtccaagcgattctcctgcctcagcctcctgagtagctgggactacaggcgcctgccactacacctggctaatttttgtatttttagtagagatggggtttcaccatattggccagactggtctcgaactcctgaacttttgatctgcccacctcggcctcccaaagtgctgggattacaggcataagccactgctcctgggcttttttttttttttttttttttgagacggagtttcgctcttgttgcccaggctggagtgcaatggcgtgatctcgcctcactgcaccctccttctcccaggttcaagggattctcctgtctcagccttttgagtagctggtattataggaaagtgccaccacgcctggctaattttgtatttttagacaggatttctccatgttggtcaggctggtctcgaactcccgacctcaggtgttctgcctgccttggcctcccaaagtgctgggattataggcgtgaaccactgcacctggcccccgccttttttttttttttttggacgcagggtcttgctctgtcacccaggtagtagtacagtggcacaatcatggctcgttgcagcctcaacctcctatgctcaagcagttctcccacctcattttttgatttttttgtagagatggagactccctattttgccctggctggtctcaaactcctgggcttgagtgatcctcttacctcggcctcccaaagtgctgggattacaggtgttacccgccgtgtcctgtctagtacattttataaaaaggagaaatgttacatattgttctgaaagaaagttcattggcactagtcaagttttggagagctggctagcaagctctgattggtgagtgacagtggtgggtaagattagtcttagagtcacggcagattgttttagtagctattaaataaaactggcttcaggttacaacaggcagtctcagcagctgggcttgtaataaactgaattcttggagcaggtgttgtgtgccccgagcactttttccccttggtcccttgactctgatttagttgggtatgacaagaatgacccagtttctgtaatcaactttcccaagatttatccaagatttatggccgtgcgccagtcacccgtgtccttcctaggtactcctgctctctacttcttgttgaaggggtagttgaggggttcaaatatggtaagtaaccttgaagtcctctttaccttgtccgtagacagcagagtggttttcagttttttttttctttcaacctaaaccccagagtatgctctgaacagagctgtgtgtgtcagtattctgcccactcaccttttatttcagtgcttctgtttccaagcaatggtagaagttctcttttctggtgagaaataaatcttaaaatctgacttttcttcaacactagggagcagaatctaactttaatacttagcatcagagaggtcgtgctgttccagcctgtgtctgtggtaatggacatcttaggaaatggatggttgacaatttaagaaacaaagccctagcaataaaggataagtgtttgaaagaaaggataaatgtttgaagtgatagataccccattcaccctgatgtgattgttacacgtgtgcctgtatcaaaatattgtatgtacccacaaaaattaaaaattaaactaaaaaaagaaagcccttgatttattcatcttttgtgtgtcataagccagttgtaaagtgttttgaggatcttggctgagcattaatggattggtataaaatattctcttggtgtggtgtaaagtgttggaagatttttttttttttttaatcaggaaatgtaatgatagtatgtgggcaaggcgcatctctgttcaaaaaggtggtagctctgcttcatttttggaaggttttcttgaatcagagcaaaatcataattgtgtcaacgcaaaagcagttgagatgaatattaaattcagctgattagagaagcaaacaaaaagagcagtctacagcaaggtgcttatctactgtactgctttactcacaggaaaacaacctctctgggtcagctctttagatgttacagcgctgaacactgcacgaaagctgagttctcctctcctgatgaacagctagttatgcaaccttgctgaacactaaacattcctgaaacaaacagggtatcaagatcaacagtatttattagaaactccccagagacctggccttttccagtagcttgtatccaaagctccaacaagaaagaagcttactgtggaagtctgggagtctgttggggaccctttacctttgtgtagtgttgccagattcagcaaacaaaaataccaaatgcatagtgaactttggatttcagataaacagccaatcttttttttttttttttttagtataagtatgagacatgcatgggggcatacttacttaaaaatgatttgctgtttatctgaaatacaagcttaactgagcatcttcgattctatgtggcagtcctgatggggacataggacagaatgaatcttgataactgggttttatgagcacatgctgtttccacaagggccatgggtcaggatgatgattttaccagcagcatgtgtaattggtaggcagaaggaggaaggaacctgaacaggccaaatgcttccaagagaaacgtttttggacacccctccctgtattctcctcctcaccaacatttttctctttagacatggtttggaatttcagtgtttggatacagtttcttaatatattaatgtagaatctcagtggagtctatgtaaattattacagtttacctcttggagatttgttgttattgatgggcacccattcagctagggtttttcactatttgttgaggctgttttgttttctgagaaacctgctggaaatgttccagaaaatattgatctttagtgttagtctttgatctgtaaagggcatagcatccgttttgcaactacctaacaacattcctaactctcctttcatctgcctgcaactaaactcaacagtaataaagatctgttcatgacttcttgtttttttaccatggttttaaaacttgtttattaccactgttttaaaaagtgtagatttagggcctggcgccgtggctcatgcctgtaatcccagcactttgggaagccgaggtgggcggatcacttgaggtcaggagttcgagaccatcctatctaacacagtgaaaccccgtctctactaaaaatacaaaaaattagccaggcgtggtggcgggtgcttgtagttccagctacttgggaggctgaggcaggagaatggcgtgaacccgggagttggagattgcagtgaaccgagatcgtgccactgcactccagcctgcgtgacagagtgagactctgtctcaaacaaaaacaaaaacaaaaaaaacagaaacaaaaattagccgggcgtggtgttgcacgcctgtaatcccagctactcaggaggctgaggcaggagaattgcttcaacccgggaggctgaggcaggagaattgcttcaaccagggaggctgaggttgcagtgagccaagatcaccccactgcactccagcctgggcaacagagggagactctatctccaaaaaaaattataataaaggaataacgaatggctactccataggcagaacagtcccgaggactgctgggtgcccatttttatggttatttcttgagtatatgctaaacaaggggtggattattcatgcctccccttttaagaccatgtagggtaatttcctgacgttgccatggcatttgtaaactgtcatggtgctggtgggagtgtagcagtgaggatgaccagaggtcactctcatctccatcttggttttggtgggttttagccagcttctttactgcatgctgtttcatcagcaaggtctttaatgacctgtatcttgtaccgacctcctagttcatcctgagacttagaatgcctaacagtctggaatgcagcctggtaggtctcagccttattttacccagctcctattcaagatggagttgctctggttcaaacgtctctgacatatttcccccctcccttttacgagagaacccttaatcctaagggctgcagagggatgaagatccactttctgtaacttctttatgctgaacaggggtgatgatattcctgcctaactgttgggtctcttgcattcagggtagaggagctcagttcgaaagcgttggtatggcgaaggccattcataactcttgagttccgacaaaaggtatatctggaagattaataagtgttcagtttaagaaaacatttagtaagcttatcctgcattcctacacaaagagtataatcacagcaatatattccacaacagtaaaataaaaaaaataaaattatcccaagtaaactgaattagaaagttttccatgaactgggcaattgtttaaatcaagctaataaggagtcactagccaattccaatatgtgcccagaattagaataacattacccatcactcttgtttcttctgagcagcagccagagatcactggttggttcacaggaataagtgggatcattctcttgtcttccataggtctgtgggacacaggtcaggaactgtgtagacaaggagtgaggccagttttcccaagcggcttttattggctctataagtcaagtttgattccataaaggaacacacaccattccagttgaagccttggtaaaataagcagtttctccacttgtgtcccaaggtcacccagtcagtgctgcagactatttcctttgggttggggggcgggtcccctcagtgtcctcctttctgtggttcgccagaaagatgttaccagaaaggggtcctgatccaggccccaagagagggttctaggatcttgcaaaggaaagaatttgaggggaatccatagagtaaagtgaaagcaagtttattaagaaagtaaaggaataataaagaatggctactccataggcagagcagccagtaaactaggcttgtaacttaagagacatgtttaacttacagaaacaaatcactgatgtgtgtgtataagccatgagagagatatgggacttaattttgctacaaaagaggatttaatttcctgcataatcagcttccccctattccactgaattaatttcatcaacatacaaggtggatattttctcctgtcttaagcaatctccctcctttgacccctgtgccccttcaggacaagggtaggctgtgctcacttgcctcccagtctttggaactcaccctcgctgggctttgccctattgccccacccagactgctcgtaggaaaggttatgttcatgttgctggattcagtggcaaggcctcagctgttaccttacctgacctggttttagcattggacatggttgttgactttcttcattggcttccaggacaccacactctccaagtttcccttcccatccctttcccttcccatccctttcccttctcctccccttcccctcccctcccctccccttcccccctcccctcccctccccctcccctccccctcccctcccctccccctcccctcccctccccctccccttccctcctttcccctcccctcgtttccatctgtcgcccaggctagagtgcaatgatgtgatctcagctcattgcaagcttcacctcctgggctcaagcaattctcttgcctcatacttccaagtagcgaaactccaggtaccagcaaccatgcctggctaatttttgtatttttaatagaggcagggtttcaccatgttgaccaggctggtctcaaactcctgactttaggtgatctgcccacctcagcctcccaaaatgctaggatcataggggtgagctaccgcacctgatctcaaactcctgactttaggtgatctgcccgcctcagcctcccaaaatgctaggattataggggtgagctaccgcacccagcccacactctctaagtttctaactccctcctggccacttcttcccaggttggggattggttttaactttttgggatcacaagttccttttagagtctgatcatcactgtgaacccacatcttagagaaaactgtacgtatgtttatgttaacaaaatttatcacaaatattagttttcatccttttcaattattattattattatttttttgagatggagttttgctcttgttgcccaggctggagtgcaatggcatgatcttggctcaccgcaacctctgcctcccgggttcaagtgattctcctgcctcagcctccccagtagctgggattataggcatgtgccaccacacctggctaattttgtatttttagtagagatggggtttcttcatgttggtcaggctgatctcgaactcctgaccttaggtgatccgcccttttcagcctcccaaagtgctgggattataggcatgagctactgtgcctggccagaattatggtgacttctaaaaaggtctgatttctttctttaagagttaatggttgttgcctgggcaacgtagtgagatgttgtctcttaaaaaaagtacgaaaagtgttagctggacatggttgcttgtacctgtagtcctagctacgtgggaggctgaagagggagcattgcctgagccctgggaattggaggctgcagttagttatggttgtgtcactgcactctcaccgaggtgacagagtgagaccccctttctttaaaaaaaaaaaaaaaaaattaggcgtggtggctcacgcctgtaatcccagcactttgggaggtcaaggcgggaggatcacttaaggtcagaagttcaagaccagcctggccaacatggtgaaaccctgtctctcctaaaaatagaaaaattagcctgggtgtagtggcacatgcctgtagtcccagctaattgggaggctgaggcaggagaactgcttgaacccaggaggtggaggttgcagtgagtcaagattgcgccactgcactccagtctgggcaatagagtgagattctgtctcaaaaaaaaaaaagaaaaaaagtaatgatcgtaagctgaaatagtgtttataatacaattttgatcaatttatagagttcactgtttcttctttttttttaagtgacaaggtctctctctgttaccaaaataaaaaataaataagtaaataaataaataaatgattttgtatataatccacctacgatttttttttttttttttttttttttagatggagtcttgctctgtcacccaggctggagtgcagtggcatgatcttggctcactgcaacctccacttcccgagttcaaacaattctcccgccttagcctccctagtagctgggactacaggtgtgcaccaccacgctggactaatttttgtatttttagtagagatgggggtttcgccatgttggccaggctggtcttgaactcctgacctcaggtggtcctcctgccttggcctcccaaagtgctgggattacagtcatgagccaccgtgcctggccacccccatggatttaatacttctgttttttctaatgtgaattgtcagtttcatattacttgttagtttatttaaagggatttaacatgcttgcataagatcataaccctttatggtcaatcatactgattatatattattttagtatgtgatattctcttttatgctaattttgattttttagcatgtagaaatttttgaagaccttcagaaaattgtatttatggcctttcttggtgggtaatattttctgtgtttcatttgctcttctttaccaggcacccgacaggaggatcctttattcgtccgaacaaggtaaattttggaacagactttcttactgcaattaagaaccgctatgtgttagaagatggaccagaggaagatagaaaagagcaaattgttacaattggaaataaacctgtggagactatcggttttgactctattatgaaacagcaaaggtaagtggagtttataacggcagagctgacttttatggttttattaaggttcagaattgaaatacccatgactgtatatggatgctcatgactttgctcctaaactggtttatggttccacagaaacggaatcaaaatctgaggaatccaagaattatttagggaaattaaaattcttatgttagcacaggattggtagatttatccagtttgcaattgaaatatttattggcccattattactattcacatcatattatctcgtgttgactaagtaaccaaggctgacgtttgggttcttttctatttcatggtgatgatggtaagttgggaatggaaacagcagtctgaattgttccctatgccgtggagcgtgctggtgccgtctgttaatagtagggagtagttctcacctcgggctgcacatcttcatcacctggggagctgtggaacatgcggcatccttggtcccatcccagatctgctcaatcacaattttgggatatgggctctaatgcattttattgtattgtattgtattgtatttttatttttatacagacaggatcttgctatgttgcccaggctggtcttgaactcttgggctcaagtgatccttggcttcccaaagcactggggattacagggattaagcacccggccttaaaataatgccctttaaaactgctgcacaagaacattctcttttctctgaaactgtatattgtgactttgtacaaggaggctttctagtcattccagtgaactgcttgaatcaaagagagagaaagatagtatttacacaaaaccagtcatggctgcacaagaactggccaggccttgcagcttcctactgtggtgagtgacttggacgaggcatctgggtaaggacccctggtggccactgtgaggataaatttgtggccacttggaggcctgcaatatattttctttcagtctctaaaagaattaagctatagttctgtccaaagtaaatttctttactatcttttgttattgttgttattaataaaagtgcacatggggacaatgtggaaaataaatacatttcttggtacatctactctttagcatacatggcccccattaaaaaaaactcagaataaatcaagagttttagaaaaaggaacaaatggactgttctttataaaacaagatacctttattgttgagaatttagaaattacagattgaacaaaaaagtatcatgattaatgccaccacttagatataagtatcgtaaacgggctgggtgcggtggcttatgcttgtcatcttagcacttttggaggccgaggcagttggatcacttaaggccaggaatttgagactagcctggccaacatggtgaaaccctgtctctactaaaaatacaaacaattagctgggtgtggtggtacgcacctgtagtcccagctgcttgggaggctgaggcaagagaatcgcttgaacctgggaggtggacgttgcagtgagccgagatcatgccgctgcactccagcctgggtgacagaatgagactctgtctcaaaaaaaaaaaaaaaaaagaaaaaaaagacgtaactatcatgaacagtttttactgtttaccctactgatttacttggatttaaagaactacatgcttcatagggttagagttctttgctttattttttcccatttaaaatacaaatagcctgggcaacatggcaaaaccctgtctctacaaaaaaaataaataaataaatgcaaaaattagctgggtgtagtggtgcgtgcctatagtcccaactatttgggaagctgaggtgggaagatcacctgaacccagaaggtcaaggctgcagtgagacatgattgcaccactgcactccagcctaggtgacatagtgagaccttgtctcaaatgacacacaaaccaaaaaaaaaaaaccccaaatatttacatatctcttacccaaaggaagcatttttttaattggttaatctctttctgagaatattaacaaattgcaaatggattttcgtcccctagtttatgaacagctatgtaactcatgaatttttctgtaaatgaccctactacttgagtatcattgcatttaatcattagctagtgtctttcttgattgaaaaggtaaaattttagagattctggagtaatctcatatgttggctggagattagtcaattcagaaattatgagacagcttggtggaatgcagccagtgttggagttaggctgggttcagccgccagctaaggcacttttggctctgacagaagttagagatagctgcttattgtttctaagcctcagtttcctcagttacaacataaaacctaagatataagtgctgttgtgaataacaaatgagatcctacaattaatgatagctgtcagttaggagttgaaacctctactttaagccattgtcttatctcatcaataaaatccagctgaccagctttgagatcgtaccactaagaagagacttactcaataaaggaatcaaaaacaaattaaaaaatccattatgtatggtttctcttggagatggctttggctctggagtgatgcttggactgagatctgagtcctcatgcttagtgccaagttgacctggcaaagaaggctattttaaattttagggggaaggagcgacatctgtcggacacagtgcaaactacagtttgaagtagttgcctgtttcatgagattcctgtagttcttttcaatgatgtcataagcctacaaagctggcttttgggcaattgccgcgataaaacacaagtatttatgtacatctatcatgcatcaatagaaatatttgttttataaaaaagcaagtatctcttaaatcagtgtggaactggaaatggaattggtggcgtccagtctgattccagggtttgggaagttgggcagtgcccagcagacactgagttgacaggacataagtaatgattaagttgtttggccctaactacgtacttaattggaactgtgaggtatttattttggcctaagtaccatgaaaaaaattactgaaaccctaaggaccgtgtggcctgagaaagtttgggaccctctaaccttgaattctgctgctgccttttgtaccctggtttttctttcttttttttgttgttgtttcttgttttttgttttgagacagagtttcactcttgttacccaggctggagcgcaatggtgtgatctcggctcactgcaacctccaccctcccgggttcaagcgattcccctgtctcagcctcctgagtagtcgggattacaggtgccccccactatgccaggctaatttttgttattttttttagtagagacagggtttcaccatgttggccaggctggtctcgaactcctgaccccaggtgatccgcccaccttggcctcccaaagtgctgggattacaggcataagccactgcccccggccatgtatttgttcttctgtgactggcttatttcacctagcataatacactcaaggttcatccacattgcggcatatgtcagaatttccttccttttttttaagttcgcacaatattgcattgtatatgtgtgccacgttttgtttatcctttcatttgttgatggacacttgggttgcttccacctcttgactaccaggaataatgctgctgtgaacttgtgcatataccgtggccttttagagatgtgaagtctgaggcacagaggtgctaattcacttctccaaagccaaaggagatggtggaattgggatttgaacccaggtggtctggttccagattctgtgttcttagacattatgtatgcggattcttttcatgaatagaaagcacaagattctctacacttaacaaatggctgccggaagtatctggtcatgctgaagctgggtgcgctctctaggaagtaccttagggaggcttttacatgtgagtgcgagaagcactccatagcatgtacttctgcgtggttgggaacaatctaaatgtcagcagaagagtatgtacattccttgtggtctgttcatataacaaacgctgtaaggtgtgaagatgaatgtcctggagctccatgtgtcaccgtagtgaaatctcaccactgaacaatagactgttgaggaaaaagtcaggtgcagaaggctctgcggagtagaataccatttatatcaagtttcagaatattaaaaaatgctgtaattgtttagggatatggaaatatatggtaaaaatattaagaaatgcttaagattaaataaacaccaaatgtagtataaggccctggggagggccgggcgtggtggctcacgcctgtaatcccagcactttgggaggcggaggtgggtggatcacttgaggtcaggagttcgagaccagtctggccaacatggtgaaaccccgtctctactaaaaacacaaaaattagccaggtgtggtagcaagcgcctgtaatcccagctactggggaggctgaggcaggagaatcacctgaacctgggagggagaggttgcagtgagtctagattgtgccactgcactccagcctgggcaacacaacgagactctggctaaaaagcaaaaagaaaagtttacctctgggagtagagggagaattgtgtttggagagggccccagaggacttcagttgcatttgtaatatttgtagtgctctttttcttttttgtaatgctttatttcttaatttgggtggtggttactggtatttgtatattatttttggtacccttttatatgtctgaaatgtgtttaattttttaaagggccagtggatagcatacgtgcttatgtatccatgtgaactctgtttttcatgcagtcagctgagcaagttgcaagaagtttctctgaggaactgtgcagtaagttgtgctggtgaaaaaggaggagttgctgaagcatgtcctagtatccttttcaccgagagcttgttattggaatctgactatggattttatacctgtgccagagactgctaattgcctacccattgtccagtcttgacaacttccttcctaatgcagttcagttttgcttggtgtagttggggcccagataaattatttaccttcccagacccctttgcttgcaagtttgccagcatgttcaggtggaagtttctacaccgggctccttgaaagggggcacacttggccaggcgcagtggctcacgcctgtaatcctagcattttgggaggctgaggcaggtggatcacgaggttaggagatcgagaacatcctggccaacatggtgaaacctgtctctactaaaaatacaaaaattagccgggtgtggtggcgtgtgcctgtagtcccagccactcaggaggctgaggcaggagaattgcttgaacccgctaggcggaggttgcagtgagctgagatcgcgccagtgcactcagcctggagacagaacaagacttcatctcaaaaaaaaagaaagggggcacacttgtttggcctctgccttttgcctgttgcttttacccttcccctgccttgagcggatggaaagcccagggctttggcagctgtcttacaagtgtgaagaaagccatccagtacagattgggagagcagaggagagggaacctgggctgctgactgtgtactgggaacctaagatgaatctgcttcagccctggtctgttttctcatgcagttcttttttttttttttgagatggagtcttgctctgttgcctaggctggagtgctgtggcgtgatctcagctcactgtaacttccgcctcccaggttcaagtgattcttctgccctagcctcccaagtagctgggattacaggtgcccgccaccatgtctggctaattttttttttttttttttttgagacggagtctcgctctgttgccaggctgcagtgcagtggcgtgatctcagctcactgcaacctccgcctcccgggttcaagcaattctcctgcctcagcctcccaagtagctggggctacaggcgcccgccaccacgcccagctaatttttgtatttttggtagagacggggtttcaccatgttggccaggatggtcttgatctcttgacctggtcatccgcccaccttggcctcccagagtgctggaattacaggcgtgagccaccacgcctggcctcgtctggctaatttttgtatttttagtagagatggggtttcgccacattggcgaggctggtcacgaactcctgacctcaggtgattcccctgcctcggcctcccaaagtgctgagattataggtgtgagccacatacctggcctcatgcagttattttttagtgggaaagactctggttctgtttcatgcagctgaatgcagtttgttataataccccaacagaggctctttatgaagtttggaatctcttttctctacctgctcttattagtgttatttttgtcatatatttcttttttgcctgtaagcaaaaatgttggaggtaggttaaaagaaaattttaaggatgggcatggtggctcatgctggtaatctcagcatggtaatctcagcattgggaggctgagactggaggactgtttgagaccagccttggcaacattgccagaccttgtctctataaaaaattaaacaaagcaaaacaaaactgggtgtggtggcatgtgcctgtcatctcagctactcgggaggctgaggtgggaggactgcttgagcccaggagtttgaggctgtgatgagccatgatcatgccactgtacttcagcctgggagaccccgtttctattaagaaatttcccatggaggctgggcgcagtggctcatgcctgtaatcccagtactttgggaggccgaggtgggcggatcatctgaggtcaggagtttgagaccaacctggccaacctggtgaaactccatctctactaaaaatacaaaaattagccaggcatggtggtgcatgcctgtaatcccagctacttgggaggctgaggcagggagaattgcttgaacccgggaggcggaggttgcagtgagtgaggtcatgccattgcactccagcctgggtaacagagtgagactctgtttcaaaaaaaaagaaagaaatttcccatggaaaccaaatagactttctttaactttaaaaggtctttccccaattcattaagtctgtctgatctgtacataataacttttgcaaaaaatagcagttttgatcagtttttttctgagtgaagagatgccaggtgaagtagctctctttggcaaaatgccccgacagtgcagtgaaggaaattagatcagacatctctccatctgtgtgtctgagggttcacttcccttgggggaaacagtctgggggtctgttgggacctgtggtagctgcacaggtctctgcctgtctctgccagtctctgcccctgagcagcctcctccgttgaccccagcgtgctgcaaatatgaggtcattttcaaaagtaggcagctggagtgaggggaattgaagtggatgcagaaaagagtttgctgaggagccagtgccacagcagtgtcagagcattctgcattctgcctggcctattcctaaactatttcagaagattggtaatcgggctgtgtacagtggctcatgcctgtaatcccagcactctgggaggccaaggcgggtggatcacctgaggtcaggagttcaagaccagcctggccaacatggtgaaaccttgtctgtactaaaaatacaaaaaattaactgggtatggttacggacgcctctaatcccagctactcaggaggaggctgaggcaggataatcacttgaacccgggaggcagagattgcagtgagccgagatcacaccactgtgctctagcctgggtgacagagcaggactccatctcaaaaaaaaaaaccaaaaaacaaaaaacgggggggccaggtgtggtggctcacgcctgtaattccagcactttgggaggctgaggcaggtggatcacctaaggtcaggagttcgagaccagcctggccaacgcggtgaaaccccatctctactaaagtacaaaaattagccaggcatggtggtgggcgcctgtagtcccagctacttgggaagctgaggcaggagaatcgcttgaacctgggaggcagaggttgcagtgagccgagatcgcgccattgcactccagcctgggcgacaagagcgagactccgtctcaaaaaaaaggacagatgtggcggtaaatgggtttgggagtgctggctgttgggttgctcagagctgtcagcagtgtcctgaagaatcagcatgttgtttgtttatactgcacttttctggagaaaaatgtcccccaggacacgaagaaatgaggtttcacgaagataatcaagtcatgattggtatttgcagatacagtgataaatgtcttgcagctcccgattgaattctcgccagaagttgaagtattgctttgggtgcttaatccagtcatccttttttgggttggtctgtctttgaggttatttactctaccagaactcgaggcagtgggagagctgcagacccgggtgtgtcaaatctgagggtacttccaggggaggggatgagcttcctcctccctcatgacctgcggaggagagtctgtgcccaggtgcttggcctgtgctttcacgggggctccttgaacggtgtgtgtgggaggggcgaccacatattgacagctgttgttcgtggttgatttcaggatgtaggtggtctgtgtgctctgtacagaccttagaaacaataactctaggctacataatgggaagcagcagtgagggaagcgtgattggacttaaacccttcctcagcagcctaacagccgatttagcggggttaatggaaacacagggtggccaaagtgtcacccagaggccgggaaagcacccctcgcatgagcctgtgttaggcggtgtcaggaagctagggcagccgagaggaggctgaggaggaggggcagaggagcagtttacagaagccatcatgcaggtgtgggcccaagggcagaggaggagcgcgaggggacctggagggtgtttgcccggtctggaattttcggcagcctgcaccgactcttttcccttccatttgatgcgacggccacggcaaaattgaggctattctgcaggtactcatattaccgattgaaatgcaactgtttacgagggtagaccccattgttagctcttgggctgtaatagtccaggcagctggcaggattcgggcatgggtagctggcgaccgggtatggagtcatccctttcttcgcatcttctctgccgtccttcccttgttcctgaccttcttgcagagcttcctaattggttcctgcctaaaattatttcctttctaaccaatgctttggagtgatgccactgtttttgtaaagaaactttctccacgttttatgtatgtttgatgactccctgttgcattatggggtgcaatgatatggattttggatcgaggatgacttgggtgtaacttcccacttgttcatttgcacacaatgacacagctctgtgactgctgtgccaccgtttgttctgctatgagaaagcaaaacaacccagcaatcagcatagtgcctgggtctggttagcagtggcagcagcagtgcgggtggtggctgtcactgctgctgttgttattactggatcttagagctcttttttttttttttttttttggagatggagtcttgctctttcactgggctggagtgcagtggcgcgatcttggctcaccgcaaccttctggcacccaggttcaaggattcttctgcctcagccccctgagtagctgggaccacagatacgtgccaccacgcttggctgattttgtttttgttttttttttttctttttttgagatagagtttcgttcttgttgcccaggctggagtgcaatggcatgatcttggctcactgttacctccgcctcccaggttcaagcgattctcctgcctcagcttcccgagtagctgggattacagacatgtgccaccatgcctggctaattttgtatttttagtagggatggggtttctccatgttggtcaggctggtctcgaacccccgacctcaggtgatccgcccgcctcggccacccaacgtgctgggattataggtatgagccacagttcccggtccaatttttgtatctttagtagagacagggtttcaccgtgttggccaggctggtctcgaactcctgacctcaggtgatccgcccactttggcctctcaaagtgctgggattacaggcgtgagccgccgcgcctggcctggatcttggagctcttcttctgtcgctggccactcctcagtcgcttctgtgggacctttctctggttgcagactgttgggtgtaccccaaggctcagacttgggagccctgggcttcttgagagaccttctggggtgtggctggcactcctccacggcctgccctcttccacatctgtctctccagctgcagctttgatacctctgtctggatgtctcatagccatcatagatttagcatgtccaaaactaagacccacgcctgctcatcctgtagtcttttccctcttaataaatgacagttccatttgcacaggccacagatcttggagttgtccttgacactccctttctcccatgccccacacctaaatccattggcaaatcctgtgagccccacttccagagtcagacgccccctctgacatgttctgccctctcatgctgctggtttgctccggcctcctggagactcccggccctcctttatttccctgcaattgtgctcaactcagaagcacagtgacttttactggatttttttgttgttgttgttttgttttttgacataatatagatcaaagtcaaagcagagtgatttttaaaggacccaggtcacctgtcgctgtttcaaagcctccaatatctcccgtttcaagcaaactttgaaaagtccgtttcaaacagactttgaagtggcctgcaaggccctttgtgatgtggcctggccccttattccttgtgaccttgtttctagtacccccaagcccctctgctcgagtcacacaggcgctggcggtcccggtcataggctgagctcgttcccaccccagggccttttgctcttgtcactcctccgccatgtgctcctctcccagatggcgttcccccatttccctcagctctctgctcagatgccctcttagaggaggtggtcttccctgggcactgcatatagaacagccacacacctttcctgcatgccctgctctgtccctgagcacagacaggcctgcctgtgacacactgttgaggcccctgtgtcgtgatcgtctctccccgatgacactctgctttgctcactgcgatgctcctggccctaaataattacttgcagaatagacgagtgcattgaataatttccacacatacacatattagatgagagtgtagctcctccagtagctggcccggtcctgctgcaagctcctctgtctttctctgcggggacctggctaagctgtgccccttcctgatggtgctgcacctgcacctagcccctcacctccacttgtgttgtctgtcggctttgcttttccagccccactgtgttatcctctctgaatccctgtatcaggggcagttggagtgatactgttacaactgcttccaggctaccggacaccctctcaattcctaagtcatgcgcttttgcacatgtgtcccaagttgacccctcttctctgccctgtagatgctatttatctggagattcctatggtaatggtgccccatagaaggtcatgtgctggggtgaggcttgtgtgtataccttaggtgcttcagaaatcaaagttaccctcactgcttttcccctctccttttgttggatagtgctaggatggtttagcgttatgacatttggttctttgtcatttgattgtagatgtttgtctcaagttttgagtatataacaatgaacttttaatttatttttagttttttgagacagtctcactctgtcacccaggctggagtgcagtggcgcagtctccactcactgcaacctccgcctcccgggctctagagtttctcttgccttaacctcctgagtagctggaattacgagcgcgtgccaccacacctggttaatttctgtatttttagtagaatggggttttgccatgtgggccaggctggtcttgaactcctgacctcaagtgattcccccgaccttggcatcccaaagtgccgggattacaggcgtgagccaccgcgcctggcctcacaatgaactttttcgtttctcagtgaagttttggataacttaaaaatattatgtactcctgaaaaaatttgaagctgactagagggtataaaatgaaaagttaaaacgctcatgctctggaattaagagtaactccttttatgtcttttgtgaatcttttgaaattactgtttcttaacatgtgcttttagatatcagaaaggtagatttgtcaaaaaacctgttgtcatcatgggatgaagtgatacacattgctgatcagctcagacacctggaagtccttaatgtcaggtatgaactcttggttgctgaatcttcattaacaataaagctcatctctccttgcttcctcacagcatctctgtggaaagaggtagggagccggaagggttaaggctgccacctgatgatacaggagttaagaaggaattactcaggctgatagtgagggtatggaagtcctcagtaaggttttccttttaatgaaaagcagccccaaattattttcctttctaacacaagcagcctgtaaaatcgagctgcagacatagatgcagacagttgagccaatcaggttcaagatggcagctccatcttcccttctcttttccagccacgtgtacagtaaggagcagacaagatggtgccagccaaagggaaatttcatttacatagtaagattagggtggggtggccagcctttcctggctgtgtaaatgtcatgcctgattgaaccaatctgtgagcattaagtaaatcagacactgcctcctcaagtcaaactaaaatctgtgcatctgggccgggtgcagtggctcactcctgtaatcccagcattttgggagtctgaggcaggcggatcacctgaggtaaggagtttgagaccagcctgaccaacatggagaaaccccgtctctactaaaaatacaaaattagctgggcgtggtggcatgcaactgtagtcccagctactcaggaggctgagacaagataattgcttgaacccgggaggcagaggttgcagtgagctgagatcgtgccattgcactccagcctgggtgatagagcaagactccgtcaaaaaaacaaacaagggccaggcgcagtggctcacgcctggaatcccaacactttgggaggctgaggcgggcggatcatgaggtcaggagatcgagaccatcatagctaacaaagtgaaaccccatctctactaaaaatacaaaaaattagccgggcgtggtggtgggcacctgtagtcccagctcctcgggaggctgaggcaggagaatggcatgaacctgggaggcggagcttgcagtgagccgagattgtgccactgcactccagcctgggcgacagagcgagactccatctcagaaaacaaacaaacaaacaaaaaatctgcatctgctgccagcttgcctttttcttcttggaagtcccctctctcttactagagagagagctgttttccatcttctttctcttgccttttaaacctctgctcctaaactcctcatgtgtctgtgtcctaaattttcctggtgggagaagaggaataccaggtgtataccccagacaacgcagctgcttcgctagtagacatttttatacagccagattttggtttacttgaatttatctaactttaactttaaggacacatttaatctttaaggacactttatttatttatttatttatttatttatttgagacagtgtctcgccctgtcgccaggctggagtgcagtggcgtgatcttggctcactgcaacctctgcctcccgggtttgagcgattctgctgcctcagcctcctgagtagctgggactacaggcacgagccaccacgcccaactaatttttgtgtttttactagagacggggtttcactatgttggctaggatagtctcaatctcttgaccttgtgatccgcccacatcagcctcccaaagtgctgggattacagtgtgagccactgtgcccagccttatgtatgtatgtatatatgtatgtgtgtatatatatatatatattttttttttttttttttttgagacagagtctcactcttgtcgcccaggctggagtgcaatggcgcgatctcggctcactgcagcttccccttcccgggttcaagggattctcctgcctcagtctcctgagtagctgggactatgggtgcccaccaccactgccagctactttttgtatttttagtagatgcagggtttcgccatgttggccaggctgttcttgaactcctgacctcaggttttccacccacctcggcctcccaaagtgctggaattacaggtgtgagccaccatgtcccgcctctttaaggacactttaatctttaagggcacattgattattatagccttgcaaacggtcacatgaggtgattcatgaataaggaatgtgttttaacttttaccaggtggggatgagttagattttcattgaactgcaagatcttatttttagcctgaccgtaaagatggaaggttgggggaggtgatatttaattggggagtaggagaggagaggtgatattattaaaactgcttgtttatttgaaaacttctagcgtttaattgctgtaggaatgagtaatttcattgggatactgtttaattctgttttgataaggatttttcattaatctacctattttactaatgtcacacttttctaggccttcctgaatatttaatttgttttaatctcagaacctaactttccaagggcttagccaggcttcctccatttttttttttttgaggcagagtctcactctgttgcccaggctggagtacagtggtatgatcttggctcactgcaaccttcgcctcccagattcaagtgattctcctgcctcagcctcccaagtagctgggactagaggtgcctaccaccacacccggctaatttttatatttttagtagagacggggtttcatcatgttggccaggctagtcttgaactcctgacctcaggtgatccatctgccttggcctcccaaagtgctgggattacaggcgtgagctaccgtgcccagcacaggtttcccctttcattcttgaaccatttttgcatagacatgtgagtgtacagtaaagccggtagacaggcctgaatgagttgtgctcccaaatagagcaaacgggggcaattcaacccatggtgtctcatcttctggaaatacgggcttgtgttttttaatagtatcgtctttcaaagtgactgtcaggattgaatactttctgagattagggttttgagaaataatttaaggggcaataatttcatccatcctcatagccaaagggcagactctatgtttagagaagcaaaattctagcccatgattcagtgtatcagtaagactctggagaacgggactttgttttgcagtatccagagccatatcttgtgaagctggaagctcaccttgcaaatgcctgagttttgggtttaggaagcctacagccgcatacaggtgccctaatcctgtgaaagcatctttacacagctgataccaaaaagttgtatgttgtaaatgttaaaaattaggtagtcttgattcacttgaatcattaaaaaagtgatttttaaaatataattccattttaagattgaaacaaatcaaaccccttagattaaaacccagattgttgctttcaacaactatttcagttgggtttactgtatagaaataagtacattgtatcttttttttctacacagtgaaaataaactaaaatttccctccggttcagtattaactggaacgctttctgtactgaaggttttagtcctcaatcaaacaggaataacgtgggctgaggtaatcatatttctttgttttattacacattaataagcaattaaaaatgtttggtttaatagagaattgttagtacagtttaatagtacaactgtggcttcatttaaatcatcccagtatctattaatagataacaagattcattaaagtgccttataaaaacgagttaaaagagcatcatagttgagttttgcatctggaaatccatgtcctatctcagctcattttgacttgttctggtgcctttataaacagtggcgctccgttatggtatgaaccagtatgtgctgagcttcaaaaagccgtagtgttggctattgactagcttcctgagttttcctgttagttttttttagaacagaagccaagcagcagaaaggttctcacatacttttcttgttagaagttcggctcttggaatccactgttcattttatacagccgggctcaaaagtagacttgtgggtccttggcacagcagcatttgggacttatatctggcagtactatttcctgtctgaggtgtactgacttcacacacccagagcattccactttctttttttttttttttgagacggagttttactcttgttgcccaggctagagtgcaatggtgcaaccttggctcactgcaacctttgcctcccaggttcaagcgattctcccacctcagcctcccaagtagctgggattacaggcatgtgccatcacacccagctaattttgcatttttagtagagacatggtttctccatgttggtcaggctggtctcgaactcctgacctcaagtgatttgcccgcctcggcctcccaaagtgctgggattagaggtgtaagccaccgtgcccagcccactttcatttttatttatttatttttcttgagacagagtctcactctgttgcccaaggtggagtgcagtggcgcaatctcggctcactgcaacctccgcctcccaggttcaagtgattcttccgcgtcagcctctcaggtagctgggattacaggcatgtaccaccatgcccagctaattttgtatctttagtagagacagagtttctccatgttggtcaggctggtctcgaactcctgacttcaggtgatccacccacctcggcctgctaaagtcctgggattacaggcgtgagccaccgtgcccagcccactttcatttttatttatttatttttcttgagacagagtctcgctctgttgcccaagttggagtgcagtggcatgatctcggctcactgcaacctccgtctcctgggttcaagcaattctccagcctcagcctccaaagtagctgggattacaggcgcttgccaccatgcccagcttatttttgtatttttagtagggacagggtttcaccatgttggccaggatggtcttgaactcctgacctcaaatgatctgcctgtctcagcctcccaaaatgctgggattacaggcgtgagccactgtgcccagcttgggcattccactttcaaaccaagggtgtagaaatacattcccagccatgttcacccaggaagtgccacagaggccactcagtgagagacaggtgggccccttgtgcccttaatatgcccgtggccatggagcctctttcctagggcccctcctctgtgaggcgcttactccctctcaaggtgtagatgtagctggaagacaagaaggggccagacactggcactggggctcacacctgcaatcccagcgctttgggaggctgaggtgggaggatcacttgagcccaggagtttgaggctgcagtgagctaggattgcacctttgcactccagcctgggtgacagagcaagacgcatctcaccctccaaataaactaggaagggcacacagaaattgaagtggtggagatggcagtaaagttccagtgagaaaatttagaaatagttggtgaggctggtcatggtggctctcgcctataattccagccagcactttgagaggcccaggcaggagaatcacttgaggccaggagttcaagacccacctaggcaacatagagagatcctgtagatgctatatatatattatatattattatacataattatataatatataataattttttgtaatttttttttttgtaaaaaaaaaaaattaggctcatgcgcagtgtggtggcagcaggcacggtctcgacatgcagaaagacgccagcaagttcgtggatctgtgcgtgctgcagaaatgctccaccagcaactgcatcatcagtgccaaggaccacacatccatgcggatgaacgtggccaaggccagtgaggtcacgggcaggtttaacagccagtttaaaacctgtgctatctgcaggactgtttgcaggatgggtgagtcagatgattccattctctaattggccatggccaagggcgtcatctcaactatttggtttttgagatggagtcttgctctgttgcctaggctggagtgcagtggtgtgatattggctcactgcaacctctgcctcctgggccaaaatgattctcctgcgtcagcctcccaagtagctgggattacagacgtgcactaccacgcctggctaattttttgtatttttagtagagatgggttttcaccacgttggccaggctgttctcaaactcccgacctcaagcattctgtctgcctcagcctcccaaagtgctgggattacaggcgtgtgcaaccatacccggccatttttgtatttttagtggtaatgggtttcatcatgttggccaggctggtctccaactcctgacctcaagtgatccacctgccttggcctcccaaagtgctgggattacaggcatgaactcactgtgcccgatctcaaagaacttttgattggagagaatcatggatgtagaatatttgtcataaatatataatgaaaactttaaaaaatgtataattaaaaaaataatgaaagaagaaataattgttgagaaatttatgaaaggatatgaaaaattagcatatcctttacaaacccagattggcatttagaattgaggaaaggtgtgtaacatcaatttacttattttggttaagcaaattctatcaaataataatatgtgcagttagtatctcctgttccacctcgtagctgctttacctaaaccatgcattgacacgtacctccaaggcctcaaagtgcccacagtgtgtgctcccacagcattaaaatgcacccccttaacattttatttatcaccccccaccactattccaggcctgaaacagtcttatgaactgtccgtgaggcacttgtttgctgaaacagtaactgagctgaattcttgtggtggttcctatgaacacccgggaagaaacagccagcagaggccgcctgagcctgaaccgagtttctcttccaggtgctgcggtgtgtcgcggggtgcccaggcctggaggaactctaccttgagtctaacaacattttcatttccgaaaggtaactagcacttacttaaatgcatctatccccatttaatcatcattctgagtaaataaatggtctcaattatatctaaccttaatttttagaaggatttgcaaacaagaattaggaaaaatgcttattattcattgccttcacaaattagaatttcactaattggttctaatcaaaggaaactcatcagaattaaatatttgtgaagacatgagttatattagttttgcatcagtgtattaacttgctgtttcttttttttctttttctttttttgagacagagtctcactctgtcgcccaggctggagtgcagtggcgatcttggctcactgtaacctccgcctcctgagttcaagcgattcttctgcctcagcctcccgagtagctgggattataggtgcctgccaccatgcccggctaattttctttatttttagtagagacggggtttcaccatcttttacggggtttcaccatcttggccaggctggtctcgaactcctgaccttgtgagccactgtgcctggccaacttgctgtttctaaatggaagttctgtaggatatgctataaggattaaataatgtatttttcattagcatcatctgtttaaggtcattgtaccaaagtacatgtaaaactttgttctctgaaatatattgttgcctcatctcctttttaaattaataatattaaattactatgtaaaattaacctaactgtgggaaaatttacaacagattctgaattaaaggattcagaatcttaaagattttcgtttacagaagggtttcattatgtaggcaaatgcaggttttttgttttgttttttttttgagatagagtttcattcttgtcacccaggctagagtgcaatggcaccatctcggctcactgcaacctccacctccctggttcaagtgattctcctgcctcagcctcccatgtagctgggactacaggcacgtgccaccatgcctggctaatttttgtatttttagtagagacggggtttcaccatgttggcccggctggtcttgaactcctgacctcagatgatccacccgcctcggcctcccgaagtgctgggattacaggtgtgagccaccgtgcctggcctgcaggttttttaaattaaatttttttattttgagataatcatatattcacatgaagttttataagaaatgatacacagagatcacttgtacccatgacccaggttcccccattggtaacaagttgcaaaactatgatataggatcacaggctaggtgtgacactgataccggcaggaatatgtgcatcaccacagggaccactcaggttgcccctttacagtcatatttacttgcttcttatccccagccctccatcgcaccaaatgcagggattttaaggctgtatctttgaaaacaattaagagataaattcacggtgaaaaaattttattttccatacaggccaacagatgttctccagacagtcaagttattagatctttcctctaatcaattaattgatgaaaatcagctgtatctgatagcccacctgcccaggtaatttgcccctaaatgcctgatacaatagtgttcagtcaattcttagtgaagcagttttcatatgctatgtatgctttctcaatagaaacgtggtaacaatgatggaatttctaaattgagtaattccctttgggaaattttcatttgaattcatttagaaaatttacttgtgaaccctgtataatgtggactatgtctgtaccagataatttgaagaatgaataatttgaccctggtgataatgcggaaagtcttcattcattaaactccgggcagtagaccgtgtctctttcctctgagacgcatttagcacctgacatagcagtaggtactcaagaaccattaggtgactatggagtcattagaatacaggataaagagttcactttgcatgtcctaagttggactttatggtttctaagtattttacatgggattaaaaacccagggtgtaggaaaaaaatttacaaaccgagtctggttgataccccatagcattttacattgttctgtgtaatcaaattgtacattttgaatttcaggttagaacaattaatcctctctgacactggaatttcttctctacattttccggatgctggaattggtatataagattagtaaagttccccactgcccccccacactatacttcagctactttcacttctactgtgtaacttcattcctctttttatagggtgcaaaacgtccatgttcccatccttgaagtacctggtagtaaacgacaatcagatatcacaagtaagagctgctcggagtatgcccagcacactgttgcctctttccactctcatggcagagtttggaggttccttctaccaaaaaagtaaaaagaaatttaaatcgaaagagaaatacctcctcagagtgaaactcctcataagaagccaaaaatattaagaaagaaattagttcacttcacacttaagtggacttcacacttaaatggcacattaatagagtaaaaggggccgggtgtggtggctcaagcctgtaatcccagcactttgggaggtcgaggcgggcggatcacctgaggtcgggagttcgagaccagcctgaccaacatggtgaaaccccatctctactaaaaaaaaaaaaaaatcgcaaaattaaccgggcgtggtggcgcatgcctgtaatcccagctactcgggaggctgaggcaggagaatcgcctgaactcaggaggcggaggttgtgatgagccgagatcgcgccgttgctctccagcctgggaaacgagcgaaactccatctcaaaaaacaaaacaaaacaaaacaaaaaacaacagtaaaagtatgtggtctttctagaggggattgcttagtgcatgatgaaattccctgcctcagattagaactagggacatgctttcctgttgctggttcaaacttctgcaaaagtggcatgaacgtaccgcttttcatttatttccttttgctgtgtttcagtggtcgtttttcaatgagctagagaagttaccaagtctacgggctttgtcctgcctaagaaaccccctgaccaaagaggacaaagaagcagagacggcgcgactactcattatcgccagcattggccagctgaagacgctgaacaaatgtgaggtgagcactggcgtcatgactagatattttttagactagaaaataaatgattttaggccaggcgccgtggctcacacctgtaatcccagcactttgggaggctggggcaggctgatcgctgcagtccaggagtttgagaccagcctgggcaatcttgtgaaaccccatctctacaaaaaatacaaaaattagctgcatggtggcacgcgcctgtaagtgcttgtagtcccagctactcaggaggctgaagtgggagaatcacctgagcccgggaggccaaggctgcagtgagccatgaacatgccactgcactccagcctgggcaatggagtgagaccctgtcttaatttaaaaaaaaaaaaaaaagtaaaaaaattatttttgaatattgtaaagggggtgagatgtagctttccttggaatggtaaagattagccttgtgcagtttcataatagtggttcttttccagctcctcaggagagagtcctccacttagatcagtgcagtatcatttgaggcacaccaggcaccgtctccatgttttcagggaatgtaggcagaaagaacacagaccacagagctgctttctcctccccttctcagccactcttccccataaaagtgggaagtccatgccttgtccttgccagcacttttgtgcattcactgggagtcagtcagctccaccagagcaggcgcctccaggcagacctgggggaggcgacccagggtacctggtgtagtcctgaaactggcctatgcgcaagtactcgcatgaattaaaagtgtaggccaggcacggtggctgacacctgtaatcccagcactttgggaggccgaggttggcagatcatgaggtcaggagatcgagaccatcctggctaacacggcgaaaccccgtctctactaaaaatacaaaaaaattagccaggcattgtggcatgcacctgtaatcccagctattccagaggctgaggcaggagaatcacttgaatctgggaggtggaggttgcagtgagctgagatcatgccactgcactctagcctgggcgacacagcgagactccatctcaaattaaaaaaaaaaagagtgtaaaactgaaattcttttttcttttctaataaacccctgagttctgtcaatgttaaaaagaagggtgaaaactagatcttgtccctctcaatttgattattttctgcatgtgctatggaggaaggacaaggtgcaaaacgcaaaggacatgttagaaaaaagctttgtaataggcttgtttttatgtcacatgaacatagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgagtacgtgcgtatacactggtggccttcaggtggtggatttccagctggaacaaagttttttcttgggtatcaaaagaggttctcagtgttgcttttgcccttcttcctttcctgggcttcttgtattcatctgaatggactataggcactttcctggggcgagggcggcagggcaagagcagtatctttcagcaggaggaacctgggagactgtttatgttcttgaaatggagaggtttgcatttggggaagggaaagcaattcttttatttttaagagatggagttggccgggcgcggtggctcaggcctgtaatcccagcattttgggaggctgaggcgggtggatcacgaggtcaggagatcgagaccatcctagctaacacggtgaaaccccgtccctactaaaaatacaaaaaaaaaaatgagccgggcgtggtggcgggcacctgtagtcccagctactcaggaggctgaggcaggagaatggtgtgaacccggggggcggagcttgcagtgagccgagatcacaccactgtactccagcctgggcgacagaacgagactccgtctcaaaacaaaaaaagagagatggagtcttgctctgtcgcccaggcccaggctggagtgatctcagctcactgtaacccctgcctcccgggttcaatttattctcctgccttagcctcctgagtagctgggattagaggcgcccgccaccacgcccgactaatttttgtatttttagtagagacggggtttcaccatattggccaggctggtcttgaactcctgacctcaagtgatccacccgcctcggcctgtcaaagtgctgagattataggtgtgagccaccgtgcgtagcaggaaagcatttctttttctttttttttcttttgagacagagtcttgctctgtcacccaggctggagtgcagtggcacaatctcagctcattgcaacctccacctcctgggttcaagtgattctcctccctcagcttccagagtagctgggactacaggcgcacaccaccatgcctggctaatttttgtatatttattttttgagacggagcctcgctctgtcgcccaggctggagtgcagtgccgcgatctccgctcactgcaagctccgcctcccgggttcacgccattctcctgcctcagcctcccgagtggctgggactacaggcgcccaccaccacacccggctaattttttgtatttttagtagggacggggtttcaccgtgttagccaggatggtctcgatctcctgaccttgtgatccacccaccttggcctcccagagtgctgggattacaggcgtgagccaccgcgcccagccagggaaagcacttcttaaatgtaggttcttctcttgcatatgtccaccaggtttcaggtggcgcaccatgctccactgtaggaagggtaggaagcactccagtttatgtctgaggcatccgtatatatatatatttttttgagatggtgtttcgctcttgttgcccagactggagtccaatggcgcgatctcggctcactgcaacctctacctcctgggttcaagtgattctcctgcttcagcctcctgagaagctgggattacaggcgtctgccaccatgcccggctaattttttgtatttttagtagagatggggtttcaccaggttggccaggctggtctcaaactcctgaactcaggtgattcgcccgcctcagcctcccaaagtgctgggattacaggcgagagccaccgcgcccagccggcatctgtatttttttaaagccccccaggtaattctagtgaataggaaagttcgtatgagtgtagttctgcagtaagctctcgtcccgagggctcgctaccaaggctggcacttggcatgcacggtggttccttaaatcctccagcctggttcttcaggctttgaagctaagaattcatgagtctttgtccctgatgtactttccattttgttttgatgacattattactccacatttcgcttttatgttatttccttttttatatttcttaatgcaagaagctcgctgcataaacgcttcaggcttgaacagtatgtttaaggaagaaaagcagcctagaggaatcactttcaaatgactccattagccagcccaatctcctggccacgctcggtgaattctaaatcactcgggggtgggcaagggaagatgtgaagcagccgggcaggtattgttgagtatttcactgctaagaatgttagaagacaaaagcacagatagatggggggatttagagaaatgttgtcactgtttggcctagagcaggaaaaaagtactgctttcctcctctcctgtggaggctgtggtccaggcctaggaactggtttgcagtatggtactgagcacccagcctggcactgcacggtctggtggaaacgtgagaagtgtcctgtggatcgtgtctcaggtggcaccaggtttctgtcagcgcagaaagagaactgttaccaaaggtgacactcggggaaaacatttgaagtatttgaaggcagtcttctcttgctagttttgagtcaggacacctaaggaacaatgatgtaatacacatgtaaacatgttgcttttcatttgttgtcttttgttgagtttcactggtcattaacaatgagctagataagctacagagtctgcagctctgggtagatagaagattctgcccttggaagtggtcgttgtccatcactcctaaaaatcacactgaataaaggcagctccatgtgtcctgggaaaggcacaggctctctggacgcttacctatcctttgtttgtttgtttgttttgtttttacttatagtggcctttggtttatcattcatctcttttgctttcttaaacagaatatggtgcacctgaagattgggaactcaaaacacagcaaccacttatgctgaaaaaccagctactaagtaagaatctcagattcaaatagtttatttgtatttgagtgcttaggtgctgaaacagttagtgtgtttctcttaagtgtgtacctcttaagtacctaagtaaatgccttgagttttaaatgaaaatttttttttttttttttgagacagagtctccctctgtctcccaggctggagtgcagtggtgtgatctcagctcattgcaacctccgcctcccaggttctaagcgattctcctgcctcagcctctggagtagctgggactacaggcatacacaaccatgcccggctaattttttttaatcgagacggagttttgctcttgttgcccagactggagtgcagtggcacgatcttggctcaccgcaacctccgcctcccgggttcaagcgattttcgtgccttagcctcccgagtagctgggattacaggcatgcgccaccacacccagttaattttgtatttttagtagagatggggtttcaccatgttggccaggctggtctcaaactcctgacctcaggagatccacccgcctcggcctcccaaagtgctaggattagcggcatgagctaccgcgccctgtcaaagaaatgaattctttaaaacatgtttaaattcttatacatttttgtaactcctatgttttaaactcatttaatagtgttataaatgtgggaggtattggagttgtgaaccaaattgtgatttgtgaatttatgacttgaaaacctagccaagctgtaaggaaagaagtactaagtggggaaaagggaaagtattgtccagctatttctgttgttgttagcaatccatggaaggattaatagaaagaattttaaacattgattagacctgccaatttgcactgaatacctctatcatttggccatctgttgatgtgtgtggataatttaaatccatataatagtagatatcaattagtctttttctttgtttctcttaaagcactgaagataaaataccctcatcaacttgatcagaaagtcctggagaaacaactgccgggtaagaagaaccagcctgtcttttccttaaactctgaatcatcggcctaggtatgagtcagctaaaattaaaacctttaactcatgtctcaaagtgtggacctcagaacttacaggttttcattagtcttttatattctaaaatacaatcaatcatgctaatatcactcccccatgcccccaaaagttcaggtctcccctaactttatcagctgaaagcagttctgttaaaattggaagcccctgcatataattacacacacacacacacacacatatatatatacacacacacacacaattttttttgagacagggcctcactctgtcacccaggttggaatgcagtggcaccaactcagctcacggcagcctctgcttcctgggcccaagcaattctccagcctcagcctccacgtagctgggactacacgtgcgagccaccaacgcccagctaatttttgtattttttgtagagatgggttttcgccatgttgcccaggctggtctcgaattcctgagctcaaagccatcctcctgcctcagcctcccagtgttggaattaattacaggcatgagccactgcagttggcctaagttgtatttttaaccaaaaaacctgagaccttgaatggcatagccttttggaagcattccccaagcctgctgctgtttccagggagactgtgacactgggtttggggtctgcttctcatcccttcataagagaggagctgtgtcctggtgaaccaaattcttacgggaggtttgtgactttgcttacattctacttctcctgactgattaggagtccctgcaaaaacaattcgcagatgctcttttaatggacaccctgaaatggttttctttgagaaagctaccttagaacttaaaaaaattgtggtactggaactgaattacttttatttggaaaataaatatgcttgtgtcaataaagtagatcaacataacttaccttaaactttcactcaaaagaaaaatgaaattatagtctatttttgagtatgccatgatactgtgaattctcaagattaaacttgattcatagctaaatgctaaaatataaataatttagagcagtgaggatttaaataaatgaaatacacatcagcttaatgactctagtacactgggtttctttgcccatcagtgcagtaaattcacattgatttttaaattagtttctatcagataaagcaagcttatcatggtattgcttatagaaggccttagttgtgttcaaagaagtacctttctgattgataaccatccatttaatttaccacaacgtctccatttttatttattcacaatccagtttctactcctgtaatatgtaatttggctactgctatataatgggttagaattagtgatttcccccttcattattctgttttcaaacttagacagacagtaaaggccctggtggagacagactagtcaaagagggccaggactgttttatttttgatatatttttttcagatggggtctggctgtcactcacgctggagtgcagtggtgccatctcagctcactgcaggctccatcaccttgatcccgggctcaagtgatcctcctacctcagcctcctgagtagctgggactataggcacgaaccaccacaccccgctaatttttttgatttttagtagagatgaagcctcgctatgttgctaaggctggcctcaaactcctgagctcaagcagttctcctgtcatcacctcccaaagtgctggggttataggtgtgagccaccatgcctggcaggccaggactttctgtgaatgtttttggccttcgatgtctttgcgtgtttccttttgcctttgcagatacatcaaatcaattcatgggaatgttaccactatagagtatttgctcaagaatattgtcattagacctgtttcgttaagctttccttttcagtctttctctggaaggcactgaggtagacctgccaaggcctgccgtctgggcatatgcctgaatgcagcccttggctgggggtgacagtgccgccttacccttctctacttccacactgtacacctgactggtatcccaggtcttctgagattcagttagccattttgggaacacccactgcattcatgctgtttttattaatctttgggtagctagcagagattcgactatccatagaaattatatgtaagaattactactttaaactattcagaatctgagtcctatattctataaattcagcagtaagccagcagattacaagggttcctttttttccccttttttatttgcttttctgtttctcaaatgtgcactcactcactcactcatacaaaggttcttaatactaattcttatgccacatgctgtgaatatttaaccactaacataggtaaatgtcttctaaacagaaaagtaatagccaggcatggtggctcacacctgtaatcctagcactttgggaggccaaggtgggcaaattgcttgagcccaggagttcgagaccagcctgagcaacatggtgaaaccccgtctctacaaaaataaataaatacaaaaattagctgggtgtggtggtgcatgcctgtagtcccagctgcttgggcggctgaggtgggaggatcacttgagcctgggaagttgaggctgcagtgagctgtgattgagccactgcaatctggcctgggtgacagagtgaggccctgtctaaaattaaaacaaaacaaaacaaaactgcaatatctttttttttatccattagattagcaaaattaaaataatactggctggcatgaaaaagcagtatacccttttttaaagtcatgtgggaactactataaaaagttaaaaatacacatatgctctgaccaagcattgtatcttgcagcatttgtaatggtaaagatagtaagaatctaagtacttgccagcggaggaatggtgaataagctctggtggaaccacacagcacacaaggcactgtcgtgtgtcaccgaggagagtgaagcagtctagagctgcgctgtccagtgtggctgcaataaccacatgtggctatttaaattcattaaaataaaataaattgagttcttcagtcatactcgccgctttccaggtgctcagtaccacatgtggctgccatactgggcagtgtatggctagaggacatggcatggaattggcatgaaaagctataccatcatgtcataaagaaatacaaatgtagtacgtcaatatattataaaacctatacatccttttttttttgagacggagtctcattctgtcacccaggctagagtgcagtggcatgatctcggctcactgcaaactctgccttccgggttcaagcaactctcccggcctcagcttcccaagtagctgggataacaggtgcccgccaccatgcctggctaatttttgtatttttagtagagacggggtttctccatgttggccaggctggtctcaaactcctgacctcagatgatccgcccgcctcggcctcccaaagtgttgggattacaggcgtgagccactgcgcctggcttaaaacctatacatccttatatgaacacagaaaaaaaaaggcctagaggtatacctctcaaatttttaacactggtcataggcaggtaaaaagaaataatcagctatttccatattttctgaatgttaagacagtcatgttactatattaaaaatggtaatgctatttattacatagagattgctactttcttctatagaaccggtatgagtaggcaggttttttttttttttttgagacaggttctcactttgttacccaggctggatggagtacagtggcgcgatcatggctcactgtagccttgacctcctgggctcaagtgatcctcccaagtagctgggactagaggcgtacatcgctatgcttggctaattttttattttttgtagagatggggtatcctcatgttgcccaggctggtctcaaattcctgggctctgatccctctgcctcccaaagtgctggggttacaggtgtgagcaggccaggcagatttcttattagaactgttttatgaccaaactttttgtttctggcatgtgttaggagtatgtcactccccactggtgtgcagcaggtaaccccttctctcaccagccttcaaacaatgaaagccagtccgtctcaatcttttgaaaggactagactatcacatattcacacatgaaagagcaaattgttaattaaaattataaattctattaactgtattcaatacatacaaaaaggccagtttttattctaaaataaagaacatttattatcacaagttggataaaaacacacagcttttacaaaaatgatttttgatagaaaaatatgtttgaatacactgtgatatttgtaggaacaccacactattgctgtatctccagctaaagcttcaaggaaactctatttcttataatcaaaatatccactatttaccacaacccgtctttggaaagaagttcatagtgtattctgaacaaaccaaagcatttactcggaagttacattcccatgcctggcagtcacttgtgtatgtttaatacagttacacatgatgtaattacagaatggcggcgctggaagggaccttgtagatcatttagttggcaccctaattttacagagggggaactaaggccagagttgagagatgtcctcaggatacctgagtcccattccagtgttcgttcagtaattcataaggaagtcatcataaaggtttaaaaagaaaacgttaatgactcgctccctttattcttctgtgctgagagtatcattctggtttattcagattaagaaagaaatacactactgaaatggtatgaaactcactgtcaaagggcacttaggtccgttggctccgtttcccacagttccccaaatgaacaggtggtacaagactcaggctttcccctaattacttacttgggtaaagtgacttgggtaaaatgaaagatacagccaggcgctgggctcatgcttgtaatcccagcactttggggggccagggcgggcggatcacgaggtcaggagttcaagaccagcctggccaacatggtgaaaccccgtctctactaaaaatacaaaagttagctgggtgtggtgatgggcaccagctactcaggaggctgaggcaggagaattgtttgaacccgggaagcggaggttgcagtgagccgagattacaccattgcactccagcctgggcgacagagcaagacttacttaagtaagtaagtaagtcagtctcaaaaaaaaaaaaaaaaaaaagacagatacagctatcattgcaatgatactgtggtctcatcacatgagctagttttacaggtaactgtcatttgagagaacgaatggacttttcttgtcttttgataggctccatgacaattcaaaaggtgaagggattgctgtcacgtcttctcaaagttcctgtgtcagaccttctgttgtcctatgaaagtcccaaagtaagttgcccagcaaaatacaaagtcaaagtcaagcttagtcctcgtattatgacattaaactgtctctagatagcaacagtttgattctaaatggagaccatgggtctgtttgtttgattttaagggtaagctactgcctggggacggggtgggggaagagtatgtgtagcatgctttatcggatctgtcttaatcacatccttccccaccttcgttctaattttagaagccgggcagagaaatcgagctggaaaatgacctaaagtcattacagttttattctgtggaaaatggagattgtctattagtgcgatggtgacaaccaactaataaaatttaaagaccacactgcttatcgtgtctggggttcaccggaaataaatgattcactggaacaattctactgtcaaaacaaagggggtttacaacttgtcctaagtataacaagggatgtattttttgttgggaagtgaccatttctaggcttatacataatagcaataataaaggctttgaacctac

SEQ ID NO: 1838 - DNA, 81554 bp, Homo sapiens; identical to SEQ ID NO: 1837

SEQ ID NO: 1839 - DNA, 22379 bp, Homo sapiens
ctgtattttttcaaagagaattttaatctgaaaaattagcagagattctgccttcacaattagagtttaacatgagtcttccagtgttttaaaaagaactgtaatatacataaagcaaaatattttggcatcacctagtgaaaacagacgatgtggtattttttcagccatctcatatagttaggccccgagttacaatttgagataagttgattcctaaacagaatgtgctttacagaatgtgaccaattttattactcccaaggaccttgtttcagattatcttaaaaccagagttcactgatctcacattttaaaaagaaaaaagtttgttaactgttttaatcaatatgagtagtaacaaacatccctaattggattctagagaggaagcagggaaggccaggtgcggtggctcatgcctgtaatcccagcactttgggaggccaaggcgggtggatcacgaggtcaggagttcaagaccagcctagccaacatagtgaaacccccgtctctactaaaaatacaaaaaattagccaggcatggtggcaggtgcctgtaatcccaactacttgggaggctgaggcagagaattgcttgaacccgggaggcagaggatgcagtgagctgagatcgcaccactgcactccagcctgggcaacagagcgagactccatctcaaaaaaaaaaaaaaaaaaaggaagcagggaacaactgagccaaaacaaaattatcccctaaggacttgactttggacttccacataaatgtgaccttgtagaactagatacatatttatcaggtaaataaatatgtaattatttagtaattagatcaagatacatgagcagtctttagcattaataattacattatttttaggaactcttatcaaatatggtcctggatctcttaatttcccatatgcagtgattttagttaaaattccaaaggatttctttttcctataatatctccatttctgagtatcatcataccaaaacaattagtattctcttattcaaggctttagatgttcgattattccctacccttccatcctcacacacacaataattgcccagataaataataataaactgtggtttccaagtatctcactgggatttttattctttataccttgcaggactagtccaagatttgaataccctgaacttatttggcaagagcgatgagtactcttaaaattactatctggaaattatattatttagaatctgccaattacctagatcccccctcaacaattgtttcaccaaggaacttcctgaaagcacatgtataagtatcataactattagaaaatgtttcaaatgctattatatttgatagaaccattcagttaacaaaatcctaaatcataaactggcttttagaattacacacttaaaaaaacagtaaactacaagagttgttttgtacacttcattctcttcgaatgcctttgtggcttacagtgataatcacatatattcgttccttgcaacctttttcattttgatcttcgtttgtaacggataactgggttttcaggggtgtgaatcatagttgtataattcacagtgggaaagtatccatcaatgagatcaaattcatataaacgaagcatagtggaccaaattgtcttaatttgaacataggcaaaattttccccaatacaacgatgacgccctaaaaaaaagaaaaagttataagaatcagtttaaattctttctcatcctttttagcctggggtgatattatctacattttagatgaacagcaaatgtacagataatataataaaaagatgacattcttttcacataaaacaacatgaattattaaaaattccaggagattttcaataccacattttaggaaaacagtacttgactgatcacataacttttccaattactttttctgaaaatatatatctgggttaaatatatggaaagtttgaatcataagatggtaatctagtttgggaatatagtagaatattctgtttgtcccaagaaagccctagttaaaagtcaatatgaaaaccttccaatcaaacctcaaatgtcattataaatgtatggaagaaaatgagatttaatgaacccaaaataatatactaaaaagtcacacccatgtagaaactgacaagctgattctaaaatgcatataaaaatgcaaaggacctaggatatccaaagcaatcttggaaaaagaactgagttggaggacataaaactgatttcaaatctgacttcaagactaaagataaaacagagtggtactaggtaaggatcaacaaatagatcaatggaacagagcagagagcccagaacagaatatttttatggttatttgattatcagtacagacaccaaagcaagccaatgaggaaaagcaagtcttttcaacataaggtccaggaataactagatattacatgggggaaaaatgaaattcaactcctatgtcacaccataatcaaatactaattcaagaagggtcacaaaccatgatgctaacagcataaatttcagtagagaagaacaggagaatatcttcatgactcaggggctaagcaaaaattttaagacagggccagaaagcaataaccatttaaaagattgatacattggactaaactaaaggttattcatttgtcaaaactcaatgaatgttgacttaagatttgggcatttcattgcaagatttttcatcaaaagaaaaaacctaaactgatagtgcttagcacagtgcttgcttggcccataactgtacttatttctaggagtgacatttaagatgagcatttacaaattggtccatatttcaaatataacaactaaagagaagcttggcttacaggaagaatagtccaaggatttaatcgcaacaagcaagaagtatcctaattgaatcaacataagagtagataaattctgatgattcacaaaatgtaatattatgaaaatgaatgaactatatgcaccaacataaataaacagcacaattacgaggtaaaagaatgagtaaagaaattagagacatgtaatgtgatatttaacaagattaacgtaagatcatatatccccccataaattcaagtccatccagaaccttagaatgtgatcttaattgggaaataggatctttatatacacaattatttaagatgagatgaccctgacttagggtaggacttagatccaatgactggtgtccttataagaatgccatgttaagatacagagacatgaacaagaagaaagcctgttgaagacaggggtagtaattggaacaatgtagttacaagccaagggttgccaagagccaccagaagctaggaagatgcaaggaaggattctcctgtagaaccttaaggaggagcacggtcctgccaataccttgatttcacacttccagcctccaaaactgtgatagaatatatttctattgttttaagccacccatattgtaattagttacagaagccctaggaaactaacacaaagattgaaaaaaagatggaggagacattatatctgtactcaaatacctcatacaatataagttcagagactatggttaggaccaactataaatgagatgttaaaaagaaacagatttcagctttaacataaggctctaaaaatgacagctgtccaaacatagaatgagccatcataaaaggtaactgaacaacccacaacccatttctagtaaagttcaagtggaaaccagataattactagtttagaaacgattcctctttggggcagaatttgggctacagaactaatgctcttcccatctgttaacaatctgattctttggccaggtggcatggctcacgcctgtaatcccagcactgtgggaggccaaggtgggcagattgcttcaagcctggaattcgagaccagcctggccaacatggcaaaacccagtctctactaaaagctcaaaaattagctgagcgtggtggtacacacctgtaatcccagctactcaggaggctaaggcacgagaattacttgaacccagaggtggaggttgcagtgagctgagagattgtgccactgcactccagactgggtgacagagcaagactctctcaaaaaaaaaactatgattcttttatatattgtgttatacaccacagtattaaatttattacataaagttaagatctgaagttcccaaaggactttatattttcctttatatgtggaaaaagtgtgaccaatgacaagtcatctgtcatttaaatgatccctttggaaagactaaagcatagaatatagtttaatcagtacagagaaccaatggacagagaaattactggagaaacaagggtatagctaaattattttaggatcttactggaaatgaaatttgcaagcctacacacaacctgcccaaatttaaagaccattttctcatacggatattcagagagcaaaaatgttgactaacgatcgagaagagctttaattttaaaagactgcctttgcttttttgtgaaatgctagtaatctgttattccctgaatggtgtgctgactccaatggttctttaaaagagaatccacaaagagctttaaataccattgtaagggaaaacaaggatgttctataaaaattagacctaataaaaccagacaggttaggaagtagtgaagcattatataaggatttatggaacaattccatttggtacaaaggaaatatttttctccaacttataaagattcttctcctaaaaaagtttgcaaaaatgtccctatgaggaaagggagagataatttgtaaacacaattcggaatattttgacagagacaaatatgttatcagaacaaacatttccaatctaaaatataatcatcttaccagctccaaatggcacataggcaaacttttcccctgatgctgggttatcctgtaagtagcgatcaggattaaagtccaggcgttctacccatgagtctttaagtctttgattgacagtgggagaaacacacacctgatgtcctggaggaatggtataccctgccacagtctataaacaaaagccacacatttcattagagaatttaaaaatgtgctgacaaataatcagatcattgtgtaataaagcatgaatatacatgggatactcagatgctccttgacttatgataggtttacatcctgataaatccatcataaagtcaaaaaattataagttgaatcacataaatcaagaaccatctgtacatatatttaaaaactggctagataataggcaaactaaaaattattttaactcaagatgatttccagtgagccagcgttgggttggaagtacacagtacacaaatcaaacccataatgccttggaggtagggttggaatttcagagaggctttcactatcaatttgtacacttcatattaacaattttttacaacaaaatgttatttttaaaaccaagaaaaatatgtactttgatttttaaaaccccaattgttaaagaaaaatgcagaacatgattagcattaaagattagcatgtaggccgggcgcgggattacacctgtaatcccagcactttgggaggccaaggcgggtggatcacctgaggtcgggagttcgagatcagcctgaccaacatggataaaccccatctctactaaaatacaaaaaattagccaggcatggtggcatgcccctgtaatcccagctacttgggaggctgaggcagaagaattgcttgaacccgggaggcggaggttgcagtgagctgagatcgcaccactgcactccagcctgggcaacaagagtgaaatgccgtctcaaaaaaaaaaaaaacagattagcacgtatactatctacaattaggtaaaaatatgtttttagagtatataaaactgaagattaggtagaagtgattattctacttttttaatttaaaaaaatctcttttatgctactctacttcctcttttctttttctttcttttttatttttattttttttgagacagggtcttgctctgttgcccaggcagcaatgcagtggcgtgatcatggattactgcagtttcaacctcccaggctcaagcaatctacccacatcagcctcccaagcagctgggaccacaggcatgtgccattatggccagctaatttttagaaaaaattttgtagagatgaggtcagtctcactatgttgcccaggctggtctcaaattctggcctcaagtgatcctcccacctcagcctcccaaagtgttgagattacaggtgtgaaccaccacacccacctatttcttctttttgataaaaactgggggtatagaggggaagatgtagccaagatactcacctgaggagttctggccattctcatcatgatcattataggaggtctaagtcttaatgtttcttttatacagcgatcaagtaaatttagatccttgagctaaaatgagaaagcatttcctgattgttataaataacatacttcaacagtacaaaaaattagtttaacttcttagttagtacaagacagcttgcattccagctaaaagtacagaggtaactggttcagggtggctggggttatcatgctctaccactgtccatggtgaaaaaggagggcaaggtaacagaagcgattgccctgaagaatgaagtaagaacctacaaaaattcactcctccaaaaaatgaaaacagtagcaacaatcttaatgtcaactttttcaaaattctggaagattaaccaaaggcttgcaacaatctaaggagagttaattcaagaaaaagaaatctgaatcttggtaagaagagtaagctttgtggtagtgtaagttgtatttctttcatcctcctctccccaaatccatggtagccccggaaaccaacagcatgacaactatagcagctgtgaaagccagaagcctaacaactattagaggagccagagcaaattttccaaaaatatttagcaaaaattgtttaacactgaaggcgcctgagatggtgatatcagttggtgctaagagacagaacaagaagtttaaaagggaaaactggggagtaagatgtccacaggagactttgaaaagttccaacataagagaatcttgaaggccacacatatgtataagaccatgcatatgcccaggtaagatctaagaggctgtaatcttttacctctggctgacctgtacacacaggtagtgaaggcagacttgtaactgcctgttggagtgttaataacatcccctaacacacacatacagagcctttcagcaaaagctaggagactggctgttcaaagcacttcagtaaatctctgtccaaatattagatgcccactaaagtaagcaagcagagatttcagtgacctcactgaacaaggaatgacataattaatccaggaaacgcagtaaacaaacagcagcagcaacaacaacaacaacaaagagccagcaacaataaacccagggaggagggcatctgatttccacagttgccacattattttaaatgtacagttttcaacaaaaaaattacaaaaaacacaccaaaacaggaaagtatggccagtacatagaaaaagcaagcagtttaatagaaactatccatgaagaagcccagacattggacttactagataatgaatttaaatcagctattataaacaggttcaaagaactatagcaaaatatgcctagatatctctagtaaaatggagaatatcaatatattatttttttagagaaccaaatagaaattcaagaactgagaagtatgagaactgaaatgaaaaattcacccgaggggatcaacagcagatttggactggcagaagaaagaataacatcaaaaaaataacaataataaaatacttaagaatacatttaacaagagaagtttaaacattgtgcaccaaaaactataaaacattgttgaaagaaattaaagaactaaaataagagaaagacatctcatgttcacagatttaaagactaaaattgtgctcccaaattaatatggcgatacaatgcaatcattgtcaaaaatctcagctagcttctttgcagaaactgacacactgaccccaaaattcatatggaaactaaagggactaggagtagataaacagccttgaaaaggacaaagtcagaggactcacactcccgaattcaaaacttattacaaaactacgtaatggcatcagactaaacatatcaatggaatagaactgagtccagaaataaagccttaaatttatggtcaagaggctttttaaaatgtatttattttttcagagacagggtttcgctatgttgcccaggctggaccccaagtcctgagctcaagcgaccttcccatctcagcttctcagtagctgagaatacaggcacgtgccactgcgcctggctataatagatttttttacaaagacaattcaacgtggaaaaaatagtcttttcaacaaacagtgtgggacaactggataaacacatgcaaaagaatgatgacctcacatcatatacataaattaattcataatggatcaaagacctaaatgtaagatatgaaactacaaaacactaagaagaatacacagaaataaatcttcatacactttgattaggcattagtttctctgacaccaaaagcacattaaaaaaaaatagatgaactcttacaactcaataataaaaagacaactcattttaaatatgggaacaggatgtgagcagacatttctccaaagaagtataccaaagccaaagaacacatcataagacactcaacatcactagtcaccagggaaatgcaaaatcaaaacaaaataccaactgggcatggtggctcacacctgtaatcccagcactttgggaggccaaggcgggcagatgacttgaggtcaggagttcaagaccagcctggccaatatggtacaaccttgtctctaccaaaaatacaaaaattagccaggcgtggtggtgtgtacccagctacttgggaggctgaggaaggagaatagcttgaacctgggaagccgaggttgcagtaagccaaggtcgcgccattgcactagagcctgggcatcacaccaagactctgtctcaaaaaaaaaaaaaaaagtatcacttcacacctattataataaaaaaatcaagtaacaagtttggtgagggggtgaagtcaggaccaacatatactgtttagtgagatttgaaagtggtgcagccactttttaaaacagtctggcagttcttcaaagttaccttataacccagcaattctactcctaggtatgaccccccaaaattgaaaacacatgtccacataaaatcagtacacaaacgtttagagcggcattattcataatagtttaaaaggtggaaacaactcaaatgtccatcaactgatgaacaaataaacaaaatgtggtctatccatataatggaatattattggtaataacaaagactgaagtactgatacatgctacaacatggaagaaccctgataacatgctaagtgaaacaaggtagtcacaaaagactacaaattgtatgatcccatttacatgaaatatccagaataggcaaactcacagaggcaaaaggagattaatggttgccaggggcagcagtcagggagaatgaagcatgactgctaatgggtaccagctctcttttgggagtgatgtaaatgttctaaaattaaattatgatgatggtttcccaactcttaatatgctaaaaaccacaaagtgtacattttaaatggatggatttatgctatgtaaatatatcagttaagctgttattttaagttactaaaaacaagaatgagtgttgagacatcactactgagcttacagaaataaaaaggattatgagaatactatgaacaattgtatgccaacaaattaggtaacctagatgaaatggacaaattcctagagagatataaactactgaaactgacataagaagaaatggaatatctgaataaacctgtaacaaataaattgaattagtaagtaaagtcttctcagaaagaaaagcacagatctagatgatttcactgctgaatttttgcaaatatgtaaaaaaggattaacaccaatcatccacaaactcttccaaaaattagaagaaaaaaagaatacttccaaatacattctatgagatgagtatgatcctgatatcaaaaccagtcaaagacatcacagtgaaactagagatcaatatcctttatgaatatagatgcaaaaatcctcaacaaaacaccagcaagtttatatgtagtaacatatagaaagaactatgcaccatgacaaagtaggatttatcccaggaatacaattaacatctgaaaatcagtgtaatgtgccatattaatataggaccaaaagcacaaaagataacaggaagatgacatcaccaaggtttgcttccaagatggaatgtcaggttgtgcagtgagttgtcctctcttcctttccacccagcaagttgcatgtagtatttgtaaatgtcttgtcctcattactactactactactacttttagaagtctctgctcatgcccaggccactctggacatacagaattctaagtaattcagaggcttctacacttcataagacacacaacatgcacataatatcctctatgtacagaagccagactttgaagcagaggaagtaagtaccaaagaaacatccccaaggatctctaagccatcaacccaaaacatatctgataaagcttaatggcaagaagcaataacattaagatattttaggtaaggttatagggaatttgctaaaaatagagaagctgatcaatttaagctatagtatatagaaaatctcaaattgtcccttttaaaaattagccacagatcctcaaagtcataaggcagcaatgaaactgaaaaatccaacaaacctggtcataagttaaaggaggcagattctctccacagactgttttctgttctaaataacattttttttgaagtgttttgtctctggccaaaaagaagcccatccaagcactagtagttgaggatgtatgctgccctgccaagagtaatccaataagcatccctgctacttcatcatcagtcaaaggacgcccatccctaaggaatgaaccaaagacacaaatttaacattttggcagatacatttcatgcctcaacctttaaataaagtgtcataatgaatacatttttcaggtatagtggtctcttatatttgactatcacaagtcaagagttttttttctcttagggaagagacagaccagcacaaaacgattttgattacaaaagactccattacagttcattagcaaacttttaccatacccagtcactgggattacagtaagacacaggatgccaatagtttatgtctcaacaatttaaagagtccaaagatcacagctaccaacttattttgccagcatcactgttttttaactggaaatactatttaactgtgttttaatgtgtaatttcctgcttcagcttaatatgttatctgaatagctcttacttgtatgtagcatctagtaaagtttggagaatgtcatcaattttttcttgagactgtctgcgtttctggattgccttatagaaaatatccttgatttcccgatgagctctgtccctgcgtctgtaattaaaagataaagatgattttcttaaataaagaaataaccttctaggatcaaattcattttgagaaccaggaccgagcataaagcatcttatttaaccaactttaatgactctaaaataattgacaaaaaaatcagaaccaggaacatactggaagtcatgaaaatcttacattgttaaaaatgtccatagtccctaagggcaagaactgtgctttatttaacatatatatcccagattcttaacacattgcctgtgttcaaactaaaggcctaaaacaagcaagaaattcctttagaagtattttccagttcaacagaaagtaggatactcttttaaattaacataaaattccaattttaataccaaatcaagtcttaaagcagaagagtcactctggttcttccatggaatctggttctacttttcactttctaatacaatagttttttgtagggggtgaaaatactagcagattcagaaaacaagcttcaactcctaaactttacctttaaatagtatgttcactatgtagcaggtaccatgttaagtgttttacatgaattactcacttttatcttcctgtgaggtacatactattaacctcaagttatagctagctgcataagatcacacagaaagcaaacattggagctggaatttaaaactaggcagtctgactcccaagccccctcttaaatcaagccttctaaaaaaaactcctactctgtttcatttacaagactgttaatctgttattgaggatcaactgaaaccatgtgtacagaagagaagatgttggggcttaactgtatgaatacagtcgaaccaggaaaacataggcctgtttaagaaagtgaattgaataatctggttaaattagttggtatgagtagaagaaagaaagactgggccagaatgtgaagggcctaacatagcaagctctgacttcatccaagagacagagcaggtagaaacaggcaggtagaaatgtacatttatgggccaggtgcagtggctcacgcctgtaatcccagcactatgggaggccgaggcgggcggatcacaaggtcgggagatcaagaccatcctggctaacacggtgaaaccccatctctactaaaagtacaaaacaattagccaggcttggtggcgggtgcctgtagtcccagctactcgggaggctgaggcaggagaatggcgtgaacctgggaagcagagcttgcagtgagccgagctcatgccactgcactccagcctgggcgagagagcaagactccatcaccaaaaaaaaaaaaaaaaaaaagaaatgcacatttatggagaacccactatgagtccagggctgtgctgggtgttctaatataagatatatgaaaacattttgaaactgcaaagctccttgcaaatataaggtatgatgagttccagagaactttagggaatctctcctggctcttccttttactcccacccctcttccaatctgtaactagatagagggggcagaaatagaagaaaagggactagcaatctatctcctccccatctgtcacctaaacaccaataaatcaacaaaagtacagaaagcctactaatatgcaaaacactaagcactaagctatagatcaagtcctaagagcaatatttctttatatcagaggcagtccctgtccttaagaaacagaaaattaaataaaggcacaaatatttaaaacaaagaaacttcacaatacaataaaaagccaccaaagatttcaaacaagtgctagagaagagctgtatcacttttaggtatagttcagagactttcctgaggataaggaatacgtgaggtaagcaggcttttaaactaggctgggctcagtggctcacgcctgtaatcctaacactttgggaggctgaggcaggtggatcacctgaggtcaggagtttgaaaccagcctggccaacatgatgaaaccctgtctctactaaaaatagaaaaattagttgggcatggtggcacgtgcctgtagtcccagctctcaggaggatgaggcaggagaattgcttgaacacaggaggcagagactgcagtgagccgagatcacaccactgcactacagctggggcaacagagcaagactccatctcaaaaacaaaaacataaataaaatattagactagacagacaacaaatcacctttttaataaactgaaacttactttaaatgagctcattatataaagaaaatttgtcttgaattcttatagaagaaaggggattcataatcttacccattttgtatgttttacttgtttaatttttatctttgttaaggcaaagcataccaacactacaataattatacaaagttaaataacctagtgtaatatattctttatccatacctgaaactaggcaaaggcagccaacctggtaagagccaggctgcatggctgaaacctccatccaaatctgcatacagctgtgctaccttttcattgagttgacttctgatttcctttccatgcaaacaatggctagctgttaaaattatgagctcagaaagagcttcaaacacatctagggagaaaaaaaagattattctcattactatttccaaaaagtgaaagaaaattgagaattaaaaacagaactcaagaagaaacaagatcctattcatatcatcaaaaaaagtctgtagacagacatgtgactatgtacaacaacaaagaggggcaataaaccaaacaatgtgaagcaccctgtccctctaaacagccaaaacagatcccagaaacacatctcaaaaccccactcatgagcacttcatcatgaaaagaataaatgtggttatttgatttccaggtcacaataacaaaagcagaaaaaaggttatttatagtgcatatgacaataataaggtacttcccaaggaatagtagccaaagatcagattatttcccaggttaaaagtaggaagatcagggccaaaatggaattactggcgatatgtaaaagaaaactataatcaccaattagtatatcccaacactggagacaaatgcaccaggcaagcataatttgatgacaactaataaaaattatccaattaatttcctgttaattccacattcactaaatgaacttccaatgatcatctggctttccaattatatttgtcaataaaaagaatatcagtaaatattctggatttcttggtgctgtaattatatgtctcacatgcattattacattggcattctaatttatacatcagtttcttgtatggttagaaaatatatcaatatcaacttaagtataccaaaaacaaagattctggaactcttacagaggccaaaggccagacccagaatatagtgacctgctgccctgggtcctgctgccctgtgggcagatgttgcttcctactatgggcacagcaattgcttctgaaggcaatacttaacttgcagcccagtataaaaactggattctcagttacaacttcatggtaatcattacataaccctcccataaatctaaggtagttttacatacactgtaatttgttttttatatactacacacatatatactctacttttctattcacagagaagtagaaatgttaggacaaacataaaacattttgcttacttttttctccactttctccccaactctcaaagtattcctttgtttctttttcaattatagaaacatgctgtttaaagtgggctatgttaaggccactttttaacattttcttctgctccaagaaaaccttcaaaaaaattcaaaacggggatacggcattaaaacacatttttgttttatcataaaatccatttaggttattataattatgtaacactaacacaagtaatggttttaaccctttgggcatttacattttaagagtctaaatgaatagatctatctgactctaaatgaatagagtctaaatgaatatatatatctgaacagagggattttccagggccctgttttttggccttaaggagaggcattcattccctcattccccatcactagaaacaagatttaatgttaactcttaactgctatactagggtactggctaatgtgtgttacattcacagccagagcccataccaagcattggggccaattgtctgatttgtgttctatatcaacttaaaacaatttcgtatttggcttttgagggtaaaacatacacatagatgtaccccacacgtgaagttgttgcattaaaagaggacttctgaagtcagcaatctctaaacagcgcttatgttagaatttcaggcaggaatgggtaggcaggaagtccttttgatgaagtaacagcattgtctaataaccctttcaaattaaatcccagtatgctaagttatcattgattccattatttgtacaggaagccctttaatattgtttagccatgacagcaaatataaaactaaatacccattacttatcagttatccatggcctttcttctcatgattcttcagacttttgaaccaaggaataaactggttctacattttattacatttttgtttggttggtttctgtgtgtgtgtgtgtgtgtgtgtgtgtgcgcgtgcgtgtgtgtgtgtgtgtttggttttttgtttctgtttttgagacagggtctcactctgttgccaaggctaaagtgcagtgttgtgatctcggctcactgcaacctccgcctcctgggttcaagcgattctcatgcctcagcctcccaagtagctggaatttacaggtgtgcaccaccagccccacccagctaatttttgtatttttagtagagacagggtttcaccatgttggccaggctggtcttgaactcctgactttgagtgatccacccaccttggcctcccaaagtgctgggattacaggaatgagccaccatgcctggctgtttctacattttaaatgtataatgtctcactattagctataactactgaggtatagatttgtctttatttatggtaacagtgtcacctactggattaggcacatcgtatgcaactcccttcccaaacacaggtgttgtcaggcgactgtagacatcttctgcattcaggtcttcatttttactattaaaaagcagtgcagcagcatcactccccagaaggtaagtaaatgtcttgcctaccatggtaaaactaaatacaggtccatactaaaaagagaaaagtacatatagtgatgttacaaaaaatatgcaacactacgacagtaactttttaaaatcacaaaataatgcattattaaaaaaataaaaacatatataaaccttaaagcaattcttttcatcttgccatactcctccttcctttgtccaaatttataattatgttcatttagttgcaaatgtagtataaatataactgtttattatgcttttttcagtttatattgacaatgttttctattgtctatataaacatcacaatgttaatttactgactactctttcattattggacatatgggtgatatgtcagggttttctttagttattacagctaattctgtgatgaacacctctgaaaatatagacttcttccccctttggttaaaaacaaattttacaagactagccaaagaatttgaccttttctatagtacctgctatgtgaagacactacaagtttatttatctattttagcactatctcacctacactaaatgacttcattttttattttatattaatttggttagatgttaaatactttcccttgcagttttctggttatgattgaagactagactctgggggtataatcatgaaaaaaaatactgtcccaactcaccaagcttagtctattggaaaaaatacaaattaatcaaataatcacattaacaaacataaaactgcaaatgtgacaagtattacagaaaggaaagcaactctgtgatgagagaatctaaaaaagggagacctaatagaggaaaagacaactaggttgagaccagaagaatgaggagctggtttggtagctaaacatacacaaaggccctaaaagtaagagaaagagaaaggaggagatgagagttgagcattaggcagtgctagaccatacagagcctcataagccattttgaggaagtttttaaacgggtgacaagaatttttcagagaaaaaggaaagatgccattgaaaaagaagtcaacaatacactgagaaaacaaataaaagtaaaaagttcctgagacaaaagagggatggagagttcagcctccgataagaggcaaaatatagttgtaataaaatcaaagtggtagaacgcagtgagccagactgtccgtgttcaaatcccagctcctccacctacttgctgtatgactttggtcctatagtcagagaacttagtctctctgtgtttcgtttctctcacctataaaatggtaataataataatagcagttcttcacagagctgctgccaaattttatatacagggcagagaagagtaccttggcttacttagcatcttaatgacttgttttccattattgttatcattaataaaagtataggctcagaaatcagaccatgtgtaaatcctggcttggccactgtctagcagtgagtccaagaagaaattatatatcctctctgcttctcagttttgtcatctataaaacaaatatacctgaaagggtttttgtggagcttcagtgagatgatctttgtaaagcactaagtactggcataaagtaagtgtttgataattattactgtgataggaagaaagagaataggattactatataaatacaagtaggtttgcatatttgaaattgagaaaatgaggaagttttctttgaatgttttaataattgtctcctaaatcaacgtttttaatcattgtctcctaaacaggagaaaaaatcatctgctttgatggagaggtagaaagattcagaagtttagaaaagtgaaggtttgaattagtcactgtaatgagtggaaaagtaggcccaatcacaagaacataataggactgtggagcagtgttcaaatatcattaaggtaggcaatcataaaatcaggaagaaactaatctggtgcagaaggagacaataactggctgcctccaagggtgacttctgccagctgaacacaatgaaaagatgcggggtcgaggaaatttaaagtacagtattgccaagagtgtaacagaaacgacatgccatggacccaaagcggaaagaggaaagtgaagaatgaaggctgatggatcaggagaaagtaaatggaatgcaagatccaatgaggtcaaagaatagttataatttaaggagttgcacaagcaaaccaggagacggtatggtctacgaataggatatctaaattaatattgtggaagtgaaacagttaagagtgacaagtccaaagcgagactgtgaagtaaatggcttaactggcacagggaagctcattagagagaagacgggcaaataattgagtagctatggtgtcatgtgggtcattcaagtggacagtgaaatcacagaagatgtatagagcaggttagaaaaccccacagatgcatggtaaagaaaaatgagggttaattaatatcaattttaatgacaataagtgaatagaaaactcagaacagtggcttttaaaccatagttgccagaactacaggtttcctcaatggtgtctcaaagacgaccccaggacatgggaaaagctaaaaggataggtatctataagacaccatctcttaaaccagagcagtttccattttgtttcctatactgaggatatgtatatgattacaatgtttttaaatgttctgccacttttttaaaaaagtttaaaaagcacttctctagttgtttttttttttttcctctaattatttggaagacttaccttctcatatgcattttctagaaattcaattggacttttcccaaatgctatggcatgcccaaggaatggaattggggagaaaatgtatggaggacttttctacaagagaaaaaaatagtaaattcaattcgtgtttcatttcaagagagaaacccagtttcgtttcatgaccaaacaattaaacaaaatagctattaagacttcaaaaaaaagttaccaaaaaaaaaggaagcatcagaagtaacttgagaacagccaaattgcaaatacctcaagagagtagctattgtagaaaagaacagaaactcaaaacacggtataagataaacgaccagataaacactaaggcactgtaaatttaaatgatggacactgtccagaatatgtccaattattattggtgtctccaggcaacttttctaaccattagtagcaaaaaaccaaaaaggtcaaactacacttgtcccttggcatttgtggagaactggtcccaggaccccctcacagatttgtatccagggatcctcaagtcccttatataaaatggcaaagtatttgcgtataacctatgcacatcctctcatataccttaaaccatttctatattacttacaatacccaatacaatgtaaaggctatataaactgttattaaactgtgtttttttatttgtattattttttattgttgtgttattttgtattgggtttttttcccctgggtattttagatctacacttggctgaattcccaaatgtggaattcgtgtccccagagggcccactatattgtttcttcactacttactactactactactcacaattttagtcccagatacttgcttaaagaaggtatagaaaaagacaagcagtaacttgtagtatagaaagaagggaaatgtttaagaagctatatttacttctcagtaaacaatcaatctcatgcttctctcactgcaagtgaactagagccactgattttagagtttttaagagagtagatcagctctagcaagaactctagcattcttcataaaagtttctttagatgccacaaaatgagacctgcagattacaacattaagtatcctgaaaatcaaacaaaataatgaaaaagggtaatactcctcaattctctggtggtctcaaatagaaaggagcaccacaacctcacagtacacctcagctaatagaactatctttaaacactaaaagtaactttgtcttcccagagacaaatatcatttccttaaagatcccatgtgtaggaaaaaaataaataaataaataactctttcttatgcctggtatggttcaaacaaaaattattttaaaagctacttggtcaaaagtttgtacattgcattgtcagtaaaagggtagttttcaaaagctacttattgctgactgtaaaaggcacaatcaaataacatttgggagattgaaagctaggttaataaggctgttaaattgaagaaaatgattttttttttttttgagacggagtctcattctgtcgcccagactggagtccagtggcgcaatctcggtttactgcaacctccgcctcctaggttcaagtgattctcgggcctcagcttcccaagcagctgggactacaggcgtgtgccaccacatccagctaatttttgttttgttttgttgtattttagtagagatggggtttctccatgttgttcaggctggtctggaactcctgacctcaggtgatccgcccgcttcggcctcccgaagtgctgggattacaggcgtgagccactgctcccggccgagaaactgttacattattagcatcagaggaaggcccttaccacactccagtcactaccattaccacactctacacatcctccttaatatgggtataaaccaccattaggggcactgctacagcccacagaacactgaaccacacagggcagcctccaggatgacgggccagctgccaacagcatctccgtcaggacccccaccaagggccccaacgaccaccgggtcgttcaaacccacagccgccaatccagccaccgccactaggggcaccactgctgcggtcagtacagaccgctacaaccacaaatgccgcaaccacgaccccgtctaggatcagatacacagccggggaggccagcaccgccccccaacacaaggcaatggcgggtgctacagccagcgccaccagcagcagtgccgccgccgcagccactactccagcccccagcgcgcctgccaccaaagccacgccaagcatggccgcagtcgcccccgcccttgccatccactgagccggtcggggccacggagccgcccacgccagcccttcggccgcctcagctgcggcgcgcgccccactcagaccctaaagaatgtacgtaccacccctgcgggcagctggaccaggtggccggcggccagacggatcaggtagaccaggctgagggtgaaggcgcaggcgatcagcagcatggacaagaggttgccgcctgtcaccttctccatcgcctggcccagcaccgacccacccgcctgcagcaagcccagcagcagcatcccagccgccgccgccattcactccgtcggaaacactgaaggccgaggtcgccaccgctcctcccaatcgacggaacgagagaagctggcagatggtcgtccacagggggccttgccccaggtctcctactaaacccagccccacccctcgggtcccacgcgcgccaccccgtgcgtcac

SEQ ID NO: 1840 - DNA, 22598 bp, Homo sapiens
ctgtattttttcaaagagaattttaatctgaaaaattagcagagattctgccttcacaattagagtttaacatgagtcttccagtgttttaaaaagaactgtaatatacataaagcaaaatattttggcatcacctagtgaaaacagacgatgtggtattttttcagccatctcatatagttaggccccgagttacaatttgagataagttgattcctaaacagaatgtgctttacagaatgtgaccaattttattactcccaaggaccttgtttcagattatcttaaaaccagagttcactgatctcacattttaaaaagaaaaaagtttgttaactgttttaatcaatatgagtagtaacaaacatccctaattggattctagagaggaagcagggaaggccaggtgcggtggctcatgcctgtaatcccagcactttgggaggccaaggcgggtggatcacgaggtcaggagttcaagaccagcctagccaacatagtgaaacccccgtctctactaaaaatacaaaaaattagccaggcatggtggcaggtgcctgtaatcccaactacttgggaggctgaggcagagaattgcttgaacccgggaggcagaggatgcagtgagctgagatcgcaccactgcactccagcctgggcaacagagcgagactccatctcaaaaaaaaaaaaaaaaaaaggaagcagggaacaactgagccaaaacaaaattatcccctaaggacttgactttggacttccacataaatgtgaccttgtagaactagatacatatttatcaggtaaataaatatgtaattatttagtaattagatcaagatacatgagcagtctttagcattaataattacattatttttaggaactcttatcaaatatggtcctggatctcttaatttcccatatgcagtgattttagttaaaattccaaaggatttctttttcctataatatctccatttctgagtatcatcataccaaaacaattagtattctcttattcaaggctttagatgttcgattattccctacccttccatcctcacacacacaataattgcccagataaataataataaactgtggtttccaagtatctcactgggatttttattctttataccttgcaggactagtccaagatttgaataccctgaacttatttggcaagagcgatgagtactcttaaaattactatctggaaattatattatttagaatctgccaattacctagatcccccctcaacaattgtttcaccaaggaacttcctgaaagcacatgtataagtatcataactattagaaaatgtttcaaatgctattatatttgatagaaccattcagttaacaaaatcctaaatcataaactggcttttagaattacacacttaaaaaaacagtaaactacaagagttgttttgtacacttcattctcttcgaatgcctttgtggcttacagtgataatcacatatattcgttccttgcaacctttttcattttgatcttcgtttgtaacggataactgggttttcaggggtgtgaatcatagttgtataattcacagtgggaaagtatccatcaatgagatcaaattcatataaacgaagcatagtggaccaaattgtcttaatttgaacataggcaaaattttccccaatacaacgatgacgccctaaaaaaaagaaaaagttataagaatcagtttaaattctttctcatcctttttagcctggggtgatattatctacattttagatgaacagcaaatgtacagataatataataaaaagatgacattcttttcacataaaacaacatgaattattaaaaattccaggagattttcaataccacattttaggaaaacagtacttgactgatcacataacttttccaattactttttctgaaaatatatatctgggttaaatatatggaaagtttgaatcataagatggtaatctagtttgggaatatagtagaatattctgtttgtcccaagaaagccctagttaaaagtcaatatgaaaaccttccaatcaaacctcaaatgtcattataaatgtatggaagaaaatgagatttaatgaacccaaaataatatactaaaaagtcacacccatgtagaaactgacaagctgattctaaaatgcatataaaaatgcaaaggacctaggatatccaaagcaatcttggaaaaagaactgagttggaggacataaaactgatttcaaatctgacttcaagactaaagataaaacagagtggtactaggtaaggatcaacaaatagatcaatggaacagagcagagagcccagaacagaatatttttatggttatttgattatcagtacagacaccaaagcaagccaatgaggaaaagcaagtcttttcaacataaggtccaggaataactagatattacatgggggaaaaatgaaattcaactcctatgtcacaccataatcaaatactaattcaagaagggtcacaaaccatgatgctaacagcataaatttcagtagagaagaacaggagaatatcttcatgactcaggggctaagcaaaaattttaagacagggccagaaagcaataaccatttaaaagattgatacattggactaaactaaaggttattcatttgtcaaaactcaatgaatgttgacttaagatttgggcatttcattgcaagatttttcatcaaaagaaaaaacctaaactgatagtgcttagcacagtgcttgcttggcccataactgtacttatttctaggagtgacatttaagatgagcatttacaaattggtccatatttcaaatataacaactaaagagaagcttggcttacaggaagaatagtccaaggatttaatcgcaacaagcaagaagtatcctaattgaatcaacataagagtagataaattctgatgattcacaaaatgtaatattatgaaaatgaatgaactatatgcaccaacataaataaacagcacaattacgaggtaaaagaatgagtaaagaaattagagacatgtaatgtgatatttaacaagattaacgtaagatcatatatccccccataaattcaagtccatccagaaccttagaatgtgatcttaattgggaaataggatctttatatacacaattatttaagatgagatgaccctgacttagggtaggacttagatccaatgactggtgtccttataagaatgccatgttaagatacagagacatgaacaagaagaaagcctgttgaagacaggggtagtaattggaacaatgtagttacaagccaagggttgccaagagccaccagaagctaggaagatgcaaggaaggattctcctgtagaaccttaaggaggagcacggtcctgccaataccttgatttcacacttccagcctccaaaactgtgatagaatatatttctattgttttaagccacccatattgtaattagttacagaagccctaggaaactaacacaaagattgaaaaaaagatggaggagacattatatctgtactcaaatacctcatacaatataagttcagagactatggttaggaccaactataaatgagatgttaaaaagaaacagatttcagctttaacataaggctctaaaaatgacagctgtccaaacatagaatgagccatcataaaaggtaactgaacaacccacaacccatttctagtaaagttcaagtggaaaccagataattactagtttagaaacgattcctctttggggcagaatttgggctacagaactaatgctcttcccatctgttaacaatctgattctttggccaggtggcatggctcacgcctgtaatcccagcactgtgggaggccaaggtgggcagattgcttcaagcctggaattcgagaccagcctggccaacatggcaaaacccagtctctactaaaagctcaaaaattagctgagcgtggtggtacacacctgtaatcccagctactcaggaggctaaggcacgagaattacttgaacccagaggtggaggttgcagtgagctgagagattgtgccactgcactccagactgggtgacagagcaagactctctcaaaaaaaaaactatgattcttttatatattgtgttatacaccacagtattaaatttattacataaagttaagatctgaagttcccaaaggactttatattttcctttatatgtggaaaaagtgtgaccaatgacaagtcatctgtcatttaaatgatccctttggaaagactaaagcatagaatatagtttaatcagtacagagaaccaatggacagagaaattactggagaaacaagggtatagctaaattattttaggatcttactggaaatgaaatttgcaagcctacacacaacctgcccaaatttaaagaccattttctcatacggatattcagagagcaaaaatgttgactaacgatcgagaagagctttaattttaaaagactgcctttgcttttttgtgaaatgctagtaatctgttattccctgaatggtgtgctgactccaatggttctttaaaagagaatccacaaagagctttaaataccattgtaagggaaaacaaggatgttctataaaaattagacctaataaaaccagacaggttaggaagtagtgaagcattatataaggatttatggaacaattccatttggtacaaaggaaatatttttctccaacttataaagattcttctcctaaaaaagtttgcaaaaatgtccctatgaggaaagggagagataatttgtaaacacaattcggaatattttgacagagacaaatatgttatcagaacaaacatttccaatctaaaatataatcatcttaccagctccaaatggcacataggcaaacttttcccctgatgctgggttatcctgtaagtagcgatcaggattaaagtccaggcgttctacccatgagtctttaagtctttgattgacagtgggagaaacacacacctgatgtcctggaggaatggtataccctgccacagtctataaacaaaagccacacatttcattagagaatttaaaaatgtgctgacaaataatcagatcattgtgtaataaagcatgaatatacatgggatactcagatgctccttgacttatgataggtttacatcctgataaatccatcataaagtcaaaaaattataagttgaatcacataaatcaagaaccatctgtacatatatttaaaaactggctagataataggcaaactaaaaattattttaactcaagatgatttccagtgagccagcgttgggttggaagtacacagtacacaaatcaaacccataatgccttggaggtagggttggaatttcagagaggctttcactatcaatttgtacacttcatattaacaattttttacaacaaaatgttatttttaaaaccaagaaaaatatgtactttgatttttaaaaccccaattgttaaagaaaaatgcagaacatgattagcattaaagattagcatgtaggccgggcgcgggattacacctgtaatcccagcactttgggaggccaaggcgggtggatcacctgaggtcgggagttcgagatcagcctgaccaacatggataaaccccatctctactaaaatacaaaaaattagccaggcatggtggcatgcccctgtaatcccagctacttgggaggctgaggcagaagaattgcttgaacccgggaggcggaggttgcagtgagctgagatcgcaccactgcactccagcctgggcaacaagagtgaaatgccgtctcaaaaaaaaaaaaaacagattagcacgtatactatctacaattaggtaaaaatatgtttttagagtatataaaactgaagattaggtagaagtgattattctacttttttaatttaaaaaaatctcttttatgctactctacttcctcttttctttttctttcttttttatttttattttttttgagacagggtcttgctctgttgcccaggcagcaatgcagtggcgtgatcatggattactgcagtttcaacctcccaggctcaagcaatctacccacatcagcctcccaagcagctgggaccacaggcatgtgccattatggccagctaatttttagaaaaaattttgtagagatgaggtcagtctcactatgttgcccaggctggtctcaaattctggcctcaagtgatcctcccacctcagcctcccaaagtgttgagattacaggtgtgaaccaccacacccacctatttcttctttttgataaaaactgggggtatagaggggaagatgtagccaagatactcacctgaggagttctggccattctcatcatgatcattataggaggtctaagtcttaatgtttcttttatacagcgatcaagtaaatttagatccttgagctaaaatgagaaagcatttcctgattgttataaataacatacttcaacagtacaaaaaattagtttaacttcttagttagtacaagacagcttgcattccagctaaaagtacagaggtaactggttcagggtggctggggttatcatgctctaccactgtccatggtgaaaaaggagggcaaggtaacagaagcgattgccctgaagaatgaagtaagaacctacaaaaattcactcctccaaaaaatgaaaacagtagcaacaatcttaatgtcaactttttcaaaattctggaagattaaccaaaggcttgcaacaatctaaggagagttaattcaagaaaaagaaatctgaatcttggtaagaagagtaagctttgtggtagtgtaagttgtatttctttcatcctcctctccccaaatccatggtagccccggaaaccaacagcatgacaactatagcagctgtgaaagccagaagcctaacaactattagaggagccagagcaaattttccaaaaatatttagcaaaaattgtttaacactgaaggcgcctgagatggtgatatcagttggtgctaagagacagaacaagaagtttaaaagggaaaactggggagtaagatgtccacaggagactttgaaaagttccaacataagagaatcttgaaggccacacatatgtataagaccatgcatatgcccaggtaagatctaagaggctgtaatcttttacctctggctgacctgtacacacaggtagtgaaggcagacttgtaactgcctgttggagtgttaataacatcccctaacacacacatacagagcctttcagcaaaagctaggagactggctgttcaaagcacttcagtaaatctctgtccaaatattagatgcccactaaagtaagcaagcagagatttcagtgacctcactgaacaaggaatgacataattaatccaggaaacgcagtaaacaaacagcagcagcaacaacaacaacaacaaagagccagcaacaataaacccagggaggagggcatctgatttccacagttgccacattattttaaatgtacagttttcaacaaaaaaattacaaaaaacacaccaaaacaggaaagtatggccagtacatagaaaaagcaagcagtttaatagaaactatccatgaagaagcccagacattggacttactagataatgaatttaaatcagctattataaacaggttcaaagaactatagcaaaatatgcctagatatctctagtaaaatggagaatatcaatatattatttttttagagaaccaaatagaaattcaagaactgagaagtatgagaactgaaatgaaaaattcacccgaggggatcaacagcagatttggactggcagaagaaagaataacatcaaaaaaataacaataataaaatacttaagaatacatttaacaagagaagtttaaacattgtgcaccaaaaactataaaacattgttgaaagaaattaaagaactaaaataagagaaagacatctcatgttcacagatttaaagactaaaattgtgctcccaaattaatatggcgatacaatgcaatcattgtcaaaaatctcagctagcttctttgcagaaactgacacactgaccccaaaattcatatggaaactaaagggactaggagtagataaacagccttgaaaaggacaaagtcagaggactcacactcccgaattcaaaacttattacaaaactacgtaatggcatcagactaaacatatcaatggaatagaactgagtccagaaataaagccttaaatttatggtcaagaggctttttaaaatgtatttattttttcagagacagggtttcgctatgttgcccaggctggaccccaagtcctgagctcaagcgaccttcccatctcagcttctcagtagctgagaatacaggcacgtgccactgcgcctggctataatagatttttttacaaagacaattcaacgtggaaaaaatagtcttttcaacaaacagtgtgggacaactggataaacacatgcaaaagaatgatgacctcacatcatatacataaattaattcataatggatcaaagacctaaatgtaagatatgaaactacaaaacactaagaagaatacacagaaataaatcttcatacactttgattaggcattagtttctctgacaccaaaagcacattaaaaaaaaatagatgaactcttacaactcaataataaaaagacaactcattttaaatatgggaacaggatgtgagcagacatttctccaaagaagtataccaaagccaaagaacacatcataagacactcaacatcactagtcaccagggaaatgcaaaatcaaaacaaaataccaactgggcatggtggctcacacctgtaatcccagcactttgggaggccaaggcgggcagatgacttgaggtcaggagttcaagaccagcctggccaatatggtacaaccttgtctctaccaaaaatacaaaaattagccaggcgtggtggtgtgtacccagctacttgggaggctgaggaaggagaatagcttgaacctgggaagccgaggttgcagtaagccaaggtcgcgccattgcactagagcctgggcatcacaccaagactctgtctcaaaaaaaaaaaaaaaagtatcacttcacacctattataataaaaaaatcaagtaacaagtttggtgagggggtgaagtcaggaccaacatatactgtttagtgagatttgaaagtggtgcagccactttttaaaacagtctggcagttcttcaaagttaccttataacccagcaattctactcctaggtatgaccccccaaaattgaaaacacatgtccacataaaatcagtacacaaacgtttagagcggcattattcataatagtttaaaaggtggaaacaactcaaatgtccatcaactgatgaacaaataaacaaaatgtggtctatccatataatggaatattattggtaataacaaagactgaagtactgatacatgctacaacatggaagaaccctgataacatgctaagtgaaacaaggtagtcacaaaagactacaaattgtatgatcccatttacatgaaatatccagaataggcaaactcacagaggcaaaaggagattaatggttgccaggggcagcagtcagggagaatgaagcatgactgctaatgggtaccagctctcttttgggagtgatgtaaatgttctaaaattaaattatgatgatggtttcccaactcttaatatgctaaaaaccacaaagtgtacattttaaatggatggatttatgctatgtaaatatatcagttaagctgttattttaagttactaaaaacaagaatgagtgttgagacatcactactgagcttacagaaataaaaaggattatgagaatactatgaacaattgtatgccaacaaattaggtaacctagatgaaatggacaaattcctagagagatataaactactgaaactgacataagaagaaatggaatatctgaataaacctgtaacaaataaattgaattagtaagtaaagtcttctcagaaagaaaagcacagatctagatgatttcactgctgaatttttgcaaatatgtaaaaaaggattaacaccaatcatccacaaactcttccaaaaattagaagaaaaaaagaatacttccaaatacattctatgagatgagtatgatcctgatatcaaaaccagtcaaagacatcacagtgaaactagagatcaatatcctttatgaatatagatgcaaaaatcctcaacaaaacaccagcaagtttatatgtagtaacatatagaaagaactatgcaccatgacaaagtaggatttatcccaggaatacaattaacatctgaaaatcagtgtaatgtgccatattaatataggaccaaaagcacaaaagataacaggaagatgacatcaccaaggtttgcttccaagatggaatgtcaggttgtgcagtgagttgtcctctcttcctttccacccagcaagttgcatgtagtatttgtaaatgtcttgtcctcattactactactactactacttttagaagtctctgctcatgcccaggccactctggacatacagaattctaagtaattcagaggcttctacacttcataagacacacaacatgcacataatatcctctatgtacagaagccagactttgaagcagaggaagtaagtaccaaagaaacatccccaaggatctctaagccatcaacccaaaacatatctgataaagcttaatggcaagaagcaataacattaagatattttaggtaaggttatagggaatttgctaaaaatagagaagctgatcaatttaagctatagtatatagaaaatctcaaattgtcccttttaaaaattagccacagatcctcaaagtcataaggcagcaatgaaactgaaaaatccaacaaacctggtcataagttaaaggaggcagattctctccacagactgttttctgttctaaataacattttttttgaagtgttttgtctctggccaaaaagaagcccatccaagcactagtagttgaggatgtatgctgccctgccaagagtaatccaataagcatccctgctacttcatcatcagtcaaaggacgcccatccctaaggaatgaaccaaagacacaaatttaacattttggcagatacatttcatgcctcaacctttaaataaagtgtcataatgaatacatttttcaggtatagtggtctcttatatttgactatcacaagtcaagagttttttttctcttagggaagagacagaccagcacaaaacgattttgattacaaaagactccattacagttcattagcaaacttttaccatacccagtcactgggattacagtaagacacaggatgccaatagtttatgtctcaacaatttaaagagtccaaagatcacagctaccaacttattttgccagcatcactgttttttaactggaaatactatttaactgtgttttaatgtgtaatttcctgcttcagcttaatatgttatctgaatagctcttacttgtatgtagcatctagtaaagtttggagaatgtcatcaattttttcttgagactgtctgcgtttctggattgccttatagaaaatatccttgatttcccgatgagctctgtccctgcgtctgtaattaaaagataaagatgattttcttaaataaagaaataaccttctaggatcaaattcattttgagaaccaggaccgagcataaagcatcttatttaaccaactttaatgactctaaaataattgacaaaaaaatcagaaccaggaacatactggaagtcatgaaaatcttacattgttaaaaatgtccatagtccctaagggcaagaactgtgctttatttaacatatatatcccagattcttaacacattgcctgtgttcaaactaaaggcctaaaacaagcaagaaattcctttagaagtattttccagttcaacagaaagtaggatactcttttaaattaacataaaattccaattttaataccaaatcaagtcttaaagcagaagagtcactctggttcttccatggaatctggttctacttttcactttctaatacaatagttttttgtagggggtgaaaatactagcagattcagaaaacaagcttcaactcctaaactttacctttaaatagtatgttcactatgtagcaggtaccatgttaagtgttttacatgaattactcacttttatcttcctgtgaggtacatactattaacctcaagttatagctagctgcataagatcacacagaaagcaaacattggagctggaatttaaaactaggcagtctgactcccaagccccctcttaaatcaagccttctaaaaaaaactcctactctgtttcatttacaagactgttaatctgttattgaggatcaactgaaaccatgtgtacagaagagaagatgttggggcttaactgtatgaatacagtcgaaccaggaaaacataggcctgtttaagaaagtgaattgaataatctggttaaattagttggtatgagtagaagaaagaaagactgggccagaatgtgaagggcctaacatagcaagctctgacttcatccaagagacagagcaggtagaaacaggcaggtagaaatgtacatttatgggccaggtgcagtggctcacgcctgtaatcccagcactatgggaggccgaggcgggcggatcacaaggtcgggagatcaagaccatcctggctaacacggtgaaaccccatctctactaaaagtacaaaacaattagccaggcttggtggcgggtgcctgtagtcccagctactcgggaggctgaggcaggagaatggcgtgaacctgggaagcagagcttgcagtgagccgagctcatgccactgcactccagcctgggcgagagagcaagactccatcaccaaaaaaaaaaaaaaaaaaaagaaatgcacatttatggagaacccactatgagtccagggctgtgctgggtgttctaatataagatatatgaaaacattttgaaactgcaaagctccttgcaaatataaggtatgatgagttccagagaactttagggaatctctcctggctcttccttttactcccacccctcttccaatctgtaactagatagagggggcagaaatagaagaaaagggactagcaatctatctcctccccatctgtcacctaaacaccaataaatcaacaaaagtacagaaagcctactaatatgcaaaacactaagcactaagctatagatcaagtcctaagagcaatatttctttatatcagaggcagtccctgtccttaagaaacagaaaattaaataaaggcacaaatatttaaaacaaagaaacttcacaatacaataaaaagccaccaaagatttcaaacaagtgctagagaagagctgtatcacttttaggtatagttcagagactttcctgaggataaggaatacgtgaggtaagcaggcttttaaactaggctgggctcagtggctcacgcctgtaatcctaacactttgggaggctgaggcaggtggatcacctgaggtcaggagtttgaaaccagcctggccaacatgatgaaaccctgtctctactaaaaatagaaaaattagttgggcatggtggcacgtgcctgtagtcccagctctcaggaggatgaggcaggagaattgcttgaacacaggaggcagagactgcagtgagccgagatcacaccactgcactacagctggggcaacagagcaagactccatctcaaaaacaaaaacataaataaaatattagactagacagacaacaaatcacctttttaataaactgaaacttactttaaatgagctcattatataaagaaaatttgtcttgaattcttatagaagaaaggggattcataatcttacccattttgtatgttttacttgtttaatttttatctttgttaaggcaaagcataccaacactacaataattatacaaagttaaataacctagtgtaatatattctttatccatacctgaaactaggcaaaggcagccaacctggtaagagccaggctgcatggctgaaacctccatccaaatctgcatacagctgtgctaccttttcattgagttgacttctgatttcctttccatgcaaacaatggctagctgttaaaattatgagctcagaaagagcttcaaacacatctagggagaaaaaaaagattattctcattactatttccaaaaagtgaaagaaaattgagaattaaaaacagaactcaagaagaaacaagatcctattcatatcatcaaaaaaagtctgtagacagacatgtgactatgtacaacaacaaagaggggcaataaaccaaacaatgtgaagcaccctgtccctctaaacagccaaaacagatcccagaaacacatctcaaaaccccactcatgagcacttcatcatgaaaagaataaatgtggttatttgatttccaggtcacaataacaaaagcagaaaaaaggttatttatagtgcatatgacaataataaggtacttcccaaggaatagtagccaaagatcagattatttcccaggttaaaagtaggaagatcagggccaaaatggaattactggcgatatgtaaaagaaaactataatcaccaattagtatatcccaacactggagacaaatgcaccaggcaagcataatttgatgacaactaataaaaattatccaattaatttcctgttaattccacattcactaaatgaacttccaatgatcatctggctttccaattatatttgtcaataaaaagaatatcagtaaatattctggatttcttggtgctgtaattatatgtctcacatgcattattacattggcattctaatttatacatcagtttcttgtatggttagaaaatatatcaatatcaacttaagtataccaaaaacaaagattctggaactcttacagaggccaaaggccagacccagaatatagtgacctgctgccctgggtcctgctgccctgtgggcagatgttgcttcctactatgggcacagcaattgcttctgaaggcaatacttaacttgcagcccagtataaaaactggattctcagttacaacttcatggtaatcattacataaccctcccataaatctaaggtagttttacatacactgtaatttgttttttatatactacacacatatatactctacttttctattcacagagaagtagaaatgttaggacaaacataaaacattttgcttacttttttctccactttctccccaactctcaaagtattcctttgtttctttttcaattatagaaacatgctgtttaaagtgggctatgttaaggccactttttaacattttcttctgctccaagaaaaccttcaaaaaaattcaaaacggggatacggcattaaaacacatttttgttttatcataaaatccatttaggttattataattatgtaacactaacacaagtaatggttttaaccctttgggcatttacattttaagagtctaaatgaatagatctatctgactctaaatgaatagagtctaaatgaatatatatatctgaacagagggattttccagggccctgttttttggccttaaggagaggcattcattccctcattccccatcactagaaacaagatttaatgttaactcttaactgctatactagggtactggctaatgtgtgttacattcacagccagagcccataccaagcattggggccaattgtctgatttgtgttctatatcaacttaaaacaatttcgtatttggcttttgagggtaaaacatacacatagatgtaccccacacgtgaagttgttgcattaaaagaggacttctgaagtcagcaatctctaaacagcgcttatgttagaatttcaggcaggaatgggtaggcaggaagtccttttgatgaagtaacagcattgtctaataaccctttcaaattaaatcccagtatgctaagttatcattgattccattatttgtacaggaagccctttaatattgtttagccatgacagcaaatataaaactaaatacccattacttatcagttatccatggcctttcttctcatgattcttcagacttttgaaccaaggaataaactggttctacattttattacatttttgtttggttggtttctgtgtgtgtgtgtgtgtgtgtgtgtgtgcgcgtgcgtgtgtgtgtgtgtgtttggttttttgtttctgtttttgagacagggtctcactctgttgccaaggctaaagtgcagtgttgtgatctcggctcactgcaacctccgcctcctgggttcaagcgattctcatgcctcagcctcccaagtagctggaatttacaggtgtgcaccaccagccccacccagctaatttttgtatttttagtagagacagggtttcaccatgttggccaggctggtcttgaactcctgactttgagtgatccacccaccttggcctcccaaagtgctgggattacaggaatgagccaccatgcctggctgtttctacattttaaatgtataatgtctcactattagctataactactgaggtatagatttgtctttatttatggtaacagtgtcacctactggattaggcacatcgtatgcaactcccttcccaaacacaggtgttgtcaggcgactgtagacatcttctgcattcaggtcttcatttttactattaaaaagcagtgcagcagcatcactccccagaaggtaagtaaatgtcttgcctaccatggtaaaactaaatacaggtccatactaaaaagagaaaagtacatatagtgatgttacaaaaaatatgcaacactacgacagtaactttttaaaatcacaaaataatgcattattaaaaaaataaaaacatatataaaccttaaagcaattcttttcatcttgccatactcctccttcctttgtccaaatttataattatgttcatttagttgcaaatgtagtataaatataactgtttattatgcttttttcagtttatattgacaatgttttctattgtctatataaacatcacaatgttaatttactgactactctttcattattggacatatgggtgatatgtcagggttttctttagttattacagctaattctgtgatgaacacctctgaaaatatagacttcttccccctttggttaaaaacaaattttacaagactagccaaagaatttgaccttttctatagtacctgctatgtgaagacactacaagtttatttatctattttagcactatctcacctacactaaatgacttcattttttattttatattaatttggttagatgttaaatactttcccttgcagttttctggttatgattgaagactagactctgggggtataatcatgaaaaaaaatactgtcccaactcaccaagcttagtctattggaaaaaatacaaattaatcaaataatcacattaacaaacataaaactgcaaatgtgacaagtattacagaaaggaaagcaactctgtgatgagagaatctaaaaaagggagacctaatagaggaaaagacaactaggttgagaccagaagaatgaggagctggtttggtagctaaacatacacaaaggccctaaaagtaagagaaagagaaaggaggagatgagagttgagcattaggcagtgctagaccatacagagcctcataagccattttgaggaagtttttaaacgggtgacaagaatttttcagagaaaaaggaaagatgccattgaaaaagaagtcaacaatacactgagaaaacaaataaaagtaaaaagttcctgagacaaaagagggatggagagttcagcctccgataagaggcaaaatatagttgtaataaaatcaaagtggtagaacgcagtgagccagactgtccgtgttcaaatcccagctcctccacctacttgctgtatgactttggtcctatagtcagagaacttagtctctctgtgtttcgtttctctcacctataaaatggtaataataataatagcagttcttcacagagctgctgccaaattttatatacagggcagagaagagtaccttggcttacttagcatcttaatgacttgttttccattattgttatcattaataaaagtataggctcagaaatcagaccatgtgtaaatcctggcttggccactgtctagcagtgagtccaagaagaaattatatatcctctctgcttctcagttttgtcatctataaaacaaatatacctgaaagggtttttgtggagcttcagtgagatgatctttgtaaagcactaagtactggcataaagtaagtgtttgataattattactgtgataggaagaaagagaataggattactatataaatacaagtaggtttgcatatttgaaattgagaaaatgaggaagttttctttgaatgttttaataattgtctcctaaatcaacgtttttaatcattgtctcctaaacaggagaaaaaatcatctgctttgatggagaggtagaaagattcagaagtttagaaaagtgaaggtttgaattagtcactgtaatgagtggaaaagtaggcccaatcacaagaacataataggactgtggagcagtgttcaaatatcattaaggtaggcaatcataaaatcaggaagaaactaatctggtgcagaaggagacaataactggctgcctccaagggtgacttctgccagctgaacacaatgaaaagatgcggggtcgaggaaatttaaagtacagtattgccaagagtgtaacagaaacgacatgccatggacccaaagcggaaagaggaaagtgaagaatgaaggctgatggatcaggagaaagtaaatggaatgcaagatccaatgaggtcaaagaatagttataatttaaggagttgcacaagcaaaccaggagacggtatggtctacgaataggatatctaaattaatattgtggaagtgaaacagttaagagtgacaagtccaaagcgagactgtgaagtaaatggcttaactggcacagggaagctcattagagagaagacgggcaaataattgagtagctatggtgtcatgtgggtcattcaagtggacagtgaaatcacagaagatgtatagagcaggttagaaaaccccacagatgcatggtaaagaaaaatgagggttaattaatatcaattttaatgacaataagtgaatagaaaactcagaacagtggcttttaaaccatagttgccagaactacaggtttcctcaatggtgtctcaaagacgaccccaggacatgggaaaagctaaaaggataggtatctataagacaccatctcttaaaccagagcagtttccattttgtttcctatactgaggatatgtatatgattacaatgtttttaaatgttctgccacttttttaaaaaagtttaaaaagcacttctctagttgtttttttttttttcctctaattatttggaagacttaccttctcatatgcattttctagaaattcaattggacttttcccaaatgctatggcatgcccaaggaatggaattggggagaaaatgtatggaggacttttctacaagagaaaaaaatagtaaattcaattcgtgtttcatttcaagagagaaacccagtttcgtttcatgaccaaacaattaaacaaaatagctattaagacttcaaaaaaaagttaccaaaaaaaaaggaagcatcagaagtaacttgagaacagccaaattgcaaatacctcaagagagtagctattgtagaaaagaacagaaactcaaaacacggtataagataaacgaccagataaacactaaggcactgtaaatttaaatgatggacactgtccagaatatgtccaattattattggtgtctccaggcaacttttctaaccattagtagcaaaaaaccaaaaaggtcaaactacacttgtcccttggcatttgtggagaactggtcccaggaccccctcacagatttgtatccagggatcctcaagtcccttatataaaatggcaaagtatttgcgtataacctatgcacatcctctcatataccttaaaccatttctatattacttacaatacccaatacaatgtaaaggctatataaactgttattaaactgtgtttttttatttgtattattttttattgttgtgttattttgtattgggtttttttcccctgggtattttagatctacacttggctgaattcccaaatgtggaattcgtgtccccagagggcccactatattgtttcttcactacttactactactactactcacaattttagtcccagatacttgcttaaagaaggtatagaaaaagacaagcagtaacttgtagtatagaaagaagggaaatgtttaagaagctatatttacttctcagtaaacaatcaatctcatgcttctctcactgcaagtgaactagagccactgattttagagtttttaagagagtagatcagctctagcaagaactctagcattcttcataaaagtttctttagatgccacaaaatgagacctgcagattacaacattaagtatcctgaaaatcaaacaaaataatgaaaaagggtaatactcctcaattctctggtggtctcaaatagaaaggagcaccacaacctcacagtacacctcagctaatagaactatctttaaacactaaaagtaactttgtcttcccagagacaaatatcatttccttaaagatcccatgtgtaggaaaaaaataaataaataaataactctttcttatgcctggtatggttcaaacaaaaattattttaaaagctacttggtcaaaagtttgtacattgcattgtcagtaaaagggtagttttcaaaagctacttattgctgactgtaaaaggcacaatcaaataacatttgggagattgaaagctaggttaataaggctgttaaattgaagaaaatgattttttttttttttgagacggagtctcattctgtcgcccagactggagtccagtggcgcaatctcggtttactgcaacctccgcctcctaggttcaagtgattctcgggcctcagcttcccaagcagctgggactacaggcgtgtgccaccacatccagctaatttttgttttgttttgttgtattttagtagagatggggtttctccatgttgttcaggctggtctggaactcctgacctcaggtgatccgcccgcttcggcctcccgaagtgctgggattacaggcgtgagccactgctcccggccgagaaactgttacattattagcatcagaggaaggcccttaccacactccagtcactaccattaccacactctacacatcctccttaatatgggtataaaccaccattaggggcactgctacagcccacagaacactgaaccacacagggcagcctccaggatgacgggccagctgccaacagcatctccgtcaggacccccaccaagggccccaacgaccaccgggtcgttcaaacccacagccgccaatccagccaccgccactaggggcaccactgctgcggtcagtacagaccgctacaaccacaaatgccgcaaccacgaccccgtctaggatcagatacacagccggggaggccagcaccgccccccaacacaaggcaatggcgggtgctacagccagcgccaccagcagcagtgccgccgccgcagccactactccagcccccagcgcgcctgccaccaaagccacgccaagcatggccgcagtcgcccccgcccttgccatccactgagccggtcggggccacggagccgcccacgccagcccttcggccgcctcagctgcggcgcgcgccccactcagaccctaaagaatgtacgtaccacccctgcgggcagctggaccaggtggccggcggccagacggatcaggtagaccaggctgagggtgaaggcgcaggcgatcagcagcatggacaagaggttgccgcctgtcaccttctccatcgcctggcccagcaccgacccacccgcctgcagcaagcccagcagcagcatcccagccgccgccgccattcactccgtcggaaacactgaaggccgaggtcgccaccgctcctcccaatcgacggaacgagagaagctggcagatggtcgtccacagggggccttgccccaggtctcctactaaacccagccccacccctcgggtcccacgcgcgccaccccgtgcgtcacagaatggggcgggatgttccgctggccacgccccttaaataacactctgtgaagccgtggtcttcttgcgcgggatagggcacctgaggaagcgggctgcgcctgtggcacagtggtacggggccggaagataacttacctgaagaggcgatcaatccctgagaatcgcgggcgacccgttttttgtgtgcccgggtgcggggtgccgggacacggcgt

SEQ ID NO: 1841 - DNA, 96832 bp, Homo sapiens
gacactgggaggaagtgcgggccgcctgcccgggcgcgttaaggaagttgcccaaaatgaggaagagccgcgggcccggcggctgaggccaccccggcggcggctggagagcgaggaggagcgggtggccccgcgctgcgcccgccctcgcctcacctggcgcaggtaggtgtggccgcgtcccctacccggccgggactttctggtaaggagaggaggttacggggaacgacgcgctgctttcatgccctttcttgttctaccttcatcggccgaggtaaaagtgctgaaaccatgtgaataaaatacaggtgggttccgccagcttcgctcctgaacctacccgcgctcgggatccagaagctgcgccgggagagaggggctcaggcctgggcggaggggacggaggtcagaccgtgcggaaagtgacccgggcaccccagggcgcccaggcccccagggagcgcggaaagtgcggtcgcggcccggccctcgggagacgcgggattgggatcaggcacagcgcgaggaagtcgatcttggagctagaacattttcctttggccatttacacgaatccactggaaaatgccgcagtgtttatcaaagttactcaaagtagaaatgtccagacgtcttatgagcttagacaaatcttttactacaaaaagaaacagcagttgcattcaaacaacaacccttctgaaccactactaaaatttagcataattactcttgtggatacattttcattgtcaagtaatttacttagccaatgaacttggagagcaagaaagttttatgtagtaaaatgtaaatttgagttaagagttaagggtgtttctttttgtctgtttgtctgtttttggcaatgtggctccaaaaccttaagcccacctaaaaactatataaatgcaatccattcttttgttggaatgttcaaggactagaaagacaattggagaagtgagagtttgaatctttttttacgttggaaacagtgttgcaaaatattttttgagttttgcctgacttagcaaagattcagtcgaactcaagtagagttcaaagcattgcagcgtgtagtaaaaaaaaaaaagagttgaagatgttgtgccatatctgattcttggtattaaaaataaaaaaaggaaccatttaatccctaagagttcctggaagaaatggaattgattctaccatctgacttctttgtcttagtagggacaaattcattgccttcacacaggcagcattttaattaaatgcaactaaatacattgatgtcctccttctccccagtgaaagtccgagcagtgcatagatagaattatattttctcaaaaaggcttaaatacatgtaaattattaagtgttttaagtgagaaatctttgtcagttgaaattattttatcaaatcatttttgttctgaacggcacttttgttttaacgtatttagaaaactcttgcattaaaacagaaattgatttgtattatcccctgtatttgaagtgcactttaaagtgtatttgaatgagagattataatcaaattacttgatttgtgtcttatcctcttactcttctaccttggatttgaaaaggttggatttgaacactaggaaaaaagagatttttctactgagggattgtgggaagatttttttttaagcctctgtatttgaagtgaaatataaaataggattttataatagtcttaataactagaaagttttaagctaggataaaaatggggtgtatactttaggtctttatctttcctgagagatgaaattggtagaaacgttattttattgctagatttcactttagaaatgaatcaccctgatctttgttaggcccctatttaatattctaaatgcaggtctaatctctctgcttttttttaatggaagacttcttagtagaacttcacttatttagcacattgtttgcccatggttataatccaatatgcttgtgccaagacgtattttggaattcaagctttttcagaatttggaattaaaatttagaatctaaatttcagaactgagaaagacattgctcagaatttagaaaggtaaacatacatgttgaccctgctggttacatgccattccaatatagtctggagagaatcctgtaattccatgcattaatatttctgtacttttacatttaagaacatgaatattctcactaagtggaataaataaagactataaagagctgtgtgtctgtttagagcaggtgttatcactacgagagcttctctaagacttaccaaaaaaaaaaaaagtgttgtttttcagagctttttagagctgcagctgagggactgagtctgtattagactccactgaactacggtttgcttttaaaaggaaagtgcatttatgttgttcaatacttcacactttccagtaattagaagggcagttcctctctctttagggagtcttaaatagcaagattttactgaattttcaatcataccgatcaaaatagaggtacttcaagtaagagtggatgtctcatctttgtaatataatttcaaacagcatagtttctgacagtctaccattttagagaaacagagcagaagttacttacaggaggggttactgtcaccctttacagctgcagtctgtccatggaagaaatattatttcctgttaactttgcaaccagctgggtttgtgtcagttatctaagcctaagtgatggctaatttttactttctcaactttccctgtatagatttttttccagctaccccctgacttttctactcttgctttgctggttttaacattttccactacttctggattggtttagctataactgggtggagaaaacaacaacaacaacaggaatttaggcctttggggaagaatttgttttgttttagaagtctacacattgagcattactttttcttctaaagcaactaaaatcagaaggcagagtcctaatgagagattatgatcaaattgcctcatttgtgtcttatcaccttcctcttctacttagatttgaacaggttggatttgaatactaggaaaaaagggttttctactgagggattgtgggaagatgttttaagaactagtctgattggattttaggaaagttcattcattttgatatgatgttatcagggacattttctatttgcttataattttatctgaccaatattagcttgtatcaatttgaggtttttttttcctttatgaatcaattgtgcaaggtttgccctacatctcttaaaaggtggttaaactggaatcttaaagacagttgaatttagccaagaccaaagatatgcaaagaaagaatattttgtttatgttacagtacatttaataaatccaaatggctcccttgattcttttctttctgggacaccacgtattgatttctggcagctggccaaaggcagatggtggtggagcaagcgaggacagttaagaatgttgatgattactggattactgaggagtactgtgagctttctggtcctctgctcagaggtgtctagctctgaaactgggatcctggctctgagctggagaggcgcttccagttactgctgtcctggagcgctggaagggagcataagtgtgaggagacagtgggcttttagcctgggatgcagatgagagatgtcttgacctgagtgaaaaccttgcaggcaagctgcaggtctaccgagcagggtgagggaggctctcgacctggatactgtgaactagggagagaaagtaaattcaacagaaggagggcccagggcagagatttaggaatatccacagtttaaatattgctttacttaagtatactctgcctgactataagtagcatttgaatgttcaacatatgacctttcatttctcccctccattggtttgtcttaactgataaatctttattttcccatggtcaacctggtagtttattaatattacatctatcagttcctgttgagttgacatgaaaatgttttggtgtgacctaagttaatttctctttttgtttaattttaatttgtaatgagttcctcttttcattctgcccatcctttggtactgctttgagttatgtcctctagaattctcactatttccttatgattggcatattttcaaagttttttggtgtactaattttaaacagtgtttgttgacactgagaattcaggactttggagttttagaccaccatcaccttctactccttctcacaccatcccaggataattattctctcatttgagattaagaagttatttggtttattttattatggttatataaatatagtttactgctaaagcaaggtatatcattccattttctatctcgtacccctttttgctcttcctggggtaaacccttgctttgtttttgtgttttcttagtttgcactgtgcctattatcatttccttcccaactttctgacataaagatgaaagccctattgacacaattttctacagtgtcagatataccaagtaatctcacggttccatttttctttctttttttctagaaccctccatcttcttcttgtctaacagttgctcttcagtcttgctatacatacagtaatacctgaagaatgtttggaggatatttggtgtgggacttttcttttttttttttctttttcttttttgtagagatgggctctcactatattgcccaggctagtctcaaactcctgggcccaagcaatcctcttgcctcagcctcccaaagtgctgggattataggcatgatccactgtgcccagccctatggggaatatttgttgactaaatatgttttatgtaaattgcttatcatactctttgttgtaacatctgtggcattaatatgcctcttgttaacactcacctacattttacctgttgtaaatccactgtcataattattgaaaatatttctccagagctttttaattctatggttatttatttattgtagtatagaacttttatgatttcttccatcagggtgcattctgaatcatgcttagtgagagatggtttttaactccactttaacagttagcatctatgttttacatcagtgtcaatgtcacttttgtattatatacgacaccaacattttattatctgagtgatgagaatgtttatttttgtggaaatggagatctcatgagactttaagcagattgctggccttctcctcgatttccttgattgattcctgaagtggaactgcagtgctaagtggaattccctgggaagcttgctcaagtaagtaagcatgagaaatgctgaatgaaataaagtgcagcaagcagggataaatatcatgggcatcttcagagcctttgtgcaggtaacatgcacagagattctctgagagagtcagtctcagccagtggtcctacacttccatgaccctgcagtgcgtttgttcttagagtggctttcagggctggctctgccacagcctctttgggaaaccatgcatgacctcttgctgctccttaccaagctccttaggctttgcttggtagaggcagaatgttgtggttgttttcatcttaaatgctaacaatatatgaattatgtggtggatacactgcctcaaagtgacatttatcgaatatttttgtagctacgggttgagagtaagggtctgaggccccactgggttcaagtcccccttctttatttgtaagctcttcttttgtaaatggagcagtcacagggggcttcactctgatacctaatggagaccgtgcctgcagtgctcggtacctggtatgtggttaaaactgacataactgtcagagcctctcccaggcgggctgactctgggaatctgccctgcagtcttggagggaaggcacgtccagataggtttgatgagcaactacaattgccaaagttagtttctctgacctccaagatgggagaactttctaatattttcttttaggaaagttgtccattgcataactgatacacgagtacatatcctttagtacaggattcagatacagcgagcaacagaaaagcccttcttaacctccaccctcagtcccagccctgcccccagtcccactgttggggagcagttggagctctaacctctcttctttcgtcctgtgcattcatgtgtgcatgtgtgcacgtcttcagaagatataatggtgggctgtgtatgtcttcttaatacctttatcactctggaactttctttttattaatatgttggggtgcggggaggtctccatattcagtgattattgtaatttttatgacagtccagaataggcatgtcgattttttttaatttttgatattataaacagtgctgcaatgaatgcactttttcttttcattctttccctctcctttgccatttgcactgtgttttcatgaaaccatcaggttaatctttatctcaaggaagcccttcatccctgtccatcctgttcttcagtccatccacttagttttcctatgattattttagcaagcaggtggttaatttccaaggaatgtagttacttctttgggatttttttaagtgatgtattagttttctgtgtattttattacttgtttgagtgcaccattacccccgtctcccggggtatcagttcatctgcttgcatgcttggtgcctctctctcctgctgtcagctttcctgatgtgctgggtatttccacgtgtgtgttggtttttttttttttttaggtaccctaggcattagtcttttaaggctgcattcttgcagcctgtcccacatgagataggaggagggcaagacctggatgtgcacagggcaggatgggcccataactggtctgtgtggtgtgtgggtggcaggaactccctgttctttgtgggtatggccatgccttccctattcaaacgaagccacacacctgtcttttcctgcgaggcgtcttctgctgctttcttggagctggggagcatctactcttcccttgtcctcccgctcctccctgttcctccctcaggtctctgtcgcttctaaggcactccacccttggtcttctcccaccttgcaccccccacactgctgcctgcctgcacagggggactgtgattgcccccttcagtgtgagcctgacctgcttcatgcctttcaaggagagcattcattgccaagctactcatggaacatctcctcagatcctcagcgtgctatgacttcattttctgtaatactgtttttcatgtttcttccccttctctgcatttatagctgtgcatatgcttgaggtggaaggccaccacttccttttggttaacaacaccaatcagctgatggtcatggctacgtgaaggaactcacagtgagggctcaggaagagcctggctagagcaggctgcatcgcaggccttggcgttaggttccccaaatcactgctggtgatcttgtagctctgtcatgaagtctgtcctgcttattaggataccgagggtccaaattcatagattcttagaagcctgtttaaatatgcagagtatctaattcaacccgattagaaacgggctcagaaaggtgaagggatttgtccaaccactgagtgatgctgctgggattagaactctcaaaactaggtgtttctaatccagaaccagaatccctatccactactctaataaggcgtaaaagaggatctgctgtcctgcctaattggtgggcaggtttggagtcctgtcagcagctcaggaaagcctggagaggcagagggaggacacaggctcagtgtcagacatgccaattttactcatcaccaatggttacacaaaacttgttttgatctttgtggcttttgcattgagaagttaagcatatacaataggaattagacacaatcccaaaccaatgagagactcaagtgagaagagctgaagcttttatgcatgccttccttccatagagataaatttactatccagagtgaactagagcctcgtggaaagtgagtgccgagcccctagctgtgagtgtctctgtccttcccacatcagacctccatgtctgtggctgtccccctacggggcagaactgctgctctctgcttgtgttgctgtcgtgagggttgggagtggacaggtgtggacagatctcagacccgtttccctcctgttatggaaatgtttgtgaggcaggtgggacttcaatgatttggtcaaggaaaggcagcttggcagctggggagaagggctcaggctagaaaggcaagcgtttgtgagggatgatttccccaaagaagccagcagtgtgtaaggtattccccggagcttgtttcttctcagaagactctggaagctgtgtcagtgtctgttatggaggaatggagtatcagtccgatcaggctttcataacaaagcaccacatactgaacggcttgaacagcccaatgtgtcgcctcccaactctgagccaaagagactgaggtcaggatgtcccagggtggctccttccaagggttgggtgggacaatgtgcccccagcatctccttggcttgtgggtgaccatctccagctccacatggcatgctccctgtgtgcctgtctctgggtccagatctccttttcatgtaaggacaccagtcatgttggagtagggctcaccctaaggacttcaatggggcgtaatcactgctgtaaagaccctgtctttaaataaggtcacactcagaggggttagggagttaggacatcaacatttgaacttggggggacacaattcaacctgtaacaaatgtgtgagtgaagactggcacctccccacgatggcctttctgtgatgccatcaagagcaccagggagctctccagatatggagatggacagatgtctaaggcccctgaaatgagcctgctgtacagatgattccagaactctgtcagtgtgaagaccaaacacaattaagcacattaaaatacttacggtaaagtgtttctttcactttagatgtgcaaaaacttaaagagagagagacttatgagaagactcagggaagaaatgtaagataaaggtgttaagggagacaaactccacaaaattgtaaagtgaagctgctgtggggagtagagcccagacccagataatatgcaggcatgggtccaagggaggctttgcacaccaggcgggggaggtgcagggccatggatgaatggtcttgggaaaacggcaaatcgtttggaaaaaaaaacaaaactttgctctttatatcaaaataaattccaagctgaacaaagaataaaaatatagcattgaaataatgaagctattaaaagaaaacttaggtgagttttaaaataattgtgaagaggcctgtctaaatgtgataaaacatatgaatttatattcacactcatcacaagattgataagcatgatttcctaaaattttaagcaaatccccataaaatgaaaaaatatacaaataagtgaaaaaaatggtaagatatatttaatttcaatacttgtggtaaagcatcaatagctttaatatgcagcgagttttttcaaatcaataagaaaaaagacacagatgggtgctgacagggccgtttggtaatatcttttaaaatttaaaacacaagtgctttcactcaacaacttcacttttaggaacctatcacacatataaattgacaaaagtggagaaatattcattgcaacattttattttataatagcaaaaaaaaatcactaagggaagtacagttgattcatatgttggaatcctatgcagtcttctaaaaaatgtggaatttatttcatacaccaaatataacaatgtccaagttctactagtgaaaaagcaagatgtaacatatcattgtatttgtttaaaaaactcatgctgggttgggtgcaatgactcatgcctgtaattccagcactttgggaagccaaggtgggtggattgcttgagctcaggagtttgaagccagcctgggcaatatggcaaaaccccacctctatgacaaataccaaaaaaaaaaactagcctggactggtggtgtgcacctgtagtcccagctacatgggggcgctgaggtggggggatcacttgagtccaagaggtcaaggctgcagtgagctgagatcatgccactgcacaccagcctgggtgacagagcaagaccctgtctcaaaaataataagtgaaaaaaaaaaaaaaaacctaaaaatctcccacatgcacataataatttaagtgatattggattgtcgtttactacttatacatgcatttctgcctatacatattctatccagtgtgtacacatgtgtatgtaaatatgtagcatgatctggaagtgtaagcaccaaattaagaacagcagctttggggggaggggaatagaattggtttagagaaaaaggtgaaattaacatttttattctgcctacttcagtgtgcctgcagtatttacaacgatcaggagtgtgtacttttttcaatttagaaaaatgataataataaggtttgcttggggggaaagggtaagtaggatgagaccaggaagagaagtaacttagaaacacatcatgcatcatgactgctggcaccattctgtcctccaatgaagagcgaggctttgagaggttcagcagctcacccaaaggtgtacagccatggtctcaaacatgcttgcaccctgctgtcactcaggtcctgaagcccaggccacctccaaggacactggggtgctctggggtgcagcctgccttcagatgtttcttaaagccactcctactccaccccacccagtgcaggagccaagattgaggaccaccatttgacagctagttcataggatttcatagcacacaaacacatctttaaaggctgatgaggtttccaccaaattgggatttattggtatgctgggtataatggcagctgtgtgtgcctttgactgcaaagacactgggcaggccagagtggctcctccccatttgatatgtgtgtgtgtgtgtgtgtgtgtgtgtgtgtgtgtgtgagagagagagattgagagagagagggctcgtgtttttctgttgcgaacagtcctttccacgggaacttatattctcctaaggtttgccactctgcagaacttttggaggaaggctttagagtgagaatgtcagtgcattctcagcgtgcaactgtaagacttgcaggaggtgaatgcacatgaaataattctcagaggaagaatatgtgcactggtcagatagcaaaactgacctgtaacattttctacacaagaggatttgaatggttttcgtctttaagatttttttttaacattatgcttagtccaccatgctttattctgtcagaccatttgccatctgcatgcttcatgagaaatgtttttttctcgtgagaaggacgtaagcaatttcgctcctggttgagagtttggtccatagtttcttggtgtctgtgggttggcttctgggcctcgctggctgcagctgatggtgaccagaagggctgttcttgtgagtcattaggggatgggccgctgctgctacctccccaccccagccacctccatcagcactgtgccatactcgcccagaagggcccctggactcatcgcctgcccccatgtttacactttttaataaaatctctagaattgtggcttagacctgtaaacatccagttccaagaagtggctctaaagccctctctgggggcagagtggttgtcagaagcagaccaggcctcggggtctagattccatccttcactggaactgctgggggctggtagtaccccatctgcaaaatgaggttaaaaatacctaacccttgggttgctatcaagctcagagatgctgtatgcaaagcaccaatcagactggctcacaaagaataggccctctgtcaaatgttcatggttgagtgcgggatgtcaaggataaatagctactggttaccagggaattgaagacagggttcttttacaagcaaaaagattttataagagggtcacagaaacagagtgactcttgcccaacagtatcataagcaaataagctgtgtctagatcctaatcatgtgtttagggctctgctgggtttaataagcaacacatagggggtgcgttgtcctccactctcacatccccagtcactagacaaggtcactcccccggggggcatcttactcagaagctctaaaagactttgttgcatgactttggcccttgctcttttaaaatgtccagttagagaccatggcatggagagttttgtatactctgctcccagcatggcaccctctttgcatattgtgggcactcttaaagttatttctcatattgtaatatatcagatatgacttggatatagtcaactagatatttagtgaaaaatgtatcacccccattatcaaaagaaaacccaaagccttcaagtttggcccaactagaaggaatttctggaagggggaagtaccaggaccacacagactctggtcctggcggtgtgtttataagatgcagctcatcatgttggtctctgtcatccctgctaaggctgttcattatggaaccactggccacatgtggccactgaccgctcaattacttaaaaccatttaaaataaatgttgaatttcatttaaaatttaaaattcagttctcagtcacacaggccaggtgtcagggaccagttgccacacgtgggtggaaggtgtgtgtcaggcagagtagaacaggtatttccattgctgtagcaaggtctgccagacaccaagctgctctcagcccatcccctgaggagcccagaagggatatgaacttccacccacctctcccctttcccagttctcagtgccactccttgcctaagtgcacggtaacactcgccactatttcatgtgttgatacctgcagctcccaattttcttaagaggatctgaccctgggaactgatgagggcaccaggagtgccctctcctttgacatgagaccttgagtcttgtccatggggccctggcctggcccttttcatccccaaggctgtaacattctcctgcacaacacaacacacgtgcacacacacacacacacacacacacacacacaaaataatgttacttctcagtcacccgggaactgacatggttcccagttatttccttgcagcagccctccaagcggtaacacagccttggagaaagctactaagtcatgtatccttggggtaagcacacttggttcagaatagtttctgaaagaacaaaccaggtttttgctcaagagggttttgagggactggagaaaaccttagtgcttgttcctttctcttcggttaaaaaaaaaaaatccaacatagtttccttgaaacatttggaacctgaggttttgtccattttgaaaagaagatgtagagaggtaacgtgtttctcacgaaggcaaaacaaaaaaataagatgccaagcaagtggcccttgtaccttcaagaccaagaaataaggcgtttgtttctgggaatgccttccatttgctcattttgtaagtaatcaaggcaggctgagaggggagccttctgaggcaccccagtgagcagaggtggggtcctgccactggcccctcggctccaaccttgcctcactccaggcgctggggcagagatgtgtggttggcctgtctctggagttcctgtgctgcttaatttgagtagagataaaaggccacaagagaagtcgttttgaagggtttgtgaattataggacttcctttcatgattcagcctgactccaggaagtgcagtcacgtgctgccctcctaggggagcttcgccccaccaccagcactcaggctccacttactgcaaaaggcgcgatcaagattcttcttcctgaattattgtcttaacaaaattgatacgtctaaacattgagttaacactttcattcactaaaaatgttttcctgaatgatgcttttcatgtgacttctttatagtcccacgtgaaaaggggaatgtgctcggctctgtgcttgttcccctctgtttgggagcctgcgctgctgctcacttctgcagtcagctctgtttggatcagttttgaaccccagaaccttccacatagaggtgataattctagataattctagagcaactgcttctctatctggctgtatgctaagctctctagagagctttacaagggagagattctgagtgttagggctgggaaaagagcactctgtgtgatcctaacctgcagctgaaatgcagaaccactgttctcagctggagcttttcattgttttttgtttgtttgttttgttttgttttgttttgcttgtgaattgagcttactaatggaagcaggagcttgttctgtttagcgatcgtgagaaccacctaggcagcggagcctgcccttagaatctgcttcactgggctgtactgggctgggcattggcagttttaggacacatctagatgtgtcccaagcaatctgatattttgatgtttatcttacagagaagcatgtgtttagaaggcagatagctgtgcttctgttcttctgattttcgacagagacatcagaaccttccacagtcattttagtctaagtcctgaaatcgttcactgccagccctgagtctagctggactatatgcctctggttggacacgtctgccacctctgagaactgtgtggatgtaactcttctgtcttctggctcgttgtgtttccaaggagaagcttgaggcccagtaatacttaaaaattttttggacaaatttaatcttacataattatggggtacacagtgatattatatctgtacaaggtggaagggttgaatcaagccaattaacatacccatcatcataaatgcttatcattaatcctcctctctatctgcaactttgtagtctttgactgtcatctccttattccatcactccccagcccctggtaaccactattttgttctctgtttctatgagttcaatcattttagattccacatatgagtgagatcatgaggtatttgtttttctgtgcttgacttatttcactttacataactttctccagcttcttctatgttatcacaaacaataggatttccttctttttcatggctgaatagtattccattgtgtgtgtgccacattttccttagccgtttattccttggtggacttttaagttgattttgtatcttggctattgcgaatagtgctgcagtgaagcatgggagtacagatatcttttcaacataaatttgtaaactttcttaaaacattatgagttttttgttttgttttgttttgttttttgcaattttttgtttttggctcatcagctatcattagtgttagtatattttatgtgtggctcaagacaattcttcttcttccagtgtggcccaggaaagccaaaagattgcacatccctgctctagaggttcctggataagatgctcttttaacccctgtagacaagactttttttatttctggaaattttataactttaaacatgtgttttactcctttattttaattctctatttcagggacattaattttatatattttagatcacccctgtctttctcaatttttctgttgaattcctgaagtctttgttaattcctatttcatttttctcaagctccacagatcctgtcccccatgctgcctgcagtgttaatatccattcatttttccctgcttgatataatagccaacatttcttttctggccttttctcctgatctctgctggcttatcattgttttttgttttttgttttttggccccttcctcccttttgagctgttattttaaccaagtgattattctgttaagttctttgattccatatctgtgtgtgtggacatgccttcatctgccttttgggacatttttctcatgaaagtcctttgccatttgtttctcctgttacttctcttctttaattatttcagcatcattgtacaaatccaaggtaggatcctcatctttgaaatagatcatggaagggccttggatgtgttccagtttaccagaatatttcctcccttctcaataatgttgtgtgtgtgtgtgtgtgtgtgtgtgtgtgtgtgtgtgagagagagagagagagagagagagagggtgaaagagagagaatgaattggtttaatacatatttctccccagtgaggctgccagccattcagtctcctctcttcaacactctaagaaatggttggctttccattgctgtgtatatccttccactctgcaggccttgtctgaagtctacagcagccagtccccactaagggtcttcatgatcccagggcaaacatagctgcattgggctccgcttgtggcatgttattgctcaggatcggggtgcccactggttccattttatttctttatctggttcttgttgcagggtcatttcagagaggagggggcagtatctctgccaacacccaagcaatctgatattttgatgtttatcttacagagtgacttagagtatgtggcattgaaaccaatggttaaaaatcaacaaataagcaggaaacaacttcagaatgaccaaaaaagttcctggggcactcttagcttccaccagcctctctgatggtcaaccaggccattttgttggctttgatccgttcagcacattgagttatggggcgcctcccacgtgtcaggagcagggtgaggtatgggggctgtcgcagcagctgagatgcttccctgcacttgacttgtttacggtcagatcgtaaggaagcatgggagcccagcatcaggctctgctcatgcataatctcatttattagtgacagcaaccatagggtttttctttgtgaaaaaaattataaaatacagaacagtgcagtaccacccaaattaataaatgttgttattttaccatttatgcctttatttttcctaaaagaacagtcccaataaagtggaagctataaccttttatggatgaggaagtggagagtaatctgctcaaggctggctagctggtgagcagcaggcctggctcaggcccctctggtgcccctgatttaggcttcatggccttctctaccctgcaggaattatgctggctcagctgtgcaggttggcgactgcaaatatcaacccctctaataggaaaccaggcagatttttctcatgctatcagctgatttttggtatatgtaaataaaacctatgtttttgagagtagcaggaaacattttgttagaaaaccaaatgaatacagggagatatggctatcaggagctgagactgatattataattttccaagtactagtatctgtgtattgatttttacagtaatttgtactttcccatccagcttgtttgtgaccactgaggcccttggtgaatatcttagaagtcactcaaaatggataaagaatgaatgtgagtcacccatagcagtcttatgtgagataatatatggttgatcctcagtattcatggcttctgaatttgtgaatttgcctactcacaatcacagtcatttatctgtaatccccaaatcaataaccatgatgctttcaagaccatttgaggtcatacacacagtgtattagttcattttcccactgctgataaagacatgcccaagactgggaagaaaaagaggtttaattggaattacagttccacatggctggggaggcctcagaatcatggcaggaggtgaaaggcacttcttacatggtggcagcaagagaaaatgaggaagaagcagaagaggaaacccctgataaatccatgagatcttgtaagacttaatcactattacaagaatagcatggaaaagactggcccccatgattcaattaccccccttccttgggtccctcccataacatgtgggaattctgggaggtacaattcaagttgagatttgggtggggacacagccaaatcatatcacccacccctggccccttcaaatctcatgtcctcaaatttcaaaaccaatcatgccttcccaatagtcccccaaagtcttaactcatttcagcattaacccaaaagtccacagtccaagtttcatctgagacaaggcaagtcccttccatctctgagcctgtaaaatcaaaagcaagctagttacttcctagatacaatgggggtacaggtattgggtaaatacacccattccaactgggagaaattgtccaaaacaaagaggttacagggccaatgcaagctgaaatccagcagtgcagtcaatttttaagctccaagatgatctcctttgactccaggtcacacagccaggtcccattgatgcaagagatgggttcccatggtcttggacagcttcatccctgtggctttgcagtgtacagcctccctcatggctgctttcacaggttggcattgagtgtctgtggcttttccaggcacatggtgcaagctgtcagtggatctaccattctgaggtctgtaggatggtgaccctctactcacggctccactaggcagtgccccagtagggactctgtgtgggagctgtgaccccacatttcccttctgtgctgtcctagcagaggttatccatgagggccctgcccctgcagcgaacttttgcctggtcatccaggcattttcatacatcttctgaagtctaggcagaggttcccaaacctcaattcttgacttctgtgcactcgcaggctcaacaccacgtggaagctgccaaagcttggggctttcaccctctgaagccacagcctgagctctacggtggcccctttcagccacagctggagcagctgggacacagggcaccaagtccctaggctgcacactgcatgaggaccctgggcccaggccacgaaaccactttttcctcctgggcctccaggtctgtgataggagggactgctgtggaggtctctgacatggcctggagacatcttccccatggtcttggggattaacattaggctcattgctacttatgcaaatttctgcagctgagttgaatttctccccagaaaatggatatttcttttctattacatagtcaggctgcaaattttccaaacttttatgctctttttttttttttaataaaactgaatgactttaacagtccccaagtcacctcttgaatgctttgcctgcttagaaatttcttctgccagataccctaaatcatcgctctcaagttcaaagtttcacagatctctagggcaggggcaaaatgctaccaatctctttgctaaaacataacaagagtcacctttactccagttcctaacaagtttctcatctccatctgagactgcctcagcctggaccttattgttaatatcgttattagcatttttgtcaaaaccattcaacaagtctctaggaggttccaaactttcccacattttcctgtcttcttctgaaccctccaaactgttccagcctctgcctgttacccagttccaaagtcacttccacattttggagtatcttttcagcaacaccccactcttctggtaccaatttactgtatttgtttattttcacattgctgataaagacatatctaagactgggaagaaaaagagacagttccacatggctgggaggccccagaatcatggagggaggtgaaaggcacttcttatatggcagcagcaagagaaaatgaggaagaagcaaaagtggaaacccctgataaacccattagatctcatgagacttattcactaccatgagaatagcatgggaaagactggccccagtaattcaattacctccccgtgggtccctctcacaacatgtgggaattctgggagatacaattcaagttgagatttgggtgaggacacagccaaaccatatcacagagtggcacaaaattttagccacatgcatattccagacgctccaactcctcctttcacctcatattataagtaagtgtctttttccccagtctacttagtgccgtattttttgcatttttgttccttttttcaaattgtggtgactttgctgtttagagtacccccagctgaagtgctatctggtgtccctaggtgtaagaaggctgtgctgtgccttacagggaaaatatgtgggttagagaagcctctgtcaggcatgagtcatagttagtgctgtcggccgtgagtccaatggtagtgcatcaacaatagatatgaaataaggtgcctttacacagaaacacataaaacaagtgatgcattgatcagttgatgaaaatatggtgacggcaggctctcaggcacataacccctgagaagcgatgggctactacttgctaattcagttttgggggtgactttgtggaatgtataacctgaaataatgagaataaactatattctacttcttttacaaagcaaggaaataatttttaaaagcaagttaaattttactgtttttgtaagagatatgttttcgaaacagttgaactgttttataacacagagaaagtctctttgccttacattttatattagttaattaagtcagcagatttttcttgggctcctgtgatgtgactggcactgttttggtaccaaaagggcattgcaaaaaaagtccagaagtagacagatcacagccttcaggattaaaagcagtctcatcaatgtgatatttcgtttaaacttagtagcaagcccattgaattctcaaaatgagaatctgctaattatcacacacttttcttatgaaagaataatttttcatagtcaatatttctaaaatataatgtctctttctcattagcagagaccgattgtatggcagatttacttgcacctgcggatgctggagataggtgatgatttagtatagtgcacatccaccaggcggtcctcctgggtcccaatatttaggcccacaggatgagtccaggtgatattgggcacaggctcactcagaggctatcagacagaaagctctgcctcactgcacagcagcttcaagcattgccttcagtgggagtcttacttgcagtccacacagctcaggtacaaggcccctgaggtccacacctggagctaatcatctctttgaataacactgtagacatagctaccagaaaataaaagaaatagaaaggcatgattaatacaagcctcactaggttcttattgtgaagatctgagaaagagctcctcatggccctggcatgggagggaagagtgataactgtaaaatacccctaggctttctccatgacaatggttactctccaagggaaaacactttgcaagagccttgtctcagctgggaattcccaagggaattcctcaagttccagcaccctcatcactttatcacttaaaggacaaaaaactcatagtcaacaggggtcagcgcttcaaggaaattgttacagaatggtaaaggggtcgaatatccaagaagacataacaatcctaaatgtgtatgtgcataacaacagagcatcaaaatatgcaagacaaacactggtaagactgaaaggagaagtagacaaatcctgtcttatagttagagattttaatctctttctcacaaaagttgatagaccaaatagataggataaaaatgacctaagcagtactgtcactcaacttgatctaattgacatttataaaatattccattcaacaacagaaaaatacacattcttctcaagctcacttggaatattcaccaagatagagcacattcttggaaaacatgttaacacatttgaaagactaaacgtcataccaattatgttctcagaacacagtataattaaactagatatcaacaacaaaaagatggaggttttgggaaatttcccaaatatctggaaatcaaacaacagacttctatataacctatgtttccaagaagaagtctccaaaatctaaaaaaatattttgaagtgcataaaaataaaaatataatttatcaaaaattttggaatgtagcaaaagcagtgcttatagagaaatttatagaactaagtgcacacattaggtaaaaaatatataaagaaaattacttgtgattctacttttaagaaactacagaaagaagagcaaattaggcctaaaccaagcaaaagaaaagaaataattaaaatgaaagcagaaatcattgaaattaaaaacaggaaaacagtagagaaaagtcaataaaaccaatgttggttctttgaaatcatcaaccaaattgataaacctttaaccaagaaaaaaaaaagaaaaaaatgtagaagatgcaatttaccaatatcagaaatgaaggaaaggtcataactgttgatctaatggatataaaaagatgataaaggaagatcatgaacaactctgtactcacaaatgtggtaacttaggtgaaataaactaatgcttgagtgacacaaactactaaaacttacagaagaaataggtagcctgaatagccctatatctttaaaatttaaattaatataacctttaaaacagaaatcatcaggcccagatgggtccactagtgaattctgtcaaacacttaagaaagaaagaataccagttttccataatctcttccagaaaatagaaatggaggaaacagtttctaattcattttatgagttcagatttcacgtaataccaaaaccagttaaggcattacaagaaaacaaagcaatattacttatatatacaaaaaccctcaacaaaatgttagaaaatcaaacccaacaacgtatgaaaagagctatgtaccacagccaagtggaatttattccaggtatgcaaaacaggttcaacatttgaaaataaattaatgtgatacatcacatcaatgggctagagaagaaaaatcatatgaccatgttaatggaggcagaaagggcatttgacaaactcaaaacactctttcatgtcaaaaaaaaaatcttaaactaggaatagaggaaaacttttgtaacttgataaagagcattaaaaaaaaaaacctacaggtaacatcatacttaatggtgagagactgaacactgtccctctgatactgaaaacaaggtaagactgtcctctcttaccactctgttcaacatcctactgggagccctagctagtgcaagaaaacaaaacaaaacttatacagatcagaaaagaagaaataagacatcttttttcacagataatatgcatgtccatatggagaacttcaaagaatccataaaacaactctaataaccaataagtgagtctacaggatgctagatcaatatacaaaagtcggttgctttcctatataccagtagttaactattgaaatttgaaataagaataattaccatgtataatagcaccaaaaagacaaaaaaaaaaaaacacaagaaaatacttaggtataaatctaacaaaatatgtacaggatctgtatgcagaaaactacaaaataatgatggaagaatcaaagaagatgtaagtaaatggaaaagtagtccatgttcgtacattggaagactcaatgttgttaaaatgttcattctgccaagcttgatctgtagattcaacccaatcccaatcaaaatcccagcaagctgttttgtagctaatgatgaaatgattctgaactttacttgggaaggtaaaagatctagaatacccaacacaatacccactaaaaaggacaaagttggaggactcacactactcaatttcaagtcttactagaaacagatacaatttctgcccttatgggacaaacagacattcatcaaaaattcacatgctagaaagtaaaggtaaattaagtcaaaacagtggtcagtggtacaaaaggaaagcatgttagttttgactgtggggacagggacatgtttatcctgagctcaaagggtagcctggacagtggaggatttttagcagagaaaagggccacagcttagaacatgtaggaagggagcaaggtgggggcactgacagccagagctactcaaaagagatgtggaggaaaaggatgttatgtggttttggagacaagtaggcatgtgtgggaggctgagacgtgagatgggagggattggcaaggggttgactttcagcagtgtagagaagggaatgatctaagagagcttggattttcatcttcataaatggatggagctcttgggccaaggttctcaaacttgagcctttaaaatacaaaacctagagcttcaccccagagtttctgatttggcaggtcagggtggaaccctaagaattttcatatcctccatgtttcctggtgatgctgacattgctggtccagagacgcacattgagaacccagctccagggaacaagaaggagctccaagttaggcaggaaagccccaagcttacatttggatgggttgactatgagggcctttgcactgccacctgaagatggtagctaagagaagaggcaggcttcaaatattggctccaccacatactgtgtgttcttcagcaagccagttgaccctcctgaggctcgatgaccaggtctgtgaattgaggataacaatagtatctaccattagggatgttgtgcacatcagttgataacctttgagtcaagtactcatggaatagctgttttgcattatcctcatcaccttcatcatcatggccattctggccagcactaaagatgtacagccaacctcttctgtggctgaagtttatcttctataaaatgagaacttgtttttcatgaagctgtcattttcacaagtttggggtgcaggtgcagattgcctactgttgtgtttctgaacacttccctcgcgaggctcctaaccccaccccagtaaactcatcaacatgactccttccagcttctacagctctggagagggttcctttttatcttgcgtttccagggatgtttcacggccttttgtggagtgggccctggctgagcttctggcccttcttgagtgtggaggatgtcacagactgcagtgggaaattaaaaagctgcttgcttcacagagtaagggaatgttagtagatgcttgaaaagtaccctgagggagctggtcagaggtgctctgtaaagttgcatctgttgctagcaccatgagcagctgtctgaccaggaggcctgggaacagggacagagagagctggcacccttctttcctctgccctacacattggcctttccgccattaagaccatctctgcttgactttttcagtctcctggctggcaattagcatcttgaggtctccattaagatcttttcaaggatgctcttcctatttggttcaatcttctggttgaatttgatacatgttatgatgtaggactttttaaaaaaacataaaacaatcaggaaaacctcgctatacccattccagcaattcaagaccaagttcatttttggtaaaaacacttgggaaagggcatttccaggctggctaagcactaaatggcacagccctgtccactgactccctcctcaactggtgtgtgttctggagggatccatgtctcagagcattacttcattttgaatgtgcaattaaaagaggccccgtgctgctggggatctcacacttctgctttctggtttgttttgcatgctgacactttgaggaaaagcccatttccctaattacagacatcgtccagcagcaggaagcactctggcttgttgatgcctgtcttgtgctttctctctgtttcagctgttttccttttaagatactcctctcagatttgtgtgcttcttcccttcccacattctatactgcccagcgcctgggattccagatctgcgtttgaatccaggaaagggaggtaggtcaaatttgtgggaatcaagcatatttagaaaccctaacctcaggctctgcgcatctgtgggtgtctgtaggagggatacttaggtttcatgcctgcatctgcgtttcctctcctctgccgctaacattcttccactgagcacatgtccatcttgagctggaaggtttagcggtttgccatcttgtcttgcctgcagttatgatgcagctaaagcatccttctctccttcctataacctatgccactttgctttaagcattgagtatatttatgtctcaggtttatgaaagacaattataaaatctcaggagaccatcataagctcctgtaatatcttgcagtcctgagtcacccacaattattttttaactggctaggaaaaagaatgctagcgattttttttaaatagacattcagtaaaactctagatatttcttaatccacatttactgtgtcctttttgcttaagtcaggtgttttggtttctctagcagctgcaggatccccataaagattatgctcataaggtagtgatggaaaagtaaaatagagcctgaaagcgggaaacttcagcaaggcactaaggcacagacaagagatgttaggtctgccggctgttgtcattgcagtctgctgtggcctcacccccgcccccccccccgccccgcccaggccttcacagctgagtaggaaaggatcttgggatgggtaccagggcaggatcaaggaaagcctgcaactgcgctgcccttctcatcatccatatgtggtttgcccagataaaagcaatatagtaagatctatcaggcatattcaacgtgagttcttttttctagcatcttgttggttgtttgtgtttttccccagagaagagtgagtgatgaggtggccctgggacatggtagatggtgcagttcactggggagacatccttggccccactcagggtcaatatgcgccccacaccgctggctgcaaccccaccctgtcctcttctgctcaaaagagcatgcaagggacattgctaagtggcaattttggttgcaacccagtgttctgttaattattcacaaaagctagctctctttttaattaccaattgtgtgtgcgttgcgtgtgcgtcccttcccccttctctgagcacacctgtatgatgaggcatgtacttcttcctggtggagaagaactgcagagatgtctcccaggttgagcctgcagcctggcccggtcaccagcacagcacggtgacttgactgtcctccctggctcccttccccacccgtggcaagtggcaacttgctttcgctcacactgaacgtggtcaacttgcctccctgtcacactgtagcacttgaatagggcaatattagattatagcagaggttctcagacattagagtgcttaaaaatcacctgggaagcaggccaggcgcagaggctcacgcctgtaatcccaacactttgggatgccgaggtgggcggatcatgaggtcaggagtttgacaccagcctggccaacatagtgaaaccctgtctctactaaaaatacaaaaaattagctgggtgtggtggtgtgcgctgtagtcccagctactcaggaggctgaggcaggagaattgcttgaacccaggaggcagacgttgcagtgagtggagatcgtgccattgcactccagctggggtgacagaataagactccgtctcaaaaaaaaaaaaaaatcacctaggaagctgtttaaaatttacccttcttgtccgtatgccctatttgctgggtctgaggtgggcccagaaccctgctttccagaagggagcctgagggtggggtgccctgaagaccacactcaggaagaaccggacatgtgagctttcatgagccagagtcctgccaagaactagaatctgcaggtggctttggccagtcccacttagaggcaagaagacgtgaggatagtagagaacctggaaatcacgcagtccccaggatgaaagtggaactctcggaccagatccttattctcttactttcgtgagccatttctgcctacctgttgtcagggaggcaggaggttcatttttctctcacatggtgcctgacataatgacttgcacgtgatagatgctcaacaagcatattgaatgaatcaatcagttagattgtaaattaaatgcaccagatgggctggttgtttatttataactacacagttaacatttatattaacataatgttaacaccaaagcgtaatatctgttttctgtgttaattatggcaaggtgggcatagagaagagatttctgagtgtcttttgcagagcttgaaaatgtctatgtgttggttgagatagatcagcctttacttgatgcactttcaatcttttaagttctgaaggcacagcaagagaatttggtgttgaaggtttggataatgttttcaagtatttcaatatccctctatttctaaacattagtaaaaatcatgcctcatgctaccatccttagcttcactttgtgtttctgaattgtgtatctctatatactaagaagtcccccatgtatgcctgcaaatatgggagagtcaaccgctcagcagaatgtgcacaatgtaaggctgtgccttggagaccaggcaccctgtgcagtgtgatgcacaggcaggcctcaggatggcgccgtggagggcaagtgatacctactgacgaagccagtggagtggatgcaaggccaactcaggccctgcagctggggttctgttcctcagtgttgaggccacaggtctgtgtccacatgttttcttttgtacagtgggattctgccgcacaaggcagtgcccccagccctttgcagatgagtcaaacatgcttgtttgcagagcctggtgctgggtggggtggtcccatcacatcacctcttccttggtcatttctctgtaattaatcagccagtccctgaccaaaccagcaagatcaattctccctctggttggactcattcctcttttttttttttttttttttttgagatggagtctcgctctgtcgcccaggctggagtgcagtggcatgatttctgctcactgcaaactccgcctcccaggttcatgccattctcctgcctcagcctcccaagtagctgggactacaggcgcccaccaccacgcctggctaattttttgtatttttagtagagacggggtttcaccctgttagccaggatggtctcaatctcctgaccttgtgatccacccgcctcagcctcccaaagtgctgggattacaagcgtgagccaccacacccggcctcctctttcttatgaaaattaacccacagatgaagtttcctttcacccaagtcttgacaattttctcagcttcaagctgcagaggaaattcctaggcacatcttaacagggctgctttgcattgagggggctgtgtggtttgagcgtgataagcctggatatctttctgcactatgctgatttttgttcccttaaatggtatggatttggcaacaattgtttgcaggtgatcttttcccagagaaccacttatttcccccactgtctctgtatgataggagggctctaatggcccagggatgtgaaagtgagacaccttcaatcgctaaggactgctggaaatgtgaactacaggaagttgagggggctggaggggaggaggcagcacctgccggagccatgcttcagtgggtctcaagaaaagcagaagcctggaatctcagggctgaggccccttgataactaggacagatgggttaataaaaagggatacagagacataggctacctcttctggttcaatgccaagctagaaaatcctgaaatgaacacagatttatgagataggagtaatatatttaagaacacagtcttacatagagataactattttcccaaaacatccaaggtaaatttatatatctttatggatgaggttgggtcttttcagggaaggttggggagacggaagggaaattacttattatcagtcctcatgattcatggattccatatctccgcattcatctattcatttaaatctgtttgcaaccccaaaatcaatactcacagcacttttgcagtcatttgtgacgtgcacaaagcagtgaaaaatttaagtcacccaacacatacgttgaggtcgcacaaggtgacactctgctttcttgttttagctcttataaacacattttcttttctcttggcccatttagtccatggtttttgcatttttgtgcttttctggggtgattttgctatttaaaaatggccccaaacacaatgctaaagtacttactgtctggtgtctctaagtgcaagaaggttgtgatgtgctttacagagaaaatacgtgtgttagggaagctactttcaggcatgagttattgtgctgttgaccatgagttcaaggttaatgaatcaacaatatatatgaaataaatatctttaaatagaaatacacataaaacaaggttctgtattgattgattgacaaaaaagttgtaaccagaggatcacaaaaacctaacaccatatttccccaggagcaactgttcaggatttgcaaattcagctttcatggtgattttatagagcataactattgtgaataacaagaagcaactgtattttgtttcatgcataagatggaaagagaacagaaccagaagtatgatatcgatgaaatggagagaggagaaagaaaagaaagaaatgacactatgaagatttattagttaaaatgttactagtgataataaattaatcagaactttggcctctgcctttgatcctggttcccataatctctaagtgccaggctcagataatgtggcccttgcagggtttgggcagctagtcctctaaccattttctacaggtaaacgtggacatgaaagaagccagggtgaggcaggcagcttccagaagcacacactgggctcagctccttccttcctaacctctattttagctccacgtacctcttcaataccagaaagtcttcttctgattctgccagagcccagctcctagaacctagctcatacactcaccagccttttttgtcaacaattcattcaaatatttatttacttaaatatccattaagcactgttgcttctctcgcccaactccattgcacatgctatatcagttatctgttgctacataacagatcactctaaacttagtggtttaaaacaacaataattacttattattgctcataatttctgtgggccaagcatttgagatagctgggtaggctcaggccctctgtagggttgtagtcaggtgtgggccagggctacagtctcatctgaaggcttgatagaggctggaagatactattccaaggtggctgctcatacggctggtcacttactgctggctattggctagaggcctcagttccttaccacatgagcctccccaaagagctacttgagcatctttccaatgaggcatctggtttccccagagtgagcaatccaaaagctgaggaaaagtgttaagggctttcatgagctagcttcagagacccaacattgtcactctgcagtcagccactctgtgtgcaagggatgggagtaccaggaagtgaggatcactgggcaccatcttggaggctgcctgccatgtatacattttaactctcaaacaaaatttgaagactgaagacccatacttaaagtagcctctgttccaggcagtagagaacaaaatgtaaacgtacttacactaatggagtgtctattctagtggctttggggaatatagacaaaaaaacagaactaaaactctaaggtgggacagggagctgggagtgttagtgtcaggtgggcctatagagctcagccccccttcatcatgttggcattcatgctggctgttcctctgtaggggatgaaattttcccctgccagaagaatgggctctggacagcttgttcagctgcttgctcaggtgtgagcatctgtgcctaatcttccagtcagactgccctagaaacatcatttcttaattagctgaaagggtatctgaaacattgtacttatggtggcaagcatggatctattgctcttcatctataaagttgctgcctgataaggtagaactacacaaatgatagtttcccaactaaatgcattttaaagggcaaaggttgtatagtcagctttagtcctggcataggggaaatggactatggaagtctagttggaagagaagattgaaacatgccagtaagtgcaaaaggatacagtataatttaaataaaacacatggaagacatgaggatgctagtgggatatgatgggctcatccatttctgcaggctccaggagggtggctggcagggcttctttggtgtggggcagaaagaatcaaagcctgtagaataaatctgactccgttctagatttaactcctcatggtgtatcacgtgcaaggtgaagcctgactggcactagggaggattttgaggtaaggaagcattgtctttggttcagtccaagccctcactgactttccaccatcttcaggtgggggtgggcatgtccgtctgtctcccagcctcatgcacacacatgtgtgcacacacatgcacacacatgcatgccttcttatgaagtgtgggtctggctgcccgtgctttttccttcatctcaccatgacttatccttccctcttctattcaaagttcccacttgagagggtccagttgccctgggcacccctccacactccccactcatgactgaaattagttacagtggctttggtatactgtcatcccctttcaccagtgaagaactctattgctatagtgcccaggtcacacaaagctgggccgggtcgccagcgttcccgattctcacctctgtgtccctgggtttcctgctctctggcccagtggaaccacctccacggggtaccattcctttccagccttgtcttttgttcattggcaatgatgttaacaaattaaataggggaatatttgttcatctaatttattggtaaaaaggctagaacaagcttatccaacccatgacccataggccacatgtggtccaggatagctatgaatgtggcccaactaaaatttgtaagctttcttagaacattatgagatttctttcccttcttttctgtagttcatcagctatcattagtattagtatattttatatgtggcccaagacaatccttcttttatcagtgtggcccagggaagccaaaagattggacacccctgggctagagcaataaaatgggcacatcagatttgtgtccacaacagctgacacagtggtttccagtcaggggtaagttacccttagggaacacttggcaatatctggagacgatgtttggctgtcatgattggggaatggggtgctactggcatctagtggggagaggccagggatgctgctcaatagtctgtactagatgagacagcccccgaccctacacacataacagagaaggatccagcccaaatgtcaagagtgccaaggttgagtaaccccgagctaatgtgatgaatggtgccagatggaaatgggtgggaccatcataaggagggggaacagggtaaaggcaaccatcttaatttgtaaattgagtgtgggggatgtgttttgaccacatgcttttgaaaagggaagctgttcattctccagaagcccagcggagatgttggatggatggggccacccatagctgcattcatggacagctggacacgggcccaggaaatcttggcagcgtcactggggccggtgcacttttaagaggagcttgggtgatatgaaattgtttggacaaaatgagtgagaggtcttgaaataatgtcaaggcaggaagaatgcattgacttggagtggctgccaagagcaagcatttgcaggttgttttggggaagcagaactggctgtgttctctttgtcctgtgcacagttggaagacgggaaatggaggaggagagatggggaaggagagatggggaatcagataagaaagtgttttccaacagaagcatcggcacacattggagtgagttcccttcccttaagaggccaggagcttatgtaggaaccaagctccatctgaagcagccacagggctggagcatctcgcagattagttgccagggttctctgattctggccctgttagcctccatctggacacacagcaattgcatgtttagcatttttattacaaaagcaacatacaattttgacccttgaacgttacaggtttgaaccatgtgggttcacttatatgcggattttttttcaacaaaaatattggaaaaaagttttgaaggtttttgacaattttaaaaacttgcagatgaactccatagcccagaaatataaaaaatgttggccgggcgctgtggctcacgcctctaatcccagcactttgggaggctgaggagggcagatcacgaggtcaggagatcgagatcatcctggctaacaaggtgaaaccccgtctctactaaacatacaaaagttagccaggcgtggtggtgggcacctgtaatcccagctacttgggaggctgaggcaggagaacagcgtgaactggggaggcggagcttgcagtgagccgagattgtgccactgcactccagcctgggcaacagagcgagacttcatctcaaaaaaaaaaaaaaaaagttaagaaaaagttaagtgtatattgaatgcacaaaatatatgtagtctattttttcatttactaccataaaatgtgtacaactctattattaaaattaaaatttatcaaaacttacacataaatacttatatgccattcacagtcgaggaaaatgtaaataaatataaagatgcagtattaaatcataattgcataaaattaactgcagtacacactgtactgctgtaataatttcatagccacttcctgttgctattgtgatgagctcgagagttgcaagtacctgcctaaatcactgtgtgatgctcatcatctctgtgtgagcagttcatctctccagtaaattgcatattgcagtaaaaagtgatctttaataagtgatctcttgcagttctcaagtatttttcataatgtttagtgcaataccgtacaacctgaataacaccatgggtcccatgtgaagggtcacagtgaggctggaagtgctcccaagaagtcatgacattataagaaaaagctgaattgcttgatgaggattgtagatggaggactgtagccatggttgcctgccatttcagatggatgagtcatcttgtaaacagatgacagtaaatttatggtattgataaatacagtacagtattgtaaacatatattctattccttatgattttcttaatgacattttcttctctagcttacctcactataagaatatagtatatgatacatataacatgcaaaatatgtgttaatcagttatttatgttataggtaagccttctggtcaacagtagactattagttaagttttgggggagtcaaaagttacacatgaatttttactacagggtgggtggtcagcatccccacattgttcaagggtcagttgtatattcactgtggaaatcctaaaaagcaaagagcaacatgtttccatcaagcaggattttgccagcctctggttaaaccctgaagcctgagcaaggcagtgaaatctccagacctttggggctcacattttagggaaagggcaggtttgtgttgatgctacaaaggtaatagatgcttttgagaagttaactatgtgcgggggtggccaaggtaggccgaagcagcacctgagactggatcatcatgatgcaactctctgagtaaaggcctgagaaggaggaagccaagcaggaggcaggagaggcctcaacctggaggcagaagcacagtgtggtggagatagtgagcaaggtgaggttgcaggtctcgggcctggtcaaggagagccttgtggaggagcaatgaagatttgcgatgtgatgtggatggagaggttccttgtgagcctcactccaccttcagggtagggaattgtcagtaaggaaaggaaggaccaggtgagacttccaatacctgagagatggcggtggcttccacgagggcagcctcaggagctatggggagacatgatggcttgggaatatattttaaagaaaagctactcagaggacctggagaccagctcatctaacctgcttcaagattctccatccctgtgactgcatcagatggagctcagctcctgcacaagctcatggcttccctgcatcactgtgagtggccaatgcttctggtagaaagcacattcctttctgacttggtgagagggaagactcctgaaagcagccagggtctcatcctcagcaactgtggtgctcaatgtcatttcctcaattaggagagactgagggaggaagagatttgctgagggagtggcaggaggagtcaaaagcctcatctggagtatgtggaggtcaacttgtctgttacacatccaaggggggacgtcagataagcagacatgcagatcaggagctcagtggagagaaataaatacccattaaccaacaaatatttttgatgacttattctgcactaggagctgttccaggcatggtgatatggcagtgaacaaggtcatcctattctcacctcccagagctggccctctggtgggaagaacaagacaatactcaaattcaacagtgaatcatgatttaaagggctgctgccttatggagatgtgctgcagagaaaaattaggcagggaagggaggtatgcggcccaggacattacagaagattatttcatgtcaaaaaacatttttctacaactaagtgcacatttaacttgtgtcacaaaaaaggtctcaaaagagcaagggatttgcagtgttttcaggagctcaccagacacctgaaaaccctccttgctgaaccactacctgcccaggtgttcactgaggtgccagacccagcaggctgaggggtacaggtggagttaaggaggagctaagtggcctggtttgtttctcagtttcgtgctttggaatgaagtagtgtcacacatggaaaaaaataactgggaatgttgaattaagaaaaaatagggagcaagttctaaacactatttggaagaaaatgatccctgggaatgctaaagagaatttgagccatgagctgttcctgtagtcagagttaagcattgtgagttggcaaaagcatcaggcgggaaggactgagtctgtgtgtgcaggaggaatgcctgcaggggaaagtcacgggctccgtccctgtctcagttggtgggggtggcagagatgccacagccgtggccaagactacgctgggtgaaaagtgagactctctggatttgccatactgactgaaagctgatatctgaaaagtggagctgagaacagcagcctgggccactgtgggcagtgactggaatggagatggccatttcctgccaaggtggcctgagaaagaggaggttggagaccaggacaaggccccgggtgggtgccggtgggtgccagtcctgagaaggtatgcacaggaacaccatggacattgtttattcccccaattaagtagcccaaaaatgtgccataagctgtccttgcagtgaaccagtgattctgcccaaaccatcaccaccaacatacccaggtcaactccggcacaggaagtcacatggccagaaaagggccatcagccacatcggtgctgacactgagtgcagcacattcttctgccacctgcttgcgaacatatctgcaatgcaccatcaaagccacacagagtgtccctggcgtgtgcctggaggttgctccgggtctgcagatgctccccaagacccgaccacagcctgtctcacttcctttccattcacttcaatatgggattcatgcccaagtgccagcaccgatgtaatgattagtgacaagccaatgaatttttaaaatagtagctatgttaagatttatatgaattaaaaagtatttgctctcattttatttaaaattttgttcctacaaagttactgtctcagtttgagctgatggtgcagtctgctgttctgcaactacataaaaagtaacctgggccctgcagaggggacacaagcatcggggccaggtacacagtgacaggggtatttgagctgggtctgtaaggatgactgagatggctgggaggaagagctgcacgcctcagcagaaagcacacgtggtgagaacaagaagggaaagccacagcatcccggtgcagtccagtgtggtctgtggactgggcatgttggaataggcaggaagggctgatgtgcgctttgagggaggaccgggcagctggagagggaggcgtcaggaagcaggagggcagaaggtgaggagtgaagggcagcagtggaaaggacagggttacgccaagcagtggtcatggatatgggcagtaaggaacatgcaccaagggcgcctggaaaacgaaccttagagaacgcaagtcctgcggaggactcctgggttcctggctgggacaccgcctgggcagggaaggcagagaagatggagaacctggtctcaggtggcatcagaacccagcatccgcatcaccaggattgcaggagcagcagcgtctcaggccctgggtgtgtcagagcccccaggccacgtggaagtatgagacgtgctgggctgcaggggaaacaatggaaatgaggttggaggcccgagaagacccactgcaggaaaagggtggagtgggggaaaagcaggctgggggcagtggctggcctgcaacaaaagcattgtagaatgcaggcgtgagccaccgcgcccggccaaggcgggcagatcatgaggtcaggagatcgcgaccatcctggctaatgcggtgaaaccccgtctcttctaaaaaaaaaaaaaaaaaaaaaactgtagaaaggggaaagcagtccaaagagaagtatttcttccaagagactcatcagcacactgtgtttccagagatgtctttctgttaacagcattcttagactcaaaagtaaatgtagatatactttaaaaaacaaaaacaccttgctaagagatgaatttttagaaacttgttggacaaagaaaagtcattgatagtcaactgctgtgagaggcaagccaggaaatgatgattaataccctcaaattataataaaacccatgcctcattaggggctcgcccaggagtactgacttgtggatagacaccgtctggggaaaactctgtcgcctgtgtcaggctgatgctcttacattttatagccccttgtaggatagtgcatgttgagaagaagccgcttcacatcatcgtggtgcaggatctgtggtgtggtgtgcttcatgtgtgtgttttgtgtgtgtagtgtgtatgtagtgtagtgttagttgtgtgtactatggtgtgtgtgtggcatgtatgtagtttgtgtgtggtgtgtgtgcagtgtgtgtgatgtgtgtagtgtgcatgtagtgatgtggtgtggtttgtgtgtgtttttatgtgtagtgtgtagtatgtgtgttgcatgtagtgtgttgtgtgtcgtgtgtatgtagtttgtgtgtgtggtgtgtttgcagtgtgtgtgggtgtgtactgtgttatgtgtgtaatgtgtatgtagtttgtgtgctgcacgtagtgtgttgtgtgtactgtgtatgtagtttgtgtatactgtgtgtagtatgtgtgcagtgtgtgtgtagtttgtgtatgacgtgtgcagtgtgtgtaagatgtgtgtagtgtgttgtgtgtgtagtgtgtatgtagtttgtgtgtgtgtggtgtgcgtttagtgcatgtgtggtatgtgtccatatgtgtggcatgcatgtagtgggcatgtagtatgggggtgtatgtgtgtggtgtagtgtgtgtgatgtgtgtagtgtgcatgtagttgtgtggtgtgtttcgtgtgtgttttgtgtgtgtagtgtgtatgtagtgtagcatgtgtttagtatggtgtgtggtgtgtatgtagtttgtgtgtgatatgtgtgtagtatgtgtgatgtgtgtagtgtgtactgtgtgtggtgtgtatgtattttgtgtgtgtggtgtatgtgatgtgtgtagtacatggtgtgtgtagtgtgttatgtgtgtagtgtgttgtatgtggtgtgtatgtagtttgtgtgttgtgtgtgcagtgtgttatgtgtgttgtgtgtgtagtgtgtatgtagtctgtggtgtgtgtgatgtgggtagtgtccgtgtagtacatggtgtgtgtagtgtgtgtggtgtgtgtagtgtgttgtatgtggagtgtatgtagtttttgtgtgttgtgtgtgcagtgtgtgatatgtgtagtgtgttgtgtgtgtggtgtacgtgtagttggtgtgtgtgatgtgtgtagtgtccatgtagtacatggtgtgtgtagtgtgtgtagtgtgttgtatgtggtatgtatgtaatttgtgttgtgtgtgcagtgtgtgttgtttgtagtgtgttgtgtgtgtggtgtgtatgtagtttgtgtgtgtggtgtgtgtgtgatgtgcatagtgtgcgtgtagtgcatggtgtgtgtgtagtgcagctgtggcatgtgttcgtagtgtgtgtggcatgcatgtagtgtccatgtggtatggagtgtgtgtgtgtggtgtagtgtatgtgatgtgtgtggtgtgtggtgtaccgtatgtgatgtgtgtagtgcgcatgtagtcatgtggtgtgtttcatgtgtgttttgtgtgtatgtaacgtagaatttggtgtgtgcggtgtgtttcatgtgtgtggtgtgtatgtagtttgtgtgtatgtgtatgtgtgtggggtagtgtgtgtgatgtgtgttgtgtgcatgcagtggtgtgtttcatgtctgttttgtgtgtgtagcatgtatgtagtgtagcatgtgatgtgtgtagtgtgtttcgtgtgtgtggtatgtatgtagtttgtgtgtttggtgtgtgtgatgtgcatagtgtgcatgtagtacatggtgtgtgtgtagtgcaggtgtggcatgtgttcatagtgtgtgtggcatgcatgtagtgtgcatgtggtatggagagagtgtgtgtgtgtgtgtgtgtgtgtgtgtgtgtgtgtgtgtaccatgagggacatgcgctttgctccctggataaatggatggagtcatgtagataattttccattcacgaccagccccttttggttaaaatgtgcctccttggatacttttggggctggcaatatgtatccttctagtttacaaccatgattgagagggaatactctccatgttaaatatgcattggccgcctttctttttgcttctgaaatgtatttatttactgcaagcagtgtctctcctgtgtcagatgtcctcgtgggctgggaaccggcactatctctttagcacgggccctgcagatgggaagtggcgttgcccaggaagtggtctggagaagcggggagaagacagcctatgggccccaggcctcgggagccagggagggtgtcactcttcatgtctcaggcagtggcttgttgctatcatagccccgggctggaggtgggaaggccttatggtgaccacaagtcacagttccgtgtgggccctcaacgtggcctcacttcacctctggggctcagcaccagcgtgtgactgactgctcgaggcagcgtctcgcagctcaggtgggtgaggtggtggtagcgtcctccttggtaatatcactgtgatgaggagcaaggcttctctaacattgtctggactcaggaggagcagttggtttgttctcatgtagattctgcctcctgtatgctgctgggaccctgagggtcagcccaagagtcctgttttgcaatagcccttctgtttgcttctctttgcggtatgtttatttttagaattctttgtctttccccactccccccaaaaaagaattatttaatttggtcacttccatcaaatgctctgattttagcttagttagaaggcatgctgaaaactgtaatgatgatgtgaacagaaagacaactgtgtgttgggagggccaaagagggaagtgcctttgttcagagatgggagggtttgtctccactttgaaagggtttgagtggttttagcaaacgttccctgccacgtggggtcctcaccaaagttctctgtctctgtcttgcccaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcaggtgggccacagctggtcctgctccctgggcccagggggccctgtgaccccacacagacttcctggctacatgcaacacatgtgcctatgtgccctgtgtgcccaaataacacaaccatctccttaagcatcaattttggccaaaaaatgcctctctctgataagagcctttcctctttcacagccacagctgagagggtgggtccctttgtgccagcagtgtgggtttctccacagcagggaaccactgttacccagtgcaaggagggccttttcagagaggcattgataggtgttgattggtttctgtttatctgacaaggtcctaccatacacactgataggcacttgattttatggcttcctaatatctcttgcagaactttctgtgtcaacactcatatagttgcatcacccgttctttggctatctggtatcacctgctatgcaccacaatttatttaactagtacctattgatggacacatttgctgtttatgaataaacgctgctaacaacattgctctagacctatcgtatactacacttgtatgcaacgtctgcaggataaactttgaaagggttgggattgccacagcaaaggatatgtgtgtttatttttttattttttatttttttgagacagagtcttgctctgtcacccaggctggagtgcagtggcatgatctcagctcaatgcaacctctggctccaaggttcaagcgattctactgcctcagcctcccaagtagctgggattacaggcatgtgccaccacacctggctaatttttgtatttttagtagagatggggtttcaccatgctggccaggctggtctcgaactcctgacctcaagtgaaccatcctccttggcctcccaaaatactgggattataagcgtgagccaccgtgcccggccatgttatttttatttatacacttgaaagtacttaagtaatgtgtaaaggtctttctggttttatttactgaatgaatgagtgaataagttttgatcctgttttaccatgccaggactcgagatagattggaaatgccttctgcatcattttcatttttcctcggtatggtttactctgctttgctctccatgtggcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgtgagtatcgtgccttccccctcacctcctgccaccaggcctgtgtggacaattgggaataattcagcttccttgtgactggccccacatgaccctgggaagaggccatgcattgccatttgacaacatgcatgctggcctgttctaaagacatttctaaccaaagctatcacttgtgacccagtgtttattttgcccagtctaactctaaaatgaacactctttttgggcaccgagggatgtaatatttaaagaaaatgtgattcagccccatattctccttttaatggcaaattataggttgcatagcacattctgtggttatccaactaaaattaaaatactgcagtttttttactcaaactacccccttgatctcagactttacttctattttacatgaaacaagatgccaacaggaaagatgttaaggaaaagttcctgggagtagcatccatgagtggtgagtgcaggtttgaagacttcagccttaggcccacagtcattagagggtctgtctgaatcctgggttctgtttgctatcctcagtggttcagtgtaaatctaaattgtagaaggttctgagatacaggccaacgtggtcagtcagttgtccagagaaggtaaagaactgtctttgggaggtgtcaaccttgttccctcgagggggtctggtcaaggtggctcagtggggcagttgtccctgggggaaatgatcccctggtcacctctcagtgtccctacagagatgcttaccttggaaacataaccagaaacagcgatgcagcctcatggtttggcaattggtgaatccccagccgacttcgtaaacttttcctagatttagaagcgttttctctgcctgtccatctattcaaaggaatttcctcagacttcactgtcataccttgtattttaaaaatgatcttagctgagtgcagtggcacgcacctgtagtcccagctactcctggcaggaggatcgcttcatcctcactatgatctcactatcgtttgaggctagtttgagaccagcctgggcaacatagtgaggccctgtctcaaaaaaagaaaaaaagaaaagaaaaattgaccacaatactcttaaaaaaaaaaaaaaaaaaggaagaaggaagagtggcccaggttgccacgcggcagtgcctagagtgatggtctttagtgggatgcagccccagccagcagcagaatgctgtggggagggaagacattgcccctcagtggaggcacctatggctatttttgctgaggtttggcttcttaccatctcagcaataatttccaacatgaatgtcatgggaccatgcacatagcatcttggcatgtgaagtcaacccaaaatagcataatccacacgatgaggctggccaacttctgctggttaagaagcctgctcatagcctctttggccacgaagctgtttcttttttcggagttgtctattcccgaaaacagcagttgcatccttcatggccatgacttttgctctctccttcctttctgggagatgtatataaaccccatgcagaaggctgggaggtgcagctcttgtttgatgaacatgccttgttccctatctgccctgtacagactgacatctcatgtgtcctcacagcacatgtccctgacactgaggcttatggtttatgcaagagagtctcaaacttgccgtgcttcctattcagctggtgtcagagctaaccaggcatgggcctgtgagagaggggcctgggcttctgtgttttcatcgagcaccctctccttagttgtcttcttctcctgggttcttattcctgggttcttattctcctgggttcttattccactttatattgcagttgtccagttatcaccccataattgccaacctcccagataatagcttccaaggctttctcccttgtgttgtccacagctcagtcccacaccttcccgtgctccctccacacctgcagggctcacctgtggactgatggtgcatagcaccccatgcccaggcctggcatcaggcagggtattagtgagagggaagagcagagctaagcctgggcagcaagacccagcttcagaacccatgttcccatgatggttgtagaaccttagactaagggaaactttccccaggctctgctcctctgggtctgtgactgtcttgaggattcaatgaaaatacacaccacgtacaccgcacagcacatgtggtcatcactgatgtagcttttcttctctcttcagtgctctttctccatcatgagcaccaggaaagtctccttgtcagggtatcttatggtgtttttaacagagaaagtgtgaggaaacaccttggaggggtttgccacctggcaatttcacctcttgacaacctttcatctcctacagaacctggctggggttcttggctgttgctgggtgtgtaaaccttccttgttgcagtgtagtgggcgtgttatactgtgagtgtttgaatatggttgtgtatgcttgtggagagcagggagagtttgccagcatactggatacagtccaagtctaccatgcttccagcacggggcagggtctgcatccctgaatacaacgtctcccaagtccaggttgcctagacgttggtccagattctttcatctttagaagtgtttgtttgtgtgtttctttcatgggaaatagagctaaaaggctccagggaactcttgtaaaccatcaccagatcctgtggctgccctctcagtgtgagtgcgtcagctcctgattcactgtgggagtctgtcctatattcccctgttgggtcaggccaacgttgcaggaagtcccagacctggttttgaatcatccaaatctgccctacttgcagatagttttataaaatgcacattatttgcaacgaatagccacagcacaaggtctttggagtcagaactagattccagtcactgctggatgtcctcactgagccagctgctgtttttttcccactgttcttctcgggccttcattcagattctcctaacgaatgtgctcatgtctactttccaatcatcatgtcagctaatccatccatggaccaacattactggagtctgtagttgcatgaagcactaagtgccaggcaccattctggactttgggaagggagaagtgaatcagcaagcacctgccctcatggaccctgcatttcagtgggagaaaagacgctgaacaataggaaagaactgcatttaagtaagggcgtagagcacactggggtatggatgctgggtcttctttctgctgcgtggggaggatggaccttgctgtgagggaggccattgagaagaggcctgaaggcagcgaggaaccatccccacccagggaatggcaaattcgaatgccctgtggcaggagcgtgcctggggagcagggcacccacagaggccagtgtcactggcagagagtgagtggagaagggtggagttgagggccaggttgcagagcactcacggcactgggaggaccctgctttgggcaagttgggggggctgtctttaggaagcaaagggccagggccagctgacattcggtgggctctgcctggctgccacatcatcggtttgctgtggggagttgtgcctgtacatatacttgcaaaccaaatgtgttgatttttttatcgtgatttcagggccttcactttctcatgcctgagcatcagtcagtttgtctccgctctgatctcctgtccaccccacccaccgtgcttttacctgggtcctgtacaggcctgtgggctggcccttaagaggttttcaatgaatgcttgtcacctaaatcaatgaattgtttggatccattctccatctcccagctcgtttttgctttccacttcctgacatgtagtaataccactgtagttctgtatgggggcagctccacacctgtctatgttggggagggaatggggattcttgcacctctttctacctcctcttaaatcattactgatggacagatgcagggacacagcaatagatatagaaatataaaaacatgacactgcgcactctatggtttgtaagattcactttctctgggtaggaggcagtgtggcctgttaacaacataccattcgggttgtctggcctcaaatgctggctccaccttatcaccagctatgggaccttgagcaagttactcagtggtctgtttccttcatttctttgtctgtaaaatggctttaatgtcatctctgactcttagagtcattgagggttatagagtatcataaaccgaaggcctgctgcacggtgcttggcaccgaacgaagcagcttcaccccactcctgcagtggcctggaccacacttggatacatcagtaacatacactgaaggtcaggtcctccatgcaaactctttccatccctgcatcacaggtgtaccatgacctctgcaggtgagtcattcttctgcaggtgagaaaaccaggcaggtcccccttatccttcccttctcttcttcagtctgcagtaggtgtgtttatttccactctgtggctatgaatagatagagtgagagtcactggccataaaaggattcacactaggcttttgcttttatgaagtgacagacttaaataaagaataattatttcggccgggcatggtggctcatgcctgtaatcccagcactttgggaggctgaggcgggcaatcacaaggtctagagatcaagaccatcctggccaacatggtgaaaccccatctctactaacagtataaaaattagctgagtatagtggtgtgtgcctgtagtcccagctacttgggaggctgaggcaggagaatctcttgaacccaggaggcggaggttgcagtgagccaagattgtgccactgcactccagcctgggcaacagagcaagactccatctcaaaaaatatatatattattattattattatttcacagagggggttggaagtttatttttgcattgcaagccataaactaatcaagaggattttactagtttggtggataatatgggtaaacaaaatcccagcgattactcttcacactttcatcgtgagtaccaatatgctgtctccaccattcagatgccagcatttcagtctgagaatcgctttacgtggaaagtggcattggtaagaattggactaaaaggtaaaaaaaaaaaaaaaagaattcctgaaatgcatgcacctccatagccatcacaaaatgcctttgctcaaacagaccttgaaaacactgagggtaaggcagcatattttggagatcaaaatctgattataaatcctaggtaatgcagttcaaaatgcagatgatggaagcagattacgtctgggagatgctgtccaactcggatcccagttttctctcctcagaactatatgtgaaatccacttacagtgagagtacacctgagctagagggcatttaccacttaagggggctaaacttattgtttttcaaacaagaactcgggtgtggaggagcttgtccaaggcaggaaggcaaaaccaggtccctgatgttgtctggggctaagcagaaacagcagccagcaaccaaatccatctccagatggatccatctccacaaccacaggcccctccctattccccatgcaagatgcagcaccagggcatgtccatgtgaaatctcagaacacacagaggcgtccatcagctttcccctctcttgtgtcctgtccacagagcttacccacaccattcaggagtgactttgagaaggtagttacagggcctttgcacatgtgcttgaagaataacgaatataaacagaggctctttgtggaggggctgggcagtgtgggtcagtggttgtccctcacagccgcctgtggcatttctggaggtgatgttcatcacctggcctttgctatataagcactgcccttgtctggggtctagctggccagaagcgagcactggagggggagtcctccagcccacgtttggtgggtgagggtcagagtgctgccttgttggtgacgtcagggaccaaggcaagggagaggagctgagtggggaaggagatcccctgcccccagaggccttgtatagcagcacagtttgctattttgagaagctagtcacagctgtctgtgaaaaatgaatttgttaggaaaaggaaacaaagcttactttataaaaattatatatcccttccccaaaagggaggatccaggattgaggggtccgaagcatatacaatttgaagactctcttatttttttaaaaatataaaattaggcatacaatagaatgtattttttggactaaggaaaaaaattcaataaattagaatttttttaaaggctggtcaatactacaagcatacaaactttagaaaagataatgtaatattttaattaactgcctgacacgtctctataacaccttttgtttcctccatgtccttgacttcactgtgtttgactacatcttagttcaacaatatttaataatatatttgtctatatatagaaaaagagactattcattccttcctctaggttcacacttcattattaataatatcatgtacatttttagaatccttgtcaaatttgggaggggaagataaagtagaacagagtgagcttccctggctgtgactaaaatatcttttgcaatctgtacaaaacctaaggccgtgcagtcacattgctgggctcctcttggtctggaggaggctgtgatcaactcctctctgaccctcatccacttggttcacacaatgtggtttattgccattgtgcacagccaattctcccacacacatcgctctgctaaaatgtaatgggatgtggccttcatttcatcttataaatgatcttagaatggaaatgctctaaaaagtccatgccaggcaaaattttaaagatggaagtattgtttctttgtattaagtgtattgtttttggctaagagtccttgtaaatcttacaaagccaagaacaatttcaaggtgacctttaagacacataagtggctgctctccaaatagctcgattaatgttaaaaataaaaggtagtatttcagatttgtggatggagtcgtccaaccagtaagtcaccaatgctattttaactacagtttctaccttctgactttagaaaaaaaagttacaaaaacagtcattcattcaacaaaataggcatgttttcaaccagacatgcagcaggcattgtgataggacttggctactgtgaggaataagtcagaccttagtccctgccctcaccggactttgactgcagggggaagatgacaaacgcaagctgatgtgctgcaaagtctgcaatgcatggcagtaggtcccctccaccacgacactgggcctacgcagcatgatcttgattttgttttcatttacttgtttatagtccccacccccacttgtgctggatgcacaagggcagagatggggctgttgccttcacgagtgcaacccagcacctagaacatggtcttggtgggaaaaatctctctgggtaaaggaacattctggctgctaacttgaatggtggccactacttggataggaggagggacaacatggttcatcgggcctgtctcaggtgcccaggctggactatcatctagtgtgtcgctaactataggaactgggaagtggccttcagagcaagtgggctgactggatttggcagagcttgacacctcaccaggcagatgcaacaaaagagcagggcagacccagccatcccattactgggtatatacccaaaggactataaatcatgctgctataaagacacatgcacacgtatgtttattgcggcactattcacaatagcaaagacttggaaccaacccagatgtccaacaatgatagactggattaagaaaatgtggcacatatacaccatggaatactatgcagccataaaaagtgatgagttcatgtcctttgtagggacacggatgaaattggaaatcatcattctcagtaaactatcgcaaggacaaaaaaacaaacaccgcatgttctcactcataggtgggaactgaacattgagaacacatggacacaggaaggggaacatcacactctggggactgttgtggggtgggaggagcggggagggatagctttaggagatatacctaatgctaaatgacaagttaatgggtgcagcacaccagcatggcacatgtatacatatgtaactaacctgcacattgtgcacatgtaccctaaaacttaaagtataataataataaaataaaataaaataaaaaagaaaaaaaagagagcagggcagcaagagattcacggggtagcatgggtatggtggccagggcaggcctggatgcctgcaggagagggagggaagtgaagcggtggatgccgagtgggtgtgcaggagcccgggcatctacagaaccccagtccgagccccaggaggcagcaccatgtcatggtcacgtggtgccctgagaccattttggtgccctgagattctatggatggtggcagagttttccttgatggtggcagactggccgggtggtggagggattggcacgtggctgccccaggccacaccatgaggtgttgagagagatcctggctgctcagctgccccgagtgtgcagcatggagcaggggcggctgctctgacggctcacagcaggagaggcacctggagagctgggctgtgatcaggcccagtagtttgcagatgtctggagagaaactgagtcagagaggaagcccaggaggttgtgagcctcagcgatctgagaggcatgcatgttgaagagtgagtgaggaggatgggaagcctgcaggcttggtgggtcctaaagttgcaagaacatcactgtcccctgcagctaagtgggcctgatgtactccactcaggccacagttgctgtacatgatctcttgggaccctagaagtgctcctttccatgatagctctttaatacattagttaaaacgattcccaggaagcccttgttccaagtatgcaggatcagataaaaagcgcagaaaccctcagagcagggaccgacggtgagtgcagtttgccctcagaggccttggtagtcaccccttcccaacccccatgccaccactgaatccccatgtggcttgttcttatatgccctgcagctgaaattcaggtgccctcctgaccttccttcccctgtccattttgaaaagaaataagcagtgtaatctttgagtcatcccttttgtactagccaagttccaggtgcagcatgacacactcgttatctccacctctcttctccccttcctttccctcatgtctgcacacactcccatcccctcacttcttccccctacagcccgcctctctctctctcacacacacacatacatacacacacacacacacacacacacacacttgagaaccgcggctgcatatcatctcctgtggacctgtgcacaacctgtggggcccaacttaaagtactgcatccattctccgtggtttatcctaatttaggtttgtttcctggtcatatagaatactgaagtatatgtctttaggaactgtctcaatttcttagagaaatgggatatacgtgaataaaatttttatgattcccttatactgagtcccacttgcactgcaaaggattaataacatctgtttccaaagcaaggcgtcacctgccatgcaagccacctgctggggaggggaggtgaagggtgtgagcattggtgagaggtgttgttctcatgttcaaggtgacaggtatgttatctggtgtccccaggctgggtcccacccagggcctgctcctggacgagggctgtatggctctgatttgcacacccctgattctggtggacacaaccctttttcttagaaagccagaatcactgtatcttctagtccttagctgcataaaaaaatggggtgcaaaacttctctggactgtctattcttattgttcattggtttatcctgcagggccacccatggagcccgtaacttaagatgcacaaatgagctattgagtgaatatgtgtgtgtgtgtgtgtgtgtgggtgtgtgtgagagagagagagagagagagacagacagagaaaaagaaagaaccatctggagggctggcaaaagcacagatgtctgcgttccatcccctgagtttttaattcacaggtctgtgtaaggactcttccatttgcattcctgccaagttctcaaatgatgctgatgctgctggtctggggatatggtgtgagcctgtttgagatacctgttacctacctgggctggattaacaactatgatcatttgagattttcatagttcattggagggtctgtaactgcatttgcagttgcaattcctgcaaaatgcccaaatactgtattattggactggttccgataaagttatctttgaaaatgcctctatttctagaaacttaagttagatagtaaagaaattcaggccatgagtcagacaggccctgccacttaatagctctgtgatttggacaacttaattttgctctctgagcctctgtttcctcagtaataaaatggggagactgatgttttatctgagtcattatggagatgacttaagtaatgtgtataaagctaagccaatggttctcatgtctctgtggttcctacatccatgaattcttttctttcatcagttctgaaaaacatcttgctacttttttcttcaaatattgctctctgttgttcttgcccatttcttccttcagagactcctattaaatacagtttgaccttctcaattcatcctttatattttttattttcccttgccttttctgtgtcctgtgctatgagtaacgtcgttgaattattcttccagcgcactaatttttccttcatttgtgtccaatctgctcttacgctcattcactgattttttttaattacattttttagaaaatttctagcagttctgtttgtttgtttgtttgtttgttttttcaaatatttctggggcatttttagagtatcttattggttgctaatttccatggttccgttttttattttgttaaacatttcatagtttatattctatatctgattattctactaccgaaacttttggaggatgtaaatctctctctctttccctccctaccccttttctcataactcatgcttccttatgttttcagtgatctttctgagcttatgcctgattgatattaatctgtgggaatcctgagtattcgatgctgggaacactttcctccagagttgaaggggatttcctcttcacaggtccttgctttaaggtgggaatcccacatccaggtgctcactgggctgctggcctgagattctgtccctgtccacagctgtgctgatattggcattggccctttggccaaacccactttaattgctctcatttgccactcactttttgctgttcaagtttcaactcactttttgtcctatacttcaatttcaaaagtgaatttgcggcttaggaaaaaccttttccttgttcattgaggaatgagactgtgttaggctgtcacgagcctcctttgccacaacaaaaactctgttccatcagtgctttcatatgctgccgtaattgatcaaagtatgccattttatttgacacatgtggttttgcagacctaggtcatcataaagagtcatgacctgtctgaagttaaaacttcaaagagagttgtgggctgatgtcaatatcacttcattgatgctgatcaaagtctccttgaagctgaaagacaagatgcgttaaataattccaccttcatgaactaaagcagagggagagaatgagagggcgtttgtaataaaatgttttaaacgacaggtgtgttaaaacagcttggtgtggcctcagatagggattgtgtactgatcttgctcttctttgtgtggaatgcacatgtgcctcagtagtgctatggcgcaaggcagaagcactcagaagttgcattatctatatctttcatggatcagtaaagctggcatttctcctgcctcttgctgacatacacactgttcaggacctcattcgctcccacatcctcctcttcccctctcccagctctctttgagaaaccactgttgggagatggctctgagtgagaactgcccacccaacccagcacaggccccctctgtccatctgcccagcccaccttagccacagtgagcattcatcctttgcacatctaatgcacacagccaatcccaggcatcttccttccccttgtatgagtctgacaactgacccggtgatactctactctgccatggaaaaaaaatggcaggggagaatgagaacacctagtgggctggaatgtgcccggcttttctgttccgtctacagcagatacaggcagtgtccccgtagccctggggaggccaccttgagtgcctcactacttcttacatcctcactttccccttggtgcccgggcatcacctctgtatattctctctcccctaggagggtgcaggagagtagaggagtccagcccttccaggccatgccccagcagagtcaacatgcctcacctttggatagtgttctagtgtctgtgaggcacaaggcctgctcaccccagaggccaaggctgcctaccctgggaaagtagacatgccgcaggtcaaggactgtctcaagaccagttaggacagcttctcagcatcatctcaagctcaagccctggaaatctcaggctttgcaatagcaaaacacaaatctgttaacttactcctcccaagacaattactgggaaaaaatattttgtaaatattcaaaggcttctgtgaacagcctgaggccagatgaccctgaaggcggaaggcagcaagccagacaggagccaggagccttgcctgtgtgcacgccctctctgggtgtctgtagagccataagcctgggtgggtgtcctgatgccaccaccagggcaaagctctcagtaagaggacacagccaagaggaggagcaagccttccaaatcagtttgtctcctatgtttaattaaaaatggcctggtccaggatctgcctgcagccaacagatacctcacagttgctggtggttaatgtcgcgagccttctggtctttgccacctacagatgctgggcctgtgggtttcctttctctgctcttgtttcctgccacctgccacagggggctgcccaggccacatgtccatggtcactacctataccttccagttacctgttgccaggactggccagggctgcttggtggagcacaggaagagaggggatcgcctgcagaacctgtcctcttgaagagcctcaaggaagtgaggcctttgcagaaactgcttgttccaaagcaaagggcactctctgtttcctctgggttgctctctatttcctcctggtaccagctctctttttatactgcttttattgtgaaatataaaacaaacacataagagtgcataactaaataggtacaacttaatgaatgattatcaagcaaacacaacccagtcaagaaatgaaatgcacccagcattgcaggagaccactccgccctcacacactcatacccatctgtacagctggcctcctgggaggcaccacctcctgaactcttgtgttcatcacgcccttgctttttttgttatttttcatttgtttgtttttttagttttaccacctaggtgtacatcactagataaaacaggtggcttttgtctgtttggggactttgtgtatatggtagcatggagtgagttttatgtttgtgagactcatctgtgctttgtatagctaccatttgctcattttattgctttagaatacagtattgtgtgaattcctacaatttacttgctctgtggtcacttacgttgtgtgcagtttttgataagcacagatgaagctgctataagtagccttggggtgcatagtgcacacatttcatacacctaggggtggaattgctcattcacgaggtctgtgaatgaataagttcagtttcaggagactgttccaaattgttttccaaagtgggtgagcccatttatgctcccacaagcaacgtaggaggggccttgctgctccccactctcagtagcacttagaatgatctttctaacttccaccagtctgaagagcgtggaatggtacttccctggggtcttcattcatgtttgccagatgcctaatgaggttgatggcatcatctctcagggaaacctgtgcttgtctgtctcagtttttaacaagaaaatgtcaatcaagacatagggtaagatggagtacagcagattggacatggattcagaaaccagagttcagatcccatttattactactatctttttttctggagagatggcgtctcactctgttgcccaggctggagtgccatggtgcagtcttggctcactgcagctttcacctcctgggctcaagtaatcctcctgccttggcctcccaaagtgctaggattacagatgtgtgccactgcacctggttcagatcccatgtattatctccatgaccttgaggtcacagacgtaaaagattaaattataggaaatactttggagtgacatattgtcaccattctttcaaggccaacttttataggcatatgcatccactcttactgctgtagtatttggatagctctctataccctcaaactataagccactgatatgtatagaataaacataaatagtctcactttataagatactttccctataaaacagactcagttctctctttatatgaaaagattaccatgtggttttttgttgtgttgtgttgtgttgtatttaacagtcaccaactgctggctgtagtcggccatgtggctgtgaaaagggagctcacaccttgggcgctggcaactcggttggtttgggaagaagaggttgttctcacagtggggaggtttcagcacagccacctgctgaggccacagagaacctagatatgtgtcctgtaccctggccagctgccctgagctgtggggtgctgtgcatggccaagcaccgctagaaaagacacttattctgaatttcactcctcccatgccatcgttcagctttcaagtcttgggttagctttttgagataagtctccatggcaagggacaggaaagcatggccatgtccagttctgaaggccatctcaactctccctgtggtcgtgtatctgacttcttgcaaccaggaggaggcatcagaaatttccccagtacccagacgtcccaaggcagttgggcacacttgaactctgccccaagtacagtgcatttgggcacgtggcttaacaattttggacctcagcttcctcattttagaaaatgcaggggccaaagaggcttcctgggacttcatgactcaccctcagaacctaagatctcatgaaccaaagggctgcagctgtggagaggggagaatggggcagtgtgtgtgactacgaagctaaactgggggattcgcacccatttcgtgccttttcagcctccactgggacctcgaactccccaagtcccacaggtcttccaggggatctctcacctccccatgagtcataagccttacgtggcatgcactgcagtgggggtgttgttccctgcctggcatcagactcctgtgtttctgttcaccaggacccagggcagggggttgttctgagggtcgcccagcattaccatgaagacagagccttggctgctcagcacggccagcacagctctggtttcacctctgtctcttcaccccacagtggatgtcattttcttctcctgggggtgttacccgacaatatcatcatttgaaactgtttgaagtccagccctgcctccctttcctgcattgggagcttggaagtccagccctgcctccctttcctgcagtgggagagtggaagtccagccctgcctccctttcctgcagtgggagagtggaagtccagccctgcctccctttcctgcagtgggagcatgggagggactgaggaaggcccgggggatggaggcttccataaccctccatctctggtccagaagatggctggttaaaatgcccaccaaacacccccacccacactccaagctaggtggtagagctgtccatcttggatctaacccaaatgcaggccctggtgaagaaaggtgagtccacagtgctccacagataatcagggcccgtggtgcccctgtgctcatcaccctgagaagcgtcactgctactgagcaccaggctctcctgaccactgcccagagctcctgggccctgctagagcttagccatggtccattcatcaccaacctgctagcatttccttgttgcaagcttgcccactggcatcatccctgagtggtaaactgggccttcctgggttgggtaaagcccttgaccctgaggctccaaactctgccctccagctgccttgccaggtgacaggccccagagagcggctgctgaccattcaggccagggtgcttcctcccagggtcccacctggagactggcgggcctggggatgatgcagttccatcctctcttctaggatccgagccagagacaacaacggctcctacgccctgtgcctgctgcacgaagggaaggtgctgcactatcgcatcgacaaagacaagacagggaagctctccatccccgagggaaagaagttcgacacgctctggcaggtacccagcctcctctccccaccttgtgggtagagtacagggcacgtggggctccttgtcccatggactcttagacatgagaggaactggaccacccactgcccacagtgtggtccccaggccagcagtagctctggagctcatgagaaacacacacctggaccacacctgggctcctgccccacctgcccatcagaccccactttcagcctccaggtggcttctgtgtttgagaagcactggtccagaggccgtcatgtgaggtgaacgaaggttccatggcttgttcagggccactcagccctcagtgccacaaggtgatgtaagtgcagggctgtgttcagagtttaacaagacactctctttggagatctagaaaatatttcttcctaggatattctaactagagcccagaacagcctttcagacaaagacacacaaaataaaggaatggatgcctggggaaggaggcctaggaacagccaagcaggactttgttggtggtgtgagaggctgaattagacagcaaatgtcaggtgccctcctcattgtaaatcgagtctctctctgtggaaactaaggcaatttaggaagcatactccctgggctccaggctgctgcttatgctgattgccacagccctggtctaaaaagtgcttattcctgacccagctactagaaaaccctgaaacaactcccaatttggaagttccttaggcactaatgagcactaaaataatgctcatcactgctttccctgaatcgcagtgagcacagattgcttgtcttaattttgcatcacagctacactggctgatgatgaaggaaataaccgtaacagtacttcgtgcatcatcttcgcagagcatcctataaactgtagtaggttcagaaacagggagaaagccaaccgactctgccaccaccccaccgccccagagcaccagctaccttgaacatgtgtgggtgaggggcataatcagggcgtgttccaatgtcctcacccaagcccagctggggccacacatgcagtcaatgttgaggaaaggactcaactcaaaatcctgtcttttcaaaaactgagactacagagccttagcccctttaaagcacttaaacttactacttccaaatgtgatttgctttctagtgctgtaattggaaaaaaaaaatactccttttttgaatgctggatatgatcatattaaaaaatgttagtcacaacatttacattgtcttttgattttgtggctcattgccatttgtcatcattaaccacaggcttctttcttttaacgatattgattcgaaagagtatttaacctttctacactcaaagccccaaagcacatcagggaggtgagtagggaatgtggccttctggaatgcaaaggcacctggagtcctctatgccagcttaatgctccaaggtcccaggccccatcacttataaacagccattcattcaccttctcctgaaagggcattttatgtgtgtggcgttctgtcaccatttcaaaggctgagcactcaccatagtgttaagcatctctaattattgagaatgtccttcccaagaatctttactatttgtattgattcccctggtagatcatagcattcatccctaattaaatattcctcattgtatattttctaggcactgtgtttaggaaactacgtcaaaaatgccagcaatacgttccaatttcccatgcatgatttcattgatttttcttgacagcgttctaaggtacttctgtaccctacccaactccagggccccagtgctatttcacggagagttggtgattgccataataccctatttcaatattctttactgtagaccagggatctgcaaacccacagaccaactctggctctcagcctgtttctgtgtagtccctgaagagaatggtttgtatgctgttaaaggtgttgttttggataaataaataaataaacaaaggacacagatacggtatgaggcccacaaaagcctaaaataccactttctggccctttacagaaaaaatttgctgcccctagcccaagaggggggatccctagctgtgggcccacttccccagccacccttgtggagtggacttaagcacataaaagcatttatgtgtcttggggccacttcgaaagcccaacagtcagtcagtagctctcagtcactatttgtctatttcctgaccttggtatttaccactttcttacttttttctctttcagctagtcgagcattattcttataaagcagatggtttgttaagagttcttactgtcccatgtcaaaaaatcggcacacagggtgagttcccaagacactggagtctcagtgtttgaggtatcagtgacaatcagcctcattttagacttagctgattgcagatttgggttggatgaggacttctttttacgggttgattaataatgatatcagagcactccgattttgtatatcgtgaatcaaaaaatagccagttgctttaactttaaaaaaattgtaatttatttgtcttcattgcatgcgggaaaaagtaaaagagggtcgaaagaagtacctgcagaaagcgtgctcacttctcaagcagcagcacatcctgatctcattgattgatctgcagtggggaggggaaggaagtggtttcctcagatagagcagtaattgtccatgctctctctaaccaggaaatgttaattttggaggccgtccacaacttccaggttcccatcctgcggtaagtgtcactaggaataccactgaatgagaagctgttgcatatttcacaaatgaaaagcatgttttagctaacaggagtagtaggcattgatattttgattgcgcttcaaaacatactccgtgatgagctgggattgctagtgagtgttaggcagaatcagcctcctattagtgataaactaaccacattttcttttctttttttcttttgctttttttttttggagatggagtgtctcactctgtcaccctgactggagtgcactggtgcaatcacggctcactgcaacctctgcctcccagcttcaagccattctcatgcctcagcctcccgagtagctgggattacaggtgcctgccatcacacccggctaatttttgtattttttagtagagacgaggttttgccattttggtcaggctggtctcaaattcctggcctcaagttatcctcctgcttcgacctcccaaagtgcttggattacaggcatgagccaccacactctgcctagccacattttcttaacttcttgtctagatgaaattctcttcatttttggagaatatacacaatgcgaatgaaacccaatattaaatcagaagtaggcctcttgcaatatttgagaaatgggaacatattttttaacttcatccttgagccgtctatgttaacacacgtaattcacaggacctcagctgtctcctccctccagcctgttaggaagtcaggtacagatttatgctctaagcaggaattattttcctgctcttttcttggggctacatatggcctttttttttttttttttttttttttgagacggagtctcgctctgttgcccaggctggagtgcagtggcgcgatctcagctcactgcaagctctgcctcccgggttcacgccattctcctgcctcagcctcgcgagtagctgggactacaggcgcccgccacaacacccggctaatttttttatatttttagtagagatggggtttcaccccgttagccaggatggtctcgatctcctaacctcgtgatctgcccgcctcggcctcccaaagtgctgggattacaggcgtgagccaccgtgcccggcccatatggactttttatgccctttaatgccatctgtgaagtgcgccctctgcacctcactttttgcctggtaacccttgaaaaacaaaatctgcagaaagccaaatatacatcctgcctccagtagggacaattggctgcccagtagctgagcccaggttgaaacaggggaggctgtccaggggcagcacttgttatcaaatgcagggaacgtgaatttgctaaaataccagtgacctttgggatcaaaatgtaatgcctttatggaagtgtgactttattttgccctttacagggctcacaggcctggcaactctatcttaatattataggctcggtgagacagatccatacacccttcagatggatgagggcttagggctgagaactcttaaaagaatgtcaagccctgtgcttagccatcatcacccaatgactacaagaagttagatattttggaataactttttaattgactggtaagatacatacgggaaaaaaaaggcatacgccctatgtgtacaactcaattaatttccacaaaattttccaccgtggaaccagcacccaccatgaagaagcaacacaactgagcactcagatctacttgtagtttctttcggtggtttgtcttgagcttacaacttaataattccacgtgaagcatgagctagtgaatgtaacagctctaattttgtagccttcagtggaacatatttcccaaatatatttctagatccttcttcccaagtggcaggcccttccagaagccttcccaatgatcaggtgttgcccgtggtcgatctcattggcagggacaggagggggttagtggtgcgattatagaagcaaatttaagtagcatgtcgtggaagggatcctgtatttgttttctgaaacatttactgttcctctttgccgttgtggtttctagacttggtcagcgggtggaataatctcaagaatcaaatcatactccttcccaaagcctggccacagaaaggtgctaaagcaacccctgcttgctgtccaactaagtggtaggaccaacgcgcactcagctcccgcccgcccagtctgccctgtgtgtgcgctgccccccatctcttgccactctgcttccaggcctctttgcccttgctcacacctgctgttcctgggcagccgcgccccaggtacatcatgtgcttttcatgtgggtcctcagtccgtcagctggaagtccaacagtgtgagcatgctttctgtgctcaagcgtcattttaaagtcgtttcagttggcgtcatccgtcatagctaattatcatgtccgaaaatcttttcaaagatggcccacttactttttggtggccagactcacgtgttgcagtgttctggtaattgattatgtaagttacgttgtgatggagggaacaccaaggttttgtgaggcgcgctgcacagtgaggtcaggcagtgcatggtaacttcattatggcttagacgtctaacatagaactgcaaatgtgacatgtaaagaagaggtgtaatctgaggtctagaaaaaccagttttctttttgaggcagtaatgttgacatctcattgatttccatgttttgttctattattggattttgagggaaaataaaaataagttctttttcatgacttttatttataatgacttatttattccttcccccaaaatatgtatatataatgtgtttgaattgctttttttccattctacttttattatcagtggggtaaaattggttcttttatcagtaattctttttattttcatattacttggtgtttttaccgacattttagcatataattgagcatccactcatgaaatagattgcctaaagtatttactagaaacaacagaaataaaagacataaaacccttgagattttatttagtaataattttccaagtttactcatactcaagaagttctcaatcgtgttgaccacagaacagaaagatttaatgcagtgttcgagaggaagaaaaggtttattttacacttgaataaagtaactatgtctgtttttcatgtttacccaaggcaaaacacccccacagattactcacagtggctaaagaaatacctagaaaataagttttggtgcatctttagactacaggagaacatgtcagaaaaaagttgaagaaaatatcagtgaccacctaaaaataaagaagtatatgtgtagataacaaccataacatcatcaaaagagaaatgagaaactgggagtaagtagcactaatgctgacacatagattaatagctttaatatacaaagagattctaaaaataattaacaaaaatattaactgtctactaggataattggcagggaatatcagtagtagtttatagtaaagcaaatataaatagttcttaaacatatgaaatgttgtttaacttcatgagaagagaaatgcaagttaaaactatggtgcttaactgtgtccacctatgatccaaattttaaaagcttgataacactgtagtaaaggcatggtagataagcactttcactcttccttggggaagtctgaaatgatgcaatctgtaagaaaggctctgcaattttatttctaagtatgtacagatattcttgcatttgtgtgaaatcatgtacatgtgaaggtgttttttccaaaattgtataattgacaaagtctgataataatttaaatgcctatcaatggaaaacaaatgaaattggttacagtaaaattgctactatgggaggcagctgagatctagaattgttttcaaaatataattttaagtgtaaaagtcaatgtcctgcaacacacacatacacatacatatatgcagaatgtgttgatatcgtatacagtatcctagaaaaatacagaaaatgctggcaatgctggttgcctctggagtaagagatgggaatgttaagaaatcccacttttcattgtaaactctgttgtatctttttaaatttgaacctgttaagaaattttaatcaatttttttaaaacagaaaattaaatagtagagagtaattaatctgattaatattgtgaaaatacctttctggcaaaaaaaaaagtttgctttctatttaagtttagaagaactttaaagtatacattgaattttttatagaaataagaaactggaaataaatattactaatgatgacacatatataaggccaaaaatatcaacagataatttttaaaagatcaaggttgtaaggtttaagctatagattaaaaatattttaattgcttatcagaaatattttagagctaatatgtatattttcacaaacaaatggggaactttccattatgtaatcagtcatgagaaaagaattgtgagaattatgtcaaatgtcccatcatgttagctaagagataaataactttcttgaacttgttaatttgctcagtgtacatagttgttttaataattcaggcacaaaaaatacatgttagaacttgaactacctatagcatctagatagttaatgaaaagtatgtttagatttgaagatgattatgaatcagataatttaaatttttcataaaattactaacaggctgatgcattttaaacttgtctttagaaattagtagcttactgccaagcacagtggctcatgcctataatcccagcactttgggaggccgaggcaggtggatcacttgaggtcaggagttcaagactagcctggccaatatggtgaaaactcatctctattaaaaatacaaaaattagccaggcgtggtggcacacgcctataatcccagctactcaggaggctgaagcaggaaaatcacttaagcctgggaggtggagattgcagagatcgtgccattgccctccagcctgggagacagagcaagactctgtctcaaaaacaaaaaaagaaaagaaaagaaaagaaattagtaacatacttataaagtataaacaaaattaacttaagaatacaactagtagtctttaaatgaattaaacccctcccaatattagtcctggaatttctttctctgctgctttaagcacagaaccttatccttcttttatggaaaataggtggaaattaaacagcaacatctctaaaaagacttccagggaacttttcagctttgcatttcaaaggcacatcccctaagaggattaaactgaaatgtgtcccagaatttccaattaaaacccatttttcatgttttattccaacacatacattggtgattataatattttaaaacttacatttaagtacagggctcagtgggaagagaaaaaagaaagaaacatcctcaagttgtaccctgttgcttggtaatgccttagtagaccagacccttgagaaaatgtgttttcatataattataaaggaacagattttagatcttcactgtaagagaacagtaattgcagaggtcaagtgttattttcatggatctcagagcaaagctaatagtagcctattccccagccaacagtctgccctcgcctgtgggggtctactgaaccagggtaattccaccaaaaaaaggaaaccaaacctagtttattgcagccaatatttctaaagccagctggctcttttgtcactattattgtgatgactaatgactgtattgtcatctgcattactgctgttgcctaatttgaaaatggcccaagaatctgggagtaaaaattaagatctagtaaatggatgttaggacacttggcaatactctggaatcaggaaactctgaatggacctatcagttccacagaccaataattttttcctcttttgttcacttttggatcaccagcttttaaacataggcactcaaagaatgcttgtcaaatacattttctattcgcagttaaaccttaccaataggaaatcagggataataatttataactggacttattattgcagagtgatatccttacctgaatttataaaatttaaagaaaagtcaccagttgttcttttggaaggtagaaagcgaaggtggctaatgccatctagcggtggactgaaggtttgagcctgttctgagtattagcaaaaatgaagaaagtggaatggtcaacatttcatttacaccttgttgctcactgtgcagaacagatgacacttattgattgggacagaatggctctctcaaatgcaaacataaagaataaaaggttaatagtaatgtagaccggaaatatattttttattaaaattaaatgtcattacattttttaagaatagtatttttacaatttatcattatgccactgtgctcattctttacaaactcctcaaatttttctttttaactgagcattttcttttagagattgttttggttattgttctactaagtggcatattcaccaagtgctttgggaaagatgaagcatggattttgcatcttcatctttatcataaagtaactactgttcttttaactgactcaataggaaacctcccatttcttccacattcttccagttgtggcatcattctttgctccagtcctgttagtcaccagaaagagataggggcagggagcccagggatctgggtaggagagagttgatgtggggttgttgagagacatgagggttctttgtggcttggcttaaaaggcttataatcacatagtggtctgtgttgggcagcatggaaatgaagccccaagctttattggctataaacgtggagttctaatttccgaggaagatctcccatctgtttccctatccataagccaagatagactaggggtgaacaacacactgctagtgagagtataaattatttgtgcccaggggtttagattctctgtgtccatcgctactaattcttactcattcctgacaccctagtatccctttcagcatattttgacaaccccatctctgttttaaaattcttccctgcaggattcatatgtcagggaattgcgttctggtttaattggaacaagccatttggaagtcctcctggtctggagaacattctgtgaggtagagaggctgcaaccccaggataatgtcctcagtgggagggacaggaggtcttatgtcaagaagaggtgatggtccctctcctcaccagtgatggctagtccgaggacatcctttaattccacatctgttcaagttttgtctttggatctcagaatgtgcctgcctgcagggaaaatcaaaggagttgaaatgacagtaaatattaaccttgaaagagactttaaaaaaaataaaactattttcagcctagaattggttgcgggagaaaactgggcaaaagaggaggacagaaagcctaggggatcacccagtttctgtcaggacagttttccagaggcaggataattatattataaatcagaagtgaaaccacagcacagtcctgtaatcatatgtaaatgtttaaaagaaatagattgtcatttggaattattcattcttatttctcttcatcagcataaaggcttgagagagagctaatttttaaagcacattagattatacttcacatctcctagtttttagaagtgattttcattcattcacccatccattcattcatgtgtttgttcaacacatttttattgagcgtccttgtggacgtggcacagttccgagtgcagtgaataaatgtctccccctccttgagcttatattctatttttatttttgatgtgtcatagttacttctgttaatcagttcagtagaagtgctgagatactctgtgacaaaacagatcccatcgacatcatttttacaaataagaccagatgtcctttagccttgtcaacaggcttgggccatggtgaacaatgtctgcctctgaagtgctcagcagaccgtgtgaaagaagaaggtccgggtgtttggaaacaatggctgagtggcggtagtggtgcattgtgacctcattattctgcttttggtttctcgccttgtaatatgaataaggcacatgaggatttagtgtgtgtcataagataagtgactgtcacgttaagcttaatgtctctgtttctgtaactttctccataatctggcagtatctcatttcttcgtggccagtgtttgggcactgaaaaggtcaatcaatacatagaattgtgactcaactcacgctgaaaaaaaaaaaaaagcatctgaatcatggttctcctgtgaattaaatttagtagcaagaatcttgttttaatttggaagaaagggtgggtcaggaaaactcaagatagagactttcaaaagggaaagtccttaggataatgagtagatttccccccccagttgtttcatgatataaactgatgtggaccaaataaatacctgtctcacaggggtactgatttccagcattagctgtggcagctggagcattgctggcctaggtggcagcaactggccttcccttgggacctgtagttactgaccagtgccaccctctgccatccaccccaatgctgctgcatctccaccgaagataaagacttgggtggagacttggaaaacatatgtgcgttggagttgggaagtaggtaggagcagctgatgagtactaattttcctctttaaataatgtccatgtaatatgaaattgaagagcacaagttaaagaaggaaaatgcttccaaggcgaacatgcaaatcatcagcgatctttggtaggtgggaataggatgtgcaagggggtgagtggggaagcagctctatccaggccagtagagttgactctcaccacaccctctgaacacctcacagagtcccttgagttgtagcagcacaagcttgctttagcccttgcaagatccaaataattgcccgaagaatgagatcagccttattttcttccctgtttttcgtaattctttcctttgtctttcctgcaaaagttaaactgtgattattggaaaataaaaataattatgcagatcaacttaacagttttgtggatgaagaaaaacaacctgttgtcctttatgtactttagtcctcccctgcccaagggaaccggcaagagagtactgtgtcattcaatccgtatgagccagaacttgcaccctgggctgcagacaaaggtgagacttcctttcattcaagggacattcacagagcaaagtgcgtggtcacttgtaagtttgtagagttggttcacgaatccacaccacgtccgtgattgcaatacagccacagttagccatggaaacactcacatctagtggcaggcagcaggcaccacatgcccatgagcagtgatggtgctattgaatgaaatggtctttcccacctccctcacccaacgacgttggaaatgtccctgccactcttcagaatttctcatcccttgcaacattgatgctactctgagttcatattcccatgaagatcatgttcttggaaggatgaatcctggtgtggggtccagccccaggtcgtatgtttcttgactgcattgcaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaagtaagttgctatgttccaccagcctcaccctcacatgagctcaggttctagacatgactgagaataacaaaatgtaacctggcatgactaaaccctttttttattaatgctaccattcttgttaatttctggtactattataatgaaagcgtccattacctttaatggcaaaaactgcaattacttttgcaccaacctaatagtacatgcaccttatggaaaattaggaaatagaaacaagcagaaacataagaaaataaaaacatcaaattggcatggtggctcatgcctgtaatcttagcaatttgggaggctgggataggaggattgtttgaggcctggagcttgagaccagcctgggcaacatagcaagaccctgtctctacaaaaaaaataaataaataaataaataaataaaacataaaaaattagccagacatagtagtgcacacatatacttccagctgctcaagaggccaagaagccaaggctgcagtgagccatgattgcaccactgcactctagcctgggtaacaaagcaaggccctgtttcaaaaaacaaaacaaaaaaaagaaaagaagaacatcatatttgtataataccatcccaacactactactgttaactaaacattactactgttaacttaatcttattgtatatatttttagatctttatttgtacacacagatattatttaattaaaacaaaatcattccattataacaatagtttttacatttattttctttaattttatagttacatctcatttttcttacatgaaaattattgattccaaatatgattagtataattatttattggctttatcctatgatttcagataacaatacatattatacaacagttaaaattgctaaatttcgaaaatatctttgtatttcttttggtctttagaaggtacccaacatagaatgtacaagtaaaactactggtttctaaagtcctttgaaatacaccctctgtttgaattggtatgatactaatatgaatgtggttagatttagtagcttcatggtatttcaaatgtaagggatttttgtaaaaaaaaaattcgtgagtaggtaatttttatgattcaagggttaaaaatatagacaaaaatatacacagacatgcgtgctttccggccgggtgccgtggctcatgcctataatcccagcactttgggaggccaaggtaggtggatcacctgaggtctggagttcaagaccatcctggccaacatggtaaaacctcgtctccactaaaaatacaaaaaattagctgggtgtggtggcatacacctgtagtcccaactacttaggaggctgaggcaggagaatcacttgaacctgggaggaagaggttgcagccagccaagatcacaccattgcactccagcctgggcaacaagagtgaaactctgcctcaaaaaaaaaaaaaaaaaaagaaagaaagaaaaaagaaatgcttgctttccaatctgtcccttcgatttgtttttgtgcatgtgtgtgtgtgtaaattagatacacatacatgtatgtatacacacacaaacatacacacatatgtatacattcacaagtatatacatgcgcacatatatacacacacaatcaaaattggctgtgatacttattttaaaatatatgtttgtatatcacagtcattttgtacaatgagtaaaaatgtttctgtattaatcctaagctttttcagattatgaaaggttgtgatctttattctgtgcttaaatttgtgaattaacatagacatgactgtggacataatttcaactagagaatttggggagaggagaggctctctcggtcaatttggggcaaaatgatgtctttacaatactgagtctttcaatctataaacacagcccatctctccatttaccaggtcttcttcagcctctctcaggagagttgtttaccttttcaatgtattacattgaaatatatgcttttaaattctgcacctagaaattcactttcaacaattatgaaaggcattttatattcacattcattacatgtaatctgagatggtgaatcccaagatgttacaggaattcgtacatgtcatcgttggtgaagtttatttacaagttatttaaatattttacagtttagggtttttgcttggttgggacattcttcagtactgttcttcaccattctttttattttatattattttttagaaacagtgtttcactgtgtcacccaggctggagtgaagtggcaagaagctcactgcagccttgaactcctgagtccaagtgattctcccacctcagcctcccgagcagctgggactacaggcttgcactgtcacacctgggtgattttttttagagatgggggtctcactatgttgcccaggctgaccttgaacttctgacctcaagcaatcctcccctttcaacctcccaaagtatggggattgtcagcatgagccaccatgcccagcccccaccattcttttttagtaatggagtattactctcattgtctataaaataagggaatataggttggaaggccagccatccattacaggcttctgaagacacattgccactctgtggcaggtatttccgtgggactgtttccacagggggattatgcttcacaggataagattatctaaaagtgaggcattttggaaagtttcttgtgtgttatgatttctcttgcagagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacaggtattgtcaggtgcccccacacatctggaagctatcccctaagggacagggcccacccctggatgggccgagcagcctgatttccttgggaagccttcccaccctcctgtgccttcctttattggtccatactcagggaccttgacagagggacagggagacatagtctttggattcagctctgttagctctagttgttcagagaagaactcatttgacagttttgtcttttttttcttcctgtagtcattcagtcttggcctagtgatagactcagcctcagaatatcttgacatggaatctcctttctcactgggaagaacactttctttttaaagaaacattttaaataaatgcttttctaagaggtgacagttaagtcttatctgtttggctgaccttatgttctcatgagtgatgacttctgaaaataccaatcactgctaattgattacatccatcaagggagtaattgtgttcttctcatctaaagctgttgttgagatgaagaaactcacttggagtaagacagaatgatggccaccgaggagcttgcctcatttgctgtgctacgtttgtacttagattgtctctttagtctccatggaagggaggtgttcttaccctgactttgtaggtgagaaactgattctcagggttagttctgtgacctgtgtgatactggaacaaggatttgaggtggtgcctggctatctgtgagccaggcctgactactctgttatactgcttttcttgcaattccaagcatgccaggaaactcaatcccattgaacaccaggagaatatggcattgagtcctgaagagctatatgctaacaaagttatttgtcaccactcgtgagttttgttgtttaagaagagggaaggagtagattcacccactgcctgcgtgaggagcatggttgtttgttgtgaaatgggtcactgtctgttatagctgatgagatcattatgactttcagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggtaagtacaacttagctaatattcagagcagcaggtggtaaaaaatgcaagataaatgtacgttttctttattttattattggtatggtttcaaaaagcagttttgctactgaaaaataactatgtaagatatgttcttataatctttgattttactgtttaaaaaataaaaataatatcacaccttgagatttactcaaagtagtatattctaaattatgtttcatggaatgatcaggaatcgaggtattaagtgaagatttgttttgaaaaaagaagaatgggattccttcattaagttaatttgaaaagtttgcattggacagcttgattcttgcaggatttccccgaagcccttttcatgctacttaacattacgaatctcagtagagggtttactgcactgcatttctcaaaccagattcatccatggcatccttttctgataggacatttcataacatgtggtggaacactgtcccacagcatggagctattggagcttggagctccagtactgcagttcagagctccaatattgcagcttggagctattccaaaataactttctaatgaacacctacctatacatgcaaaagttagaaagtgaagatttaccaaataaactcgtcatctgtgtatgtccactacatatgtagaaattgttctattggcttaactggtatccagaagagttgaagtgtcaaaaaatagatgcagtgctggaaagaagagatctagatagttatgtgactgaagctaaaagaaatatgccccttggtttggtgaggcagagattatcaagaattaagggtggacttccagcaaaacataaagtagaaactagttctgggtgcaggtttggacttcctaaaaaataatttcacagtgaccaatccccttgctaatataacttgacccctctctgaaccctcaaatgaaccaataacaactaaaagaagaaaagataagaaagctctatcttcatattaactcatctgtggtgtatacctagggtctatgttaaccaactggaaaacgtgatggcaccaatcccactgagtcaaagagggtgccgaaggcaggttaacaaccctgctagtctctggtgaagtccacatgctcagaaatagatggcagaccttcaaaatctacctagtgggtggcagataggatcctgtgtttcatgccctgcagtggtcagagaccccaccctgagtgacaatacccacccactcacctttccctaagaggcagtccatggactggtaggtgatggggaatggtggacctcggccagcaaagggactgcatgaagggtaagccacaagagccaagctcccaggcaggcaggcagactccaccatcttgagcacaaaggccaggcgagagtacagcaggggtcaggctggccctcctcaccccattcttcatacagtagcttcccagaaggaagccccttcagaggtgaaccactgtgagaaaggcatcagcatgggcctggatagaaatagcagggaaacagagcaaggaagacagcagcctaggatgaccagcatgggacatgctggagaaagaagcctgttgtaatgctggatgtacctcatcatgatcattacagaaaagaagacagcctgtctgaaacaaggacacagaggagatagagaaaatgaaacatgaatgctgggcaccttatccactgctgtataacaaatcaccccaaacttactgccaaaaacaccaccaggtgttggtttccctgccgtcctgctgtgtgggcagggccaggtaggcagggttcagtgcgtctgctcacacaggggattgcacagtggcccgagggacaggaggaccgtttccactctgctcactcacactactcagccactgagcagctggttagacacagcccatgctggagacctctgcggggctgtcagccagctcacctgcacatggcctctccttggggcccttgggcttcccttgggcccatgcttcccttgggcagcatggcagctgcgggctgagagcagttacccaagaggcaggaagtgggggctgccaggcctataaaaccaggcccagaaactacctcagggtcacttccacctgatcctattggtcagagcagccaaggccaccagcttcaaaggatgggatagatagaaccacccttttgaggagaagtgtcaaagagtcaaagaacatggggccaattctaaaactgctgtagatattaaacagcataccattaaaaagtaaactaaactaaaaagtaaaccaaagattgtctttggacaatcaatgaagaaaaaaagccactagggaaataaaagccatcttggaagcagcaaaaagagacaaaactaccgaaaagatagggtagtggaagatttctgtatgaaaacaaagcaaagtgaaatggaaaagaataaaaagtgggccgggcgtggtggctcacgcctgtaatcccagcactttgggaggctgaggtgggtggattacctgaggtcaggagttcgagaccagcctggccaacatggtgaaatcccgtctctactaaaaacacaaaaattagccaggcatggtggcaggcacctgtaatcccagctactctggtggctgaggcaggagaattgcttgagcccgggaggtggaggttgcagtgagctgagatcgtgccactgcactctagcctggccaacagagcaagactctgtctcaaaaaaaaaaaggaataaaaagtgaaacaagatcaaagaaaagtgctagctgtggaagcaaacgaacgctggcactcgggaaaccatgcgtgacagggtagatttgtgcagcatcacaactgaaaaacacaggtgttctttgatccagcagctccttccgagagcaaacacacacatctggtaatgtgcactctagcacgggctgccacggcaaaaatctggaaactgcctgacgactgctccgcagggtttggtccaatcagtcatagcagattcacaggaagctcacaatgcaacccttttaaaagtgacttatttgcatgtgctgacctagaaatatgtctactatacatggttaggtagaaaaattaaaaagtacagtgctcaaagaatatgcccctagttttatgaccagaaaaaagtatacactacctatttatgcatgtatctaggttattctgaagacagcctaaatttcattgcatttaagatttgtcaaaggtttacttttttcatcagttcaaaattcagaagaaacctgaaataacacacatggttgtattgttcatgacttgtaagatcaaaattttaaaatagcacacaaggtgatggaaacagaagtataatcagttgtatcatttggaagagaagtgccagggcaccttatggtctccagattgatgtcctgaatgtctccttgtgatccactgtagtgtcatgaaatcagttttcactgaaatcatgtccccctctccaccccaatgagacctcacacaggtgacatcagcagaagataaccagactccgctgtgtgccccctgaatcccaaacccagagagagggttttgctatgcagttttgacctctgtactatcacttgctttttaaaattaggaaattagaatgcttagatcattttttaatgatgctagcaagtagtgcatgctaaaataattgacctgggtggagaactgatcaagatggacgactaaatgcaactagtatatgctcctccgtagagacggaccaaaataacaagtacatattcacacttccaatagatggtctaagagagaacacagatgcaaccaaggagcgacaggaagcaccaaaagcaaagcacagggaaacaaggcagcctgcttggccaggaatgactgggagctgggagaagcttccagatatggggaaagcataaatgagagatccccagggctccacattccagccaaggacttctacaatcctagcgacagaagaacccctcgacccacgtgggccttaagactaacatagggagctgcctagggatcacacagaggcattgctccatagagggaactcacgctgagtcccacaggcttccaagctctgagtagctgcagcttggtgccatactgagaaccaagtccccaaaggactgcatcttgccctgggactattgctgatgctgccatcaccaggccaaggacagaggggagaatggacaccttcacacaccccagggacagatccccctgctgctacaggctgctgtggggctgagacacaagcaaatcacaccccctatagctgcctgcctacactgctccccctgagaatgtccgcagcctccccaggagcaggcccatagccagcgccattctgagagccaagcctccaaaggtctgtgtccttccttgggccagggctgatgctgccactgccccgccacatagggagaagggaggccaggcactttcacatgccacaaaaacaaataccaccaccactgctgagggctgctgtgggaccaaggctcaagaagactgcatatcccacagctacctgcctactctgcacctattgagagtggccctaccctttctggtggtaggccttcagggcagccactgctggcaacctagagaccacccctccctgcgtatcacagccagcagctgaatgcaccaccagggagcctgagcacaagtccattggcctagtcacatgccccaatacttgagcatgacatcctgttgcagccaccgccaacaccaacatggaccacttgggttccagtgagttgccctaccaccattactgccatcacccacatcacacccactccccaggaacccaagaacctgcccacatgcccagccactgcagcatccacacaatctacctgaaagcccaagggtcagccttcttagacctactaacaccagtgctagtgtataccgccctagggcccaaggacaggcatactcagctcactgctgtcaccactggggtctgaagactggcccacctagcatcctattcacagtacaccttcacaacagcctccactaataaccataccctaaggcactgagaaaatcacaggtgtcactgaggctgtttatggccatagaaattatacatagattaaatactgcattcaccccaaatcaaacccaaagtgccctacatatatatatgtgtgtgtgtatatatacacacatacacatacgtgtatatatacacacatacacatacgtgtatatatacacgcatatacacatacacatacgtgtatatatacacatacacatacacatacgtgtatatatacacacatatacacatacgtgtatatatacacacatatacacatacacatacgtgtatatatacacacatacacatacgtgtatacatacatacacacatacgtgtatatatgcatacatacacatatgtgtatatatacatacatatacacatatgtgtgtacatatacatacacatacacatatgtgtgtacatatacatacacacacatacacatatgtgtacatgtacatacatacacatacacatatgtgtacatgtacatacatacacatacacatatgtgtacatgtacatacatacacatacacatatgtgtacatgtacatatatacacatatacacatatgtgtacatgtacatatatacacatatacacatatgtgtacatgtacatatatacacatatacacatatgtgtacatgtacatatacacatatacacatatgtgtacatgtacatatacacatatacacatatgtgtacatgcacatatacacatgtgtacatgcacatatacacatatgtgtacatacacatatacacatatgtgtgtatatacatatacacacatatgtgtgtatatacatatatacatatatacatatatatacatatgcacatatgtgtatatatacatatatatacatatgcacatatgtgtatatatatacacacatatatgtgtatatatatatatacccaacatatatatacccaacaacatatatatattttcaggaaaaagacctcctctacaaaagcaatttcaaaaaactggaagaaatgactgttgtaccacatgggcagatatcaatgtaagaacacaggaaacatgaaaaagcaaggaaatatgatacctccaaaggaacacacaattctccagcaaaaaaatcccaatcaaaaagaaattcacaaaaccccagatgaacaattcaaaatattgattttaaagaagctaaataagatataagagaattctgaaaaacaatagagagaattcagaaaaacagttcaggatatgaatgagaaatttatcaaagaaatagatatttttaaaagaaccaaacagaaattctggaactaaagattcattgaatgcaataaaaaatacatcccaaactccaccaatagactagatcaggcaaaagaaagaatctcagaacttgaagacaggtcttttgaaacaacctattcagacaaaaataaagagaaaagaataaaaaagaatgagcaaacccttcatgatatatggggcagtgtaaagcaactgaatattcaaatcatcagtgtccccaagggtgaagagagaatgaaagattagaaatcctatttaatgaaatattagatcaaaacttcccaaatataacaacaaacctagacatccagatgcaggaggcccaaaggtccccaaacagatacaatgcaaaatcatcttctccacagcacgttataatcaaaccacttaaagtcaaagcaaaagcaaatatactaaaaagagcaaaagaaaatcttctaattacccataaaggaaccaccattagactaacagtggatttctcagcagacaccttacaggccaggagagaaggggatgacattttcaaagtgctgaaagaaaaatactgccacccaaggagaccatgtccagcaaaactattcttcataaataaaagaaaaataaagcctttcccaggtaagcaaacactgagggaattcatcaccactagactgatcctagaagaaatactcaaaggaatcttaaacgtggaagtaaaaggacaatatttaccatcataaaaacacacaaaagtataaaactcactggtaaaccaaacatacaaataatcctgttaaatagtgggctaagaacatagatagacatttctcaaaagaagatatacaaatggccaacaggtatatgaaaaaatgctcaatatcaccaaacagcagggaaatgcaaattacaaacacaatgagataccatcttaccccggctagaatggctgttattaaaaagactttttttaaaaaaatgctttgcagatgcaggaaaaaaaggaactcttatacactgtttgtgggaatgtaaattagtatagtcactacggaaaatattagagagacttctcaaaacaaaaacaggctgggcacggtggctcacacctgtaatcccagcagttttggaagcccgaggcaggcagatcacaaggtcaggagatcaagaccatcctggctaacacggtgaaaccctgtctctactaaaaatacaaaaaattggccaggcctggtgacaggtgcctgtcatcccagctacctgggaggctgaggcagaagaatggcatgaacccaggaggcggagcttgcagtgagctgaaatcacactactgcacactccagcctgggcgatagagtgagactccatctcaaaaacaaaaagaagaaaaaaaaactaactacacatagaattaccatatgatccagcaagtctactattgggtatttatccagaggcaaataaacttgtatcaaagggacacatacactcaacgtgcttatcatagaactattcacaatagcaaagatgtggaatcaacctaactgtccatggatggatgaatggataaagaaaatgtggtgtgtatatatatatatacacctctagaggtgttcactggttacttagggtacaccctatgtaaatgaagaggctaaagtgaagttacaaagttatttacttggtgtacaccctatgtaaatgaggaggatgaagtaatgttacaaagtcatttactgagtgtacaccctgtgtaaatgaagaggatatttcctgtcatagctgaagtgtttccatttgatttagttctaggaagtccttaggttccctgcctccaggccctattctcctgtctcaatttcactcagcataatgtcctctaggctcatgcatattgtagtgaattcccttccttttgaaggctgaatgctattccattgtctatatagagggtgttttgtttatccactcatctgctgaaggacacttgggttgctttcatgttttagctattgggaataatgctgctatgaacatgaatgtacacaattttatgcttttctttctttcttttttttttttttttgagatggagtctctcgttgtgtcacccaggctgcagtgcagtggtgtgatctgagatcactgcaacctctgccttctgggttcaagcaattctcctgcctcagcctcccaagtagctggaattacaggcacccgccaccacacctggctaatttttgtatttttaatagagatggggtttcctcttggccaggctggtctcaagctcccgatctcaagtgatctgctctcctcagcctcccaaagtgctgggattacaggcatgaaccaatgtgcccggcccacaattttattcttaatggaatttctccctctgctttgcttttaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagtgagccagtcctgcttcattttctcactgtggggccattagaacagataagcaccagattgtctttacaacaacctgaaaatcctaatctgagtctctcattatcttttaccagtaagcagttaatgtgccctcagtctattccaaactgagaatgaaatatctgatgctcactgaagagtgtgtttttcccattgtgtgtcaacacatgtaaatatacacaaaatataacccagatcattactcattagagttgaaatagaaataatgactatttacagtatcttaattacattttttagatcttttaattaaaacatatataccaaaaagggcacaactcttagcatgcagtacagtggttttccacaaatgaaacatacccatgaaatcagcccccagatgaagaacagaaccccagaagcctgtttcctctgcacacacagccttccccaggggtgacccaactgactccaacatcacagattaagtgctcctgtttttatacttcgtataattgaaatcatacaatgtgtactccttcatgtcttggagtggctgttttgttttgtttgactaacacctttaaaaaaaaaaaagcttatgcatatcttgcatgttgtaggggatgaaaggaagtgaagtcaccgctatgttagagaaaggagagcggatggggtgccctgcagggtgtccaagagagatgtacgatctcatgaatctgtgctggacatacgagtgagtacctgacactgactgtgatgtattcagatgctctggaaacaggtgaaatggttgggcgtctaaaaaaaaggataaagttcaccttttcatgaatcaggaatgtgcccgctttctaaacaaacaacggtgggggctggtcttgctttagagaccttgctttctggcccatgcacttacatgtagtagagcctaaagagcaagtttagatggggactctaacccgagtgtccaaatttaaatgtcgataatggtggagagatggggcaagggcagtcaaagtaaaaaagtgtttgtaagagtttggggctggatgccatttttggcatagaggatggcagaagcactcggtaggggatggtatactttcctgactccctgattaccatgagcagtgaggggtgacctcggactctggccagctcacagatacattggctaaggttgcacttccctagaatctacctcatccttgaagtggtggcctcagtccaccctgactgccgtcatacgtctcgcttagtggatcccaggtgctgttatgcttttaaagtacacctggcattattcttaggtgatgttcagggcagctcagcaaggaaggaaaatgcattgccactgaaaattaggagtacagttttgccaggctcagcagcctgcttgtgcgtgcatagcacggtgaccccaagccgccatctccagttccctggtactgaactgtgcacacagagcccacacagctgagaatcgatgtggtttgtgatcaggaggacatcacaaatcctggccatggatttgatgctttgcggaatcaggtttgccttcagatacagctgacattgccagagcctctgaaagatgagggctattccaaatgctgcagatgccacctgggattccgagacctcccctccccaccctgggagtatcactctaccacaattgtgagtgacagggaaataatctcattctgtatctagaaaccacccagggggcagccacaaaggcagcaggcaaactgtgggtatatgcttccctgcccctgctgctgccgtggctcaggagaggagcctggcctgggccccggagcatcttctccaaccccaagtgttagtgcaacagggagagctaagtgtcagcaagagggaagtgctactcatggatctaagaggatgtttattcctaagtcttggcttaattctcccagtgcctaaactagaatcgtaagaaccattggcaggtaggcactggcagcactggaccctggggagggcagcccttgggcacgtggcagcctatgaccctttactgaaagtgttctttggtccagcctgcagctccctttgcaaggcttcccttcttgtagaagggtgaggagggtagagtttaaaacattgtgatacaaatgcaaaaactttgaattaaaaatgaactcgcagtgggggagtttttgcatttaacgttgatgctgatctatgtacttctgtcgattcttctttgtggtgtgtgtttaacagtgaggagtgaaaggtgggtgggaagagagcagggtgcgcagccaggggcaccacctcccacttggctcccaggtgggtgcagtgaggctgctgaataccctttgggctcgtggtgtattcttgtgactcaaggaatcaggataggggctgctgggccgacctctgtcctccatggacgcacgtaacagtgggcagttatttccagagtggtccaccaggggcagaccggggagggaaagcagtctacgtgatattcactggatgttcaccagaattacagcaaagtagagcagtagaacagtctccttaagagagtattctttctaaacgtattttcccgcctggagatttaagatggaacctgagtgaggttcacaggcaggcaatgtctttccccttggttcccaccccagtccgctctgcaggggtgcatttcagtgagttctgcaggcttggaggagtcagctccagggcacaagccccagtcaaaaggaaatcatgacaatggcccatgccccatattagaaatcacagctctttatcagactttgatttatttcccaacaaagctatatttctgaaggttacagtgtttctagtagtgacctcaaacagggttgggggaggtggggagatgttctgaaacttttgaagcagctgtgtttgtctggggtaatacctgagctcgttgcctcacgccaaggaaatcaaagatgcagacacacaagaagtgagtttaagagcagaggtttaataggcaacagaaaagagaaaagctctctttcctgcagagagacaagggctcccaagtggttcttccggctccgtgtggaaatgcaagggttttatagacgagcttgagtctgattacatagggcccaaagatcggttggacagccaggccatttacataacacgaaaagaaactggctgccccaccctaatcttttattatgcagatgaggtctctccttggccgacgccatgttgcctgctttttttttttttttttttttgagacggagtctcactctgtcgcccaggctggagtgcagtggcgcgatctgggctcactgcaagctctgtctcccgggttcacaccatactcctgcctcagcctcccgagtagctgggactacaggcgcccgccaccacgcccagctaatttttttgtattttttagtggagacggggtttcaccgtgttagtcaggatggtctcgatctcctgacctcatgatccgcccgcctcagccttgttgcctgcttttttactgcacacgtggcaacaaggaaagtggaagagggaacctccatgttgaatatccctggctccagggatcccttttctattgacacagctgccggcatttacctatgtgagcttttagcttgcttagctatgcttgcagcttgatttttcaggctgctttttgttataaaagacatgatttaggagctgctttttattgcaaggaaaccttacagaggactctgttaccctcactatctgcctaaataatttctttctagctctgaatcactttgtctaaacataagaaattcaatgaggtgcagttgaatgaaaaaaaaggaaaagattccttggagcagggccacaaggagaactcagaagcgccaagggctggtcctggtaacccaggctattgcttgaggccctccagaagatgcagggggtccctcactgcaggcattgtcatcagttccagggtgtggtcctggagggaattcaaagggacttcccagcctcaatgacaaagccctgagaaggcagacagcatccctcacccttgtaagacagccagagattacctccaacccctttttagtcttaatggactcttcagctggacctagaaaccaaattgataccaggccagattaacaaaagaaaagcttaccaattttactagttttacatgtttatggggatcctcacaagacagtgaagtctaaagaagtggccaaaacaacatgcttttataatctttagacaaagaaccatacatttaaggagaaatgacaggacaaataaaatctggctagaaggagtaaattttctagagaaggcgctaggagatatgaggagggtgtaaaaccagtggaagataagggatactgtgttaaatatgtttactcaggcccattgcagctccaatgcccagtctctgatgataaggggcattttctcatcctgctacaggaagggtctccttcccagaggaatctttatggcttgctgcaggcatgaagagacaggtcagttagtcctatccgaaactacaatgtatccaatattttcaactcaaaataatcaatatcccaatctggcatattttgggatggcccatgcttcactccttccccctctcactttccaaagaggaaacacaacatcagagtcctgccctgtgcaggtcactcaaggaggcagcgtgaaagccaggaaggaaacactggccctaagaaaagcaggaatcagtcaggaagccttccactgtagtgttttccagagccaagtcatgcttggggtgattaaagacaccagtggggaaagcccttgcaaatggagagaagttggtgctcttgatcctgaaaaacggtttcctaatagtcccagccctccagtgggggcctctgccgaatggagaaatttcctgggctctccaggttctctgagagtcagggaggctctagatgcggctcaaattcctgtttaaagatcaacaagcccaagataaaacatgaattcccaggaccttggtgagatgtcccctggctccctgcacaacctcagctccaaggctttcctctgagcggcacatcctctgagagccctgggtcattcacagggtcggtggccactgccggagctcctgctatgcaggctgccaccccaggtgcaagcctcacagaagcctcagaccctgtccctatcagaccttatagttggggctggggcagacaggcaataaacaataagctaaaaataagtgtgtcctatgatgtgtcttaggaaagggatgactccagtgggaattctaagcaaggagggcacaggggcctggaggatatcacgtgtatatatggggttttttaagccctctcgtgtcgaagtagtttctcacagttgcctgcagcacagaagcacattggagcttctagaatgtggtggattcaatgaagggactacaggtggtcctagtatattctctgttttgttttgttttgctttgttttttcattttttcctcagtagtaaacagccactctctccaaggtgatatatagagacagacagagagagcgggagggaggtagatgaagggagagaaggagggagggagggagagaaatagtctcattagcacaaacccaggtatggttgaagggggtttattatgagtaacaaaagatgctgctttcagcccaacaatcaggaaattccaagggttttaggagctctgtgccaggaacccaggataaagaccatatatctctttatataaaatcacacactggaaactttaaaagagaacagaaaattatggggagggaagcctcacacttccagcaggggctccagataggccgcctttagggattgcagctgagacctgcaggctaagaagcaaggttgagtgcagggatgaggggagaggaggagggtcactgggtacaaggagcagagcagaatctgcactctggcccgaaagcagagtggcaggccagggcaggccaggaagctgggcacgcaagggcactgcatcaccctcctgctgctgaagcacagctgtgtcccagcttcctggaggcagcatctcccatggatgtacaggagagatttcctaggagacctgaccaggtgtttttcctgaggacgagtctgtattcctgtttccctgcatttgtttgctccttggctgctgggcagatgaacccccagagcaagatccaaaggtgctctttgtaccatttggatccccacagttggagcagagccccctgttttgcaaagatgctgaagtgtgttctctttgactgtagaagtttaggagcaagacagaggctgtccctctgggtggacacatgctcctgtaccagaggcttggccaccatatcccctctcggaacacacttggtggccagagacaaagcccctctcagtgacaccctgggaggcccgtgtccccagacatgaccacagatggctgaccacactgatcaattcgagcagttttatcattttgctcactattgaaagctataagagaaaccatgtattttgatgccatttgacaaagctacccattttgatttgtagaagccactctgctcttataatgatgagtgagtcttggtcctgatgcgcgttctatggctgttctcttgtgtcgacattgaatcatatgaaattgccattgatataggtcaaaatggctgaatgtggacggtttcctacaatttaacctcacattctgtttcactttttcacttattgtatttcaacttcacccacttgcaatatatccagaaatcttgcaaaataagaaaaataacttctaagtgaggatcgattatcagggttttagtacttacttccaactgatctgtacaggatgtctgtgtaagacaaaacagaagtgtctgtaagtgtttgtttagagactgcgaactgttaatgcttttgcccatagtttactgacattagtgcctccctggccagcagtggcagtaaggactggctatattaaggtggatcatagacaagccctgggtctttgctcctgccatgacatgttttgagctttcctaagaacccatatcaacagcccattttcagaaaatccagagccatcgattagagcgtggaaagggagaattaaagttatgttcgtatttcttctcttaacaagattatgagtcagatgttgactatatctgcagaacatttgccaagtattttcagacacctgttttgctaaaatcacagagtgacagcctcttcgtgttgcctgtggcacagaagcatattgtgtgccgcatatctgaacctggggctaaaacactcccagttctaatgcaaaaagtctcctactttagggtggacatgaatcaccgggaggtcttgttaaagtgcagatatgggttatttaggtctacagtaggccgacactatttttgacagccttgtggtcaccctggggtggggggcacagggaccacgctgtgagctgcaggccctagagttagccaccagggagcagcaccactggtactcagcctgcagaggccctgcttgtgatcagcaatttttcacaagcacattgacaaacaagaatgcatctcttccattccagtgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttgctttgtgatga

SEQ ID NO: 1842 - DNA, 96637 bp, Homo sapiens
ggactttctggtaaggagaggaggttacggggaacgacgcgctgctttcatgccctttcttgttctaccttcatcggccgaggtaaaagtgctgaaaccatgtgaataaaatacaggtgggttccgccagcttcgctcctgaacctacccgcgctcgggatccagaagctgcgccgggagagaggggctcaggcctgggcggaggggacggaggtcagaccgtgcggaaagtgacccgggcaccccagggcgcccaggcccccagggagcgcggaaagtgcggtcgcggcccggccctcgggagacgcgggattgggatcaggcacagcgcgaggaagtcgatcttggagctagaacattttcctttggccatttacacgaatccactggaaaatgccgcagtgtttatcaaagttactcaaagtagaaatgtccagacgtcttatgagcttagacaaatcttttactacaaaaagaaacagcagttgcattcaaacaacaacccttctgaaccactactaaaatttagcataattactcttgtggatacattttcattgtcaagtaatttacttagccaatgaacttggagagcaagaaagttttatgtagtaaaatgtaaatttgagttaagagttaagggtgtttctttttgtctgtttgtctgtttttggcaatgtggctccaaaaccttaagcccacctaaaaactatataaatgcaatccattcttttgttggaatgttcaaggactagaaagacaattggagaagtgagagtttgaatctttttttacgttggaaacagtgttgcaaaatattttttgagttttgcctgacttagcaaagattcagtcgaactcaagtagagttcaaagcattgcagcgtgtagtaaaaaaaaaaaagagttgaagatgttgtgccatatctgattcttggtattaaaaataaaaaaaggaaccatttaatccctaagagttcctggaagaaatggaattgattctaccatctgacttctttgtcttagtagggacaaattcattgccttcacacaggcagcattttaattaaatgcaactaaatacattgatgtcctccttctccccagtgaaagtccgagcagtgcatagatagaattatattttctcaaaaaggcttaaatacatgtaaattattaagtgttttaagtgagaaatctttgtcagttgaaattattttatcaaatcatttttgttctgaacggcacttttgttttaacgtatttagaaaactcttgcattaaaacagaaattgatttgtattatcccctgtatttgaagtgcactttaaagtgtatttgaatgagagattataatcaaattacttgatttgtgtcttatcctcttactcttctaccttggatttgaaaaggttggatttgaacactaggaaaaaagagatttttctactgagggattgtgggaagatttttttttaagcctctgtatttgaagtgaaatataaaataggattttataatagtcttaataactagaaagttttaagctaggataaaaatggggtgtatactttaggtctttatctttcctgagagatgaaattggtagaaacgttattttattgctagatttcactttagaaatgaatcaccctgatctttgttaggcccctatttaatattctaaatgcaggtctaatctctctgcttttttttaatggaagacttcttagtagaacttcacttatttagcacattgtttgcccatggttataatccaatatgcttgtgccaagacgtattttggaattcaagctttttcagaatttggaattaaaatttagaatctaaatttcagaactgagaaagacattgctcagaatttagaaaggtaaacatacatgttgaccctgctggttacatgccattccaatatagtctggagagaatcctgtaattccatgcattaatatttctgtacttttacatttaagaacatgaatattctcactaagtggaataaataaagactataaagagctgtgtgtctgtttagagcaggtgttatcactacgagagcttctctaagacttaccaaaaaaaaaaaaagtgttgtttttcagagctttttagagctgcagctgagggactgagtctgtattagactccactgaactacggtttgcttttaaaaggaaagtgcatttatgttgttcaatacttcacactttccagtaattagaagggcagttcctctctctttagggagtcttaaatagcaagattttactgaattttcaatcataccgatcaaaatagaggtacttcaagtaagagtggatgtctcatctttgtaatataatttcaaacagcatagtttctgacagtctaccattttagagaaacagagcagaagttacttacaggaggggttactgtcaccctttacagctgcagtctgtccatggaagaaatattatttcctgttaactttgcaaccagctgggtttgtgtcagttatctaagcctaagtgatggctaatttttactttctcaactttccctgtatagatttttttccagctaccccctgacttttctactcttgctttgctggttttaacattttccactacttctggattggtttagctataactgggtggagaaaacaacaacaacaacaggaatttaggcctttggggaagaatttgttttgttttagaagtctacacattgagcattactttttcttctaaagcaactaaaatcagaaggcagagtcctaatgagagattatgatcaaattgcctcatttgtgtcttatcaccttcctcttctacttagatttgaacaggttggatttgaatactaggaaaaaagggttttctactgagggattgtgggaagatgttttaagaactagtctgattggattttaggaaagttcattcattttgatatgatgttatcagggacattttctatttgcttataattttatctgaccaatattagcttgtatcaatttgaggtttttttttcctttatgaatcaattgtgcaaggtttgccctacatctcttaaaaggtggttaaactggaatcttaaagacagttgaatttagccaagaccaaagatatgcaaagaaagaatattttgtttatgttacagtacatttaataaatccaaatggctcccttgattcttttctttctgggacaccacgtattgatttctggcagctggccaaaggcagatggtggtggagcaagcgaggacagttaagaatgttgatgattactggattactgaggagtactgtgagctttctggtcctctgctcagaggtgtctagctctgaaactgggatcctggctctgagctggagaggcgcttccagttactgctgtcctggagcgctggaagggagcataagtgtgaggagacagtgggcttttagcctgggatgcagatgagagatgtcttgacctgagtgaaaaccttgcaggcaagctgcaggtctaccgagcagggtgagggaggctctcgacctggatactgtgaactagggagagaaagtaaattcaacagaaggagggcccagggcagagatttaggaatatccacagtttaaatattgctttacttaagtatactctgcctgactataagtagcatttgaatgttcaacatatgacctttcatttctcccctccattggtttgtcttaactgataaatctttattttcccatggtcaacctggtagtttattaatattacatctatcagttcctgttgagttgacatgaaaatgttttggtgtgacctaagttaatttctctttttgtttaattttaatttgtaatgagttcctcttttcattctgcccatcctttggtactgctttgagttatgtcctctagaattctcactatttccttatgattggcatattttcaaagttttttggtgtactaattttaaacagtgtttgttgacactgagaattcaggactttggagttttagaccaccatcaccttctactccttctcacaccatcccaggataattattctctcatttgagattaagaagttatttggtttattttattatggttatataaatatagtttactgctaaagcaaggtatatcattccattttctatctcgtacccctttttgctcttcctggggtaaacccttgctttgtttttgtgttttcttagtttgcactgtgcctattatcatttccttcccaactttctgacataaagatgaaagccctattgacacaattttctacagtgtcagatataccaagtaatctcacggttccatttttctttctttttttctagaaccctccatcttcttcttgtctaacagttgctcttcagtcttgctatacatacagtaatacctgaagaatgtttggaggatatttggtgtgggacttttcttttttttttttctttttcttttttgtagagatgggctctcactatattgcccaggctagtctcaaactcctgggcccaagcaatcctcttgcctcagcctcccaaagtgctgggattataggcatgatccactgtgcccagccctatggggaatatttgttgactaaatatgttttatgtaaattgcttatcatactctttgttgtaacatctgtggcattaatatgcctcttgttaacactcacctacattttacctgttgtaaatccactgtcataattattgaaaatatttctccagagctttttaattctatggttatttatttattgtagtatagaacttttatgatttcttccatcagggtgcattctgaatcatgcttagtgagagatggtttttaactccactttaacagttagcatctatgttttacatcagtgtcaatgtcacttttgtattatatacgacaccaacattttattatctgagtgatgagaatgtttatttttgtggaaatggagatctcatgagactttaagcagattgctggccttctcctcgatttccttgattgattcctgaagtggaactgcagtgctaagtggaattccctgggaagcttgctcaagtaagtaagcatgagaaatgctgaatgaaataaagtgcagcaagcagggataaatatcatgggcatcttcagagcctttgtgcaggtaacatgcacagagattctctgagagagtcagtctcagccagtggtcctacacttccatgaccctgcagtgcgtttgttcttagagtggctttcagggctggctctgccacagcctctttgggaaaccatgcatgacctcttgctgctccttaccaagctccttaggctttgcttggtagaggcagaatgttgtggttgttttcatcttaaatgctaacaatatatgaattatgtggtggatacactgcctcaaagtgacatttatcgaatatttttgtagctacgggttgagagtaagggtctgaggccccactgggttcaagtcccccttctttatttgtaagctcttcttttgtaaatggagcagtcacagggggcttcactctgatacctaatggagaccgtgcctgcagtgctcggtacctggtatgtggttaaaactgacataactgtcagagcctctcccaggcgggctgactctgggaatctgccctgcagtcttggagggaaggcacgtccagataggtttgatgagcaactacaattgccaaagttagtttctctgacctccaagatgggagaactttctaatattttcttttaggaaagttgtccattgcataactgatacacgagtacatatcctttagtacaggattcagatacagcgagcaacagaaaagcccttcttaacctccaccctcagtcccagccctgcccccagtcccactgttggggagcagttggagctctaacctctcttctttcgtcctgtgcattcatgtgtgcatgtgtgcacgtcttcagaagatataatggtgggctgtgtatgtcttcttaatacctttatcactctggaactttctttttattaatatgttggggtgcggggaggtctccatattcagtgattattgtaatttttatgacagtccagaataggcatgtcgattttttttaatttttgatattataaacagtgctgcaatgaatgcactttttcttttcattctttccctctcctttgccatttgcactgtgttttcatgaaaccatcaggttaatctttatctcaaggaagcccttcatccctgtccatcctgttcttcagtccatccacttagttttcctatgattattttagcaagcaggtggttaatttccaaggaatgtagttacttctttgggatttttttaagtgatgtattagttttctgtgtattttattacttgtttgagtgcaccattacccccgtctcccggggtatcagttcatctgcttgcatgcttggtgcctctctctcctgctgtcagctttcctgatgtgctgggtatttccacgtgtgtgttggtttttttttttttttaggtaccctaggcattagtcttttaaggctgcattcttgcagcctgtcccacatgagataggaggagggcaagacctggatgtgcacagggcaggatgggcccataactggtctgtgtggtgtgtgggtggcaggaactccctgttctttgtgggtatggccatgccttccctattcaaacgaagccacacacctgtcttttcctgcgaggcgtcttctgctgctttcttggagctggggagcatctactcttcccttgtcctcccgctcctccctgttcctccctcaggtctctgtcgcttctaaggcactccacccttggtcttctcccaccttgcaccccccacactgctgcctgcctgcacagggggactgtgattgcccccttcagtgtgagcctgacctgcttcatgcctttcaaggagagcattcattgccaagctactcatggaacatctcctcagatcctcagcgtgctatgacttcattttctgtaatactgtttttcatgtttcttccccttctctgcatttatagctgtgcatatgcttgaggtggaaggccaccacttccttttggttaacaacaccaatcagctgatggtcatggctacgtgaaggaactcacagtgagggctcaggaagagcctggctagagcaggctgcatcgcaggccttggcgttaggttccccaaatcactgctggtgatcttgtagctctgtcatgaagtctgtcctgcttattaggataccgagggtccaaattcatagattcttagaagcctgtttaaatatgcagagtatctaattcaacccgattagaaacgggctcagaaaggtgaagggatttgtccaaccactgagtgatgctgctgggattagaactctcaaaactaggtgtttctaatccagaaccagaatccctatccactactctaataaggcgtaaaagaggatctgctgtcctgcctaattggtgggcaggtttggagtcctgtcagcagctcaggaaagcctggagaggcagagggaggacacaggctcagtgtcagacatgccaattttactcatcaccaatggttacacaaaacttgttttgatctttgtggcttttgcattgagaagttaagcatatacaataggaattagacacaatcccaaaccaatgagagactcaagtgagaagagctgaagcttttatgcatgccttccttccatagagataaatttactatccagagtgaactagagcctcgtggaaagtgagtgccgagcccctagctgtgagtgtctctgtccttcccacatcagacctccatgtctgtggctgtccccctacggggcagaactgctgctctctgcttgtgttgctgtcgtgagggttgggagtggacaggtgtggacagatctcagacccgtttccctcctgttatggaaatgtttgtgaggcaggtgggacttcaatgatttggtcaaggaaaggcagcttggcagctggggagaagggctcaggctagaaaggcaagcgtttgtgagggatgatttccccaaagaagccagcagtgtgtaaggtattccccggagcttgtttcttctcagaagactctggaagctgtgtcagtgtctgttatggaggaatggagtatcagtccgatcaggctttcataacaaagcaccacatactgaacggcttgaacagcccaatgtgtcgcctcccaactctgagccaaagagactgaggtcaggatgtcccagggtggctccttccaagggttgggtgggacaatgtgcccccagcatctccttggcttgtgggtgaccatctccagctccacatggcatgctccctgtgtgcctgtctctgggtccagatctccttttcatgtaaggacaccagtcatgttggagtagggctcaccctaaggacttcaatggggcgtaatcactgctgtaaagaccctgtctttaaataaggtcacactcagaggggttagggagttaggacatcaacatttgaacttggggggacacaattcaacctgtaacaaatgtgtgagtgaagactggcacctccccacgatggcctttctgtgatgccatcaagagcaccagggagctctccagatatggagatggacagatgtctaaggcccctgaaatgagcctgctgtacagatgattccagaactctgtcagtgtgaagaccaaacacaattaagcacattaaaatacttacggtaaagtgtttctttcactttagatgtgcaaaaacttaaagagagagagacttatgagaagactcagggaagaaatgtaagataaaggtgttaagggagacaaactccacaaaattgtaaagtgaagctgctgtggggagtagagcccagacccagataatatgcaggcatgggtccaagggaggctttgcacaccaggcgggggaggtgcagggccatggatgaatggtcttgggaaaacggcaaatcgtttggaaaaaaaaacaaaactttgctctttatatcaaaataaattccaagctgaacaaagaataaaaatatagcattgaaataatgaagctattaaaagaaaacttaggtgagttttaaaataattgtgaagaggcctgtctaaatgtgataaaacatatgaatttatattcacactcatcacaagattgataagcatgatttcctaaaattttaagcaaatccccataaaatgaaaaaatatacaaataagtgaaaaaaatggtaagatatatttaatttcaatacttgtggtaaagcatcaatagctttaatatgcagcgagttttttcaaatcaataagaaaaaagacacagatgggtgctgacagggccgtttggtaatatcttttaaaatttaaaacacaagtgctttcactcaacaacttcacttttaggaacctatcacacatataaattgacaaaagtggagaaatattcattgcaacattttattttataatagcaaaaaaaaatcactaagggaagtacagttgattcatatgttggaatcctatgcagtcttctaaaaaatgtggaatttatttcatacaccaaatataacaatgtccaagttctactagtgaaaaagcaagatgtaacatatcattgtatttgtttaaaaaactcatgctgggttgggtgcaatgactcatgcctgtaattccagcactttgggaagccaaggtgggtggattgcttgagctcaggagtttgaagccagcctgggcaatatggcaaaaccccacctctatgacaaataccaaaaaaaaaaactagcctggactggtggtgtgcacctgtagtcccagctacatgggggcgctgaggtggggggatcacttgagtccaagaggtcaaggctgcagtgagctgagatcatgccactgcacaccagcctgggtgacagagcaagaccctgtctcaaaaataataagtgaaaaaaaaaaaaaaaacctaaaaatctcccacatgcacataataatttaagtgatattggattgtcgtttactacttatacatgcatttctgcctatacatattctatccagtgtgtacacatgtgtatgtaaatatgtagcatgatctggaagtgtaagcaccaaattaagaacagcagctttggggggaggggaatagaattggtttagagaaaaaggtgaaattaacatttttattctgcctacttcagtgtgcctgcagtatttacaacgatcaggagtgtgtacttttttcaatttagaaaaatgataataataaggtttgcttggggggaaagggtaagtaggatgagaccaggaagagaagtaacttagaaacacatcatgcatcatgactgctggcaccattctgtcctccaatgaagagcgaggctttgagaggttcagcagctcacccaaaggtgtacagccatggtctcaaacatgcttgcaccctgctgtcactcaggtcctgaagcccaggccacctccaaggacactggggtgctctggggtgcagcctgccttcagatgtttcttaaagccactcctactccaccccacccagtgcaggagccaagattgaggaccaccatttgacagctagttcataggatttcatagcacacaaacacatctttaaaggctgatgaggtttccaccaaattgggatttattggtatgctgggtataatggcagctgtgtgtgcctttgactgcaaagacactgggcaggccagagtggctcctccccatttgatatgtgtgtgtgtgtgtgtgtgtgtgtgtgtgtgtgtgtgagagagagagattgagagagagagggctcgtgtttttctgttgcgaacagtcctttccacgggaacttatattctcctaaggtttgccactctgcagaacttttggaggaaggctttagagtgagaatgtcagtgcattctcagcgtgcaactgtaagacttgcaggaggtgaatgcacatgaaataattctcagaggaagaatatgtgcactggtcagatagcaaaactgacctgtaacattttctacacaagaggatttgaatggttttcgtctttaagatttttttttaacattatgcttagtccaccatgctttattctgtcagaccatttgccatctgcatgcttcatgagaaatgtttttttctcgtgagaaggacgtaagcaatttcgctcctggttgagagtttggtccatagtttcttggtgtctgtgggttggcttctgggcctcgctggctgcagctgatggtgaccagaagggctgttcttgtgagtcattaggggatgggccgctgctgctacctccccaccccagccacctccatcagcactgtgccatactcgcccagaagggcccctggactcatcgcctgcccccatgtttacactttttaataaaatctctagaattgtggcttagacctgtaaacatccagttccaagaagtggctctaaagccctctctgggggcagagtggttgtcagaagcagaccaggcctcggggtctagattccatccttcactggaactgctgggggctggtagtaccccatctgcaaaatgaggttaaaaatacctaacccttgggttgctatcaagctcagagatgctgtatgcaaagcaccaatcagactggctcacaaagaataggccctctgtcaaatgttcatggttgagtgcgggatgtcaaggataaatagctactggttaccagggaattgaagacagggttcttttacaagcaaaaagattttataagagggtcacagaaacagagtgactcttgcccaacagtatcataagcaaataagctgtgtctagatcctaatcatgtgtttagggctctgctgggtttaataagcaacacatagggggtgcgttgtcctccactctcacatccccagtcactagacaaggtcactcccccggggggcatcttactcagaagctctaaaagactttgttgcatgactttggcccttgctcttttaaaatgtccagttagagaccatggcatggagagttttgtatactctgctcccagcatggcaccctctttgcatattgtgggcactcttaaagttatttctcatattgtaatatatcagatatgacttggatatagtcaactagatatttagtgaaaaatgtatcacccccattatcaaaagaaaacccaaagccttcaagtttggcccaactagaaggaatttctggaagggggaagtaccaggaccacacagactctggtcctggcggtgtgtttataagatgcagctcatcatgttggtctctgtcatccctgctaaggctgttcattatggaaccactggccacatgtggccactgaccgctcaattacttaaaaccatttaaaataaatgttgaatttcatttaaaatttaaaattcagttctcagtcacacaggccaggtgtcagggaccagttgccacacgtgggtggaaggtgtgtgtcaggcagagtagaacaggtatttccattgctgtagcaaggtctgccagacaccaagctgctctcagcccatcccctgaggagcccagaagggatatgaacttccacccacctctcccctttcccagttctcagtgccactccttgcctaagtgcacggtaacactcgccactatttcatgtgttgatacctgcagctcccaattttcttaagaggatctgaccctgggaactgatgagggcaccaggagtgccctctcctttgacatgagaccttgagtcttgtccatggggccctggcctggcccttttcatccccaaggctgtaacattctcctgcacaacacaacacacgtgcacacacacacacacacacacacacacacacaaaataatgttacttctcagtcacccgggaactgacatggttcccagttatttccttgcagcagccctccaagcggtaacacagccttggagaaagctactaagtcatgtatccttggggtaagcacacttggttcagaatagtttctgaaagaacaaaccaggtttttgctcaagagggttttgagggactggagaaaaccttagtgcttgttcctttctcttcggttaaaaaaaaaaaatccaacatagtttccttgaaacatttggaacctgaggttttgtccattttgaaaagaagatgtagagaggtaacgtgtttctcacgaaggcaaaacaaaaaaataagatgccaagcaagtggcccttgtaccttcaagaccaagaaataaggcgtttgtttctgggaatgccttccatttgctcattttgtaagtaatcaaggcaggctgagaggggagccttctgaggcaccccagtgagcagaggtggggtcctgccactggcccctcggctccaaccttgcctcactccaggcgctggggcagagatgtgtggttggcctgtctctggagttcctgtgctgcttaatttgagtagagataaaaggccacaagagaagtcgttttgaagggtttgtgaattataggacttcctttcatgattcagcctgactccaggaagtgcagtcacgtgctgccctcctaggggagcttcgccccaccaccagcactcaggctccacttactgcaaaaggcgcgatcaagattcttcttcctgaattattgtcttaacaaaattgatacgtctaaacattgagttaacactttcattcactaaaaatgttttcctgaatgatgcttttcatgtgacttctttatagtcccacgtgaaaaggggaatgtgctcggctctgtgcttgttcccctctgtttgggagcctgcgctgctgctcacttctgcagtcagctctgtttggatcagttttgaaccccagaaccttccacatagaggtgataattctagataattctagagcaactgcttctctatctggctgtatgctaagctctctagagagctttacaagggagagattctgagtgttagggctgggaaaagagcactctgtgtgatcctaacctgcagctgaaatgcagaaccactgttctcagctggagcttttcattgttttttgtttgtttgttttgttttgttttgttttgcttgtgaattgagcttactaatggaagcaggagcttgttctgtttagcgatcgtgagaaccacctaggcagcggagcctgcccttagaatctgcttcactgggctgtactgggctgggcattggcagttttaggacacatctagatgtgtcccaagcaatctgatattttgatgtttatcttacagagaagcatgtgtttagaaggcagatagctgtgcttctgttcttctgattttcgacagagacatcagaaccttccacagtcattttagtctaagtcctgaaatcgttcactgccagccctgagtctagctggactatatgcctctggttggacacgtctgccacctctgagaactgtgtggatgtaactcttctgtcttctggctcgttgtgtttccaaggagaagcttgaggcccagtaatacttaaaaattttttggacaaatttaatcttacataattatggggtacacagtgatattatatctgtacaaggtggaagggttgaatcaagccaattaacatacccatcatcataaatgcttatcattaatcctcctctctatctgcaactttgtagtctttgactgtcatctccttattccatcactccccagcccctggtaaccactattttgttctctgtttctatgagttcaatcattttagattccacatatgagtgagatcatgaggtatttgtttttctgtgcttgacttatttcactttacataactttctccagcttcttctatgttatcacaaacaataggatttccttctttttcatggctgaatagtattccattgtgtgtgtgccacattttccttagccgtttattccttggtggacttttaagttgattttgtatcttggctattgcgaatagtgctgcagtgaagcatgggagtacagatatcttttcaacataaatttgtaaactttcttaaaacattatgagttttttgttttgttttgttttgttttttgcaattttttgtttttggctcatcagctatcattagtgttagtatattttatgtgtggctcaagacaattcttcttcttccagtgtggcccaggaaagccaaaagattgcacatccctgctctagaggttcctggataagatgctcttttaacccctgtagacaagactttttttatttctggaaattttataactttaaacatgtgttttactcctttattttaattctctatttcagggacattaattttatatattttagatcacccctgtctttctcaatttttctgttgaattcctgaagtctttgttaattcctatttcatttttctcaagctccacagatcctgtcccccatgctgcctgcagtgttaatatccattcatttttccctgcttgatataatagccaacatttcttttctggccttttctcctgatctctgctggcttatcattgttttttgttttttgttttttggccccttcctcccttttgagctgttattttaaccaagtgattattctgttaagttctttgattccatatctgtgtgtgtggacatgccttcatctgccttttgggacatttttctcatgaaagtcctttgccatttgtttctcctgttacttctcttctttaattatttcagcatcattgtacaaatccaaggtaggatcctcatctttgaaatagatcatggaagggccttggatgtgttccagtttaccagaatatttcctcccttctcaataatgttgtgtgtgtgtgtgtgtgtgtgtgtgtgtgtgtgtgtgagagagagagagagagagagagagagggtgaaagagagagaatgaattggtttaatacatatttctccccagtgaggctgccagccattcagtctcctctcttcaacactctaagaaatggttggctttccattgctgtgtatatccttccactctgcaggccttgtctgaagtctacagcagccagtccccactaagggtcttcatgatcccagggcaaacatagctgcattgggctccgcttgtggcatgttattgctcaggatcggggtgcccactggttccattttatttctttatctggttcttgttgcagggtcatttcagagaggagggggcagtatctctgccaacacccaagcaatctgatattttgatgtttatcttacagagtgacttagagtatgtggcattgaaaccaatggttaaaaatcaacaaataagcaggaaacaacttcagaatgaccaaaaaagttcctggggcactcttagcttccaccagcctctctgatggtcaaccaggccattttgttggctttgatccgttcagcacattgagttatggggcgcctcccacgtgtcaggagcagggtgaggtatgggggctgtcgcagcagctgagatgcttccctgcacttgacttgtttacggtcagatcgtaaggaagcatgggagcccagcatcaggctctgctcatgcataatctcatttattagtgacagcaaccatagggtttttctttgtgaaaaaaattataaaatacagaacagtgcagtaccacccaaattaataaatgttgttattttaccatttatgcctttatttttcctaaaagaacagtcccaataaagtggaagctataaccttttatggatgaggaagtggagagtaatctgctcaaggctggctagctggtgagcagcaggcctggctcaggcccctctggtgcccctgatttaggcttcatggccttctctaccctgcaggaattatgctggctcagctgtgcaggttggcgactgcaaatatcaacccctctaataggaaaccaggcagatttttctcatgctatcagctgatttttggtatatgtaaataaaacctatgtttttgagagtagcaggaaacattttgttagaaaaccaaatgaatacagggagatatggctatcaggagctgagactgatattataattttccaagtactagtatctgtgtattgatttttacagtaatttgtactttcccatccagcttgtttgtgaccactgaggcccttggtgaatatcttagaagtcactcaaaatggataaagaatgaatgtgagtcacccatagcagtcttatgtgagataatatatggttgatcctcagtattcatggcttctgaatttgtgaatttgcctactcacaatcacagtcatttatctgtaatccccaaatcaataaccatgatgctttcaagaccatttgaggtcatacacacagtgtattagttcattttcccactgctgataaagacatgcccaagactgggaagaaaaagaggtttaattggaattacagttccacatggctggggaggcctcagaatcatggcaggaggtgaaaggcacttcttacatggtggcagcaagagaaaatgaggaagaagcagaagaggaaacccctgataaatccatgagatcttgtaagacttaatcactattacaagaatagcatggaaaagactggcccccatgattcaattaccccccttccttgggtccctcccataacatgtgggaattctgggaggtacaattcaagttgagatttgggtggggacacagccaaatcatatcacccacccctggccccttcaaatctcatgtcctcaaatttcaaaaccaatcatgccttcccaatagtcccccaaagtcttaactcatttcagcattaacccaaaagtccacagtccaagtttcatctgagacaaggcaagtcccttccatctctgagcctgtaaaatcaaaagcaagctagttacttcctagatacaatgggggtacaggtattgggtaaatacacccattccaactgggagaaattgtccaaaacaaagaggttacagggccaatgcaagctgaaatccagcagtgcagtcaatttttaagctccaagatgatctcctttgactccaggtcacacagccaggtcccattgatgcaagagatgggttcccatggtcttggacagcttcatccctgtggctttgcagtgtacagcctccctcatggctgctttcacaggttggcattgagtgtctgtggcttttccaggcacatggtgcaagctgtcagtggatctaccattctgaggtctgtaggatggtgaccctctactcacggctccactaggcagtgccccagtagggactctgtgtgggagctgtgaccccacatttcccttctgtgctgtcctagcagaggttatccatgagggccctgcccctgcagcgaacttttgcctggtcatccaggcattttcatacatcttctgaagtctaggcagaggttcccaaacctcaattcttgacttctgtgcactcgcaggctcaacaccacgtggaagctgccaaagcttggggctttcaccctctgaagccacagcctgagctctacggtggcccctttcagccacagctggagcagctgggacacagggcaccaagtccctaggctgcacactgcatgaggaccctgggcccaggccacgaaaccactttttcctcctgggcctccaggtctgtgataggagggactgctgtggaggtctctgacatggcctggagacatcttccccatggtcttggggattaacattaggctcattgctacttatgcaaatttctgcagctgagttgaatttctccccagaaaatggatatttcttttctattacatagtcaggctgcaaattttccaaacttttatgctctttttttttttttaataaaactgaatgactttaacagtccccaagtcacctcttgaatgctttgcctgcttagaaatttcttctgccagataccctaaatcatcgctctcaagttcaaagtttcacagatctctagggcaggggcaaaatgctaccaatctctttgctaaaacataacaagagtcacctttactccagttcctaacaagtttctcatctccatctgagactgcctcagcctggaccttattgttaatatcgttattagcatttttgtcaaaaccattcaacaagtctctaggaggttccaaactttcccacattttcctgtcttcttctgaaccctccaaactgttccagcctctgcctgttacccagttccaaagtcacttccacattttggagtatcttttcagcaacaccccactcttctggtaccaatttactgtatttgtttattttcacattgctgataaagacatatctaagactgggaagaaaaagagacagttccacatggctgggaggccccagaatcatggagggaggtgaaaggcacttcttatatggcagcagcaagagaaaatgaggaagaagcaaaagtggaaacccctgataaacccattagatctcatgagacttattcactaccatgagaatagcatgggaaagactggccccagtaattcaattacctccccgtgggtccctctcacaacatgtgggaattctgggagatacaattcaagttgagatttgggtgaggacacagccaaaccatatcacagagtggcacaaaattttagccacatgcatattccagacgctccaactcctcctttcacctcatattataagtaagtgtctttttccccagtctacttagtgccgtattttttgcatttttgttccttttttcaaattgtggtgactttgctgtttagagtacccccagctgaagtgctatctggtgtccctaggtgtaagaaggctgtgctgtgccttacagggaaaatatgtgggttagagaagcctctgtcaggcatgagtcatagttagtgctgtcggccgtgagtccaatggtagtgcatcaacaatagatatgaaataaggtgcctttacacagaaacacataaaacaagtgatgcattgatcagttgatgaaaatatggtgacggcaggctctcaggcacataacccctgagaagcgatgggctactacttgctaattcagttttgggggtgactttgtggaatgtataacctgaaataatgagaataaactatattctacttcttttacaaagcaaggaaataatttttaaaagcaagttaaattttactgtttttgtaagagatatgttttcgaaacagttgaactgttttataacacagagaaagtctctttgccttacattttatattagttaattaagtcagcagatttttcttgggctcctgtgatgtgactggcactgttttggtaccaaaagggcattgcaaaaaaagtccagaagtagacagatcacagccttcaggattaaaagcagtctcatcaatgtgatatttcgtttaaacttagtagcaagcccattgaattctcaaaatgagaatctgctaattatcacacacttttcttatgaaagaataatttttcatagtcaatatttctaaaatataatgtctctttctcattagcagagaccgattgtatggcagatttacttgcacctgcggatgctggagataggtgatgatttagtatagtgcacatccaccaggcggtcctcctgggtcccaatatttaggcccacaggatgagtccaggtgatattgggcacaggctcactcagaggctatcagacagaaagctctgcctcactgcacagcagcttcaagcattgccttcagtgggagtcttacttgcagtccacacagctcaggtacaaggcccctgaggtccacacctggagctaatcatctctttgaataacactgtagacatagctaccagaaaataaaagaaatagaaaggcatgattaatacaagcctcactaggttcttattgtgaagatctgagaaagagctcctcatggccctggcatgggagggaagagtgataactgtaaaatacccctaggctttctccatgacaatggttactctccaagggaaaacactttgcaagagccttgtctcagctgggaattcccaagggaattcctcaagttccagcaccctcatcactttatcacttaaaggacaaaaaactcatagtcaacaggggtcagcgcttcaaggaaattgttacagaatggtaaaggggtcgaatatccaagaagacataacaatcctaaatgtgtatgtgcataacaacagagcatcaaaatatgcaagacaaacactggtaagactgaaaggagaagtagacaaatcctgtcttatagttagagattttaatctctttctcacaaaagttgatagaccaaatagataggataaaaatgacctaagcagtactgtcactcaacttgatctaattgacatttataaaatattccattcaacaacagaaaaatacacattcttctcaagctcacttggaatattcaccaagatagagcacattcttggaaaacatgttaacacatttgaaagactaaacgtcataccaattatgttctcagaacacagtataattaaactagatatcaacaacaaaaagatggaggttttgggaaatttcccaaatatctggaaatcaaacaacagacttctatataacctatgtttccaagaagaagtctccaaaatctaaaaaaatattttgaagtgcataaaaataaaaatataatttatcaaaaattttggaatgtagcaaaagcagtgcttatagagaaatttatagaactaagtgcacacattaggtaaaaaatatataaagaaaattacttgtgattctacttttaagaaactacagaaagaagagcaaattaggcctaaaccaagcaaaagaaaagaaataattaaaatgaaagcagaaatcattgaaattaaaaacaggaaaacagtagagaaaagtcaataaaaccaatgttggttctttgaaatcatcaaccaaattgataaacctttaaccaagaaaaaaaaaagaaaaaaatgtagaagatgcaatttaccaatatcagaaatgaaggaaaggtcataactgttgatctaatggatataaaaagatgataaaggaagatcatgaacaactctgtactcacaaatgtggtaacttaggtgaaataaactaatgcttgagtgacacaaactactaaaacttacagaagaaataggtagcctgaatagccctatatctttaaaatttaaattaatataacctttaaaacagaaatcatcaggcccagatgggtccactagtgaattctgtcaaacacttaagaaagaaagaataccagttttccataatctcttccagaaaatagaaatggaggaaacagtttctaattcattttatgagttcagatttcacgtaataccaaaaccagttaaggcattacaagaaaacaaagcaatattacttatatatacaaaaaccctcaacaaaatgttagaaaatcaaacccaacaacgtatgaaaagagctatgtaccacagccaagtggaatttattccaggtatgcaaaacaggttcaacatttgaaaataaattaatgtgatacatcacatcaatgggctagagaagaaaaatcatatgaccatgttaatggaggcagaaagggcatttgacaaactcaaaacactctttcatgtcaaaaaaaaaatcttaaactaggaatagaggaaaacttttgtaacttgataaagagcattaaaaaaaaaaacctacaggtaacatcatacttaatggtgagagactgaacactgtccctctgatactgaaaacaaggtaagactgtcctctcttaccactctgttcaacatcctactgggagccctagctagtgcaagaaaacaaaacaaaacttatacagatcagaaaagaagaaataagacatcttttttcacagataatatgcatgtccatatggagaacttcaaagaatccataaaacaactctaataaccaataagtgagtctacaggatgctagatcaatatacaaaagtcggttgctttcctatataccagtagttaactattgaaatttgaaataagaataattaccatgtataatagcaccaaaaagacaaaaaaaaaaaaacacaagaaaatacttaggtataaatctaacaaaatatgtacaggatctgtatgcagaaaactacaaaataatgatggaagaatcaaagaagatgtaagtaaatggaaaagtagtccatgttcgtacattggaagactcaatgttgttaaaatgttcattctgccaagcttgatctgtagattcaacccaatcccaatcaaaatcccagcaagctgttttgtagctaatgatgaaatgattctgaactttacttgggaaggtaaaagatctagaatacccaacacaatacccactaaaaaggacaaagttggaggactcacactactcaatttcaagtcttactagaaacagatacaatttctgcccttatgggacaaacagacattcatcaaaaattcacatgctagaaagtaaaggtaaattaagtcaaaacagtggtcagtggtacaaaaggaaagcatgttagttttgactgtggggacagggacatgtttatcctgagctcaaagggtagcctggacagtggaggatttttagcagagaaaagggccacagcttagaacatgtaggaagggagcaaggtgggggcactgacagccagagctactcaaaagagatgtggaggaaaaggatgttatgtggttttggagacaagtaggcatgtgtgggaggctgagacgtgagatgggagggattggcaaggggttgactttcagcagtgtagagaagggaatgatctaagagagcttggattttcatcttcataaatggatggagctcttgggccaaggttctcaaacttgagcctttaaaatacaaaacctagagcttcaccccagagtttctgatttggcaggtcagggtggaaccctaagaattttcatatcctccatgtttcctggtgatgctgacattgctggtccagagacgcacattgagaacccagctccagggaacaagaaggagctccaagttaggcaggaaagccccaagcttacatttggatgggttgactatgagggcctttgcactgccacctgaagatggtagctaagagaagaggcaggcttcaaatattggctccaccacatactgtgtgttcttcagcaagccagttgaccctcctgaggctcgatgaccaggtctgtgaattgaggataacaatagtatctaccattagggatgttgtgcacatcagttgataacctttgagtcaagtactcatggaatagctgttttgcattatcctcatcaccttcatcatcatggccattctggccagcactaaagatgtacagccaacctcttctgtggctgaagtttatcttctataaaatgagaacttgtttttcatgaagctgtcattttcacaagtttggggtgcaggtgcagattgcctactgttgtgtttctgaacacttccctcgcgaggctcctaaccccaccccagtaaactcatcaacatgactccttccagcttctacagctctggagagggttcctttttatcttgcgtttccagggatgtttcacggccttttgtggagtgggccctggctgagcttctggcccttcttgagtgtggaggatgtcacagactgcagtgggaaattaaaaagctgcttgcttcacagagtaagggaatgttagtagatgcttgaaaagtaccctgagggagctggtcagaggtgctctgtaaagttgcatctgttgctagcaccatgagcagctgtctgaccaggaggcctgggaacagggacagagagagctggcacccttctttcctctgccctacacattggcctttccgccattaagaccatctctgcttgactttttcagtctcctggctggcaattagcatcttgaggtctccattaagatcttttcaaggatgctcttcctatttggttcaatcttctggttgaatttgatacatgttatgatgtaggactttttaaaaaaacataaaacaatcaggaaaacctcgctatacccattccagcaattcaagaccaagttcatttttggtaaaaacacttgggaaagggcatttccaggctggctaagcactaaatggcacagccctgtccactgactccctcctcaactggtgtgtgttctggagggatccatgtctcagagcattacttcattttgaatgtgcaattaaaagaggccccgtgctgctggggatctcacacttctgctttctggtttgttttgcatgctgacactttgaggaaaagcccatttccctaattacagacatcgtccagcagcaggaagcactctggcttgttgatgcctgtcttgtgctttctctctgtttcagctgttttccttttaagatactcctctcagatttgtgtgcttcttcccttcccacattctatactgcccagcgcctgggattccagatctgcgtttgaatccaggaaagggaggtaggtcaaatttgtgggaatcaagcatatttagaaaccctaacctcaggctctgcgcatctgtgggtgtctgtaggagggatacttaggtttcatgcctgcatctgcgtttcctctcctctgccgctaacattcttccactgagcacatgtccatcttgagctggaaggtttagcggtttgccatcttgtcttgcctgcagttatgatgcagctaaagcatccttctctccttcctataacctatgccactttgctttaagcattgagtatatttatgtctcaggtttatgaaagacaattataaaatctcaggagaccatcataagctcctgtaatatcttgcagtcctgagtcacccacaattattttttaactggctaggaaaaagaatgctagcgattttttttaaatagacattcagtaaaactctagatatttcttaatccacatttactgtgtcctttttgcttaagtcaggtgttttggtttctctagcagctgcaggatccccataaagattatgctcataaggtagtgatggaaaagtaaaatagagcctgaaagcgggaaacttcagcaaggcactaaggcacagacaagagatgttaggtctgccggctgttgtcattgcagtctgctgtggcctcacccccgcccccccccccgccccgcccaggccttcacagctgagtaggaaaggatcttgggatgggtaccagggcaggatcaaggaaagcctgcaactgcgctgcccttctcatcatccatatgtggtttgcccagataaaagcaatatagtaagatctatcaggcatattcaacgtgagttcttttttctagcatcttgttggttgtttgtgtttttccccagagaagagtgagtgatgaggtggccctgggacatggtagatggtgcagttcactggggagacatccttggccccactcagggtcaatatgcgccccacaccgctggctgcaaccccaccctgtcctcttctgctcaaaagagcatgcaagggacattgctaagtggcaattttggttgcaacccagtgttctgttaattattcacaaaagctagctctctttttaattaccaattgtgtgtgcgttgcgtgtgcgtcccttcccccttctctgagcacacctgtatgatgaggcatgtacttcttcctggtggagaagaactgcagagatgtctcccaggttgagcctgcagcctggcccggtcaccagcacagcacggtgacttgactgtcctccctggctcccttccccacccgtggcaagtggcaacttgctttcgctcacactgaacgtggtcaacttgcctccctgtcacactgtagcacttgaatagggcaatattagattatagcagaggttctcagacattagagtgcttaaaaatcacctgggaagcaggccaggcgcagaggctcacgcctgtaatcccaacactttgggatgccgaggtgggcggatcatgaggtcaggagtttgacaccagcctggccaacatagtgaaaccctgtctctactaaaaatacaaaaaattagctgggtgtggtggtgtgcgctgtagtcccagctactcaggaggctgaggcaggagaattgcttgaacccaggaggcagacgttgcagtgagtggagatcgtgccattgcactccagctggggtgacagaataagactccgtctcaaaaaaaaaaaaaaatcacctaggaagctgtttaaaatttacccttcttgtccgtatgccctatttgctgggtctgaggtgggcccagaaccctgctttccagaagggagcctgagggtggggtgccctgaagaccacactcaggaagaaccggacatgtgagctttcatgagccagagtcctgccaagaactagaatctgcaggtggctttggccagtcccacttagaggcaagaagacgtgaggatagtagagaacctggaaatcacgcagtccccaggatgaaagtggaactctcggaccagatccttattctcttactttcgtgagccatttctgcctacctgttgtcagggaggcaggaggttcatttttctctcacatggtgcctgacataatgacttgcacgtgatagatgctcaacaagcatattgaatgaatcaatcagttagattgtaaattaaatgcaccagatgggctggttgtttatttataactacacagttaacatttatattaacataatgttaacaccaaagcgtaatatctgttttctgtgttaattatggcaaggtgggcatagagaagagatttctgagtgtcttttgcagagcttgaaaatgtctatgtgttggttgagatagatcagcctttacttgatgcactttcaatcttttaagttctgaaggcacagcaagagaatttggtgttgaaggtttggataatgttttcaagtatttcaatatccctctatttctaaacattagtaaaaatcatgcctcatgctaccatccttagcttcactttgtgtttctgaattgtgtatctctatatactaagaagtcccccatgtatgcctgcaaatatgggagagtcaaccgctcagcagaatgtgcacaatgtaaggctgtgccttggagaccaggcaccctgtgcagtgtgatgcacaggcaggcctcaggatggcgccgtggagggcaagtgatacctactgacgaagccagtggagtggatgcaaggccaactcaggccctgcagctggggttctgttcctcagtgttgaggccacaggtctgtgtccacatgttttcttttgtacagtgggattctgccgcacaaggcagtgcccccagccctttgcagatgagtcaaacatgcttgtttgcagagcctggtgctgggtggggtggtcccatcacatcacctcttccttggtcatttctctgtaattaatcagccagtccctgaccaaaccagcaagatcaattctccctctggttggactcattcctcttttttttttttttttttttttgagatggagtctcgctctgtcgcccaggctggagtgcagtggcatgatttctgctcactgcaaactccgcctcccaggttcatgccattctcctgcctcagcctcccaagtagctgggactacaggcgcccaccaccacgcctggctaattttttgtatttttagtagagacggggtttcaccctgttagccaggatggtctcaatctcctgaccttgtgatccacccgcctcagcctcccaaagtgctgggattacaagcgtgagccaccacacccggcctcctctttcttatgaaaattaacccacagatgaagtttcctttcacccaagtcttgacaattttctcagcttcaagctgcagaggaaattcctaggcacatcttaacagggctgctttgcattgagggggctgtgtggtttgagcgtgataagcctggatatctttctgcactatgctgatttttgttcccttaaatggtatggatttggcaacaattgtttgcaggtgatcttttcccagagaaccacttatttcccccactgtctctgtatgataggagggctctaatggcccagggatgtgaaagtgagacaccttcaatcgctaaggactgctggaaatgtgaactacaggaagttgagggggctggaggggaggaggcagcacctgccggagccatgcttcagtgggtctcaagaaaagcagaagcctggaatctcagggctgaggccccttgataactaggacagatgggttaataaaaagggatacagagacataggctacctcttctggttcaatgccaagctagaaaatcctgaaatgaacacagatttatgagataggagtaatatatttaagaacacagtcttacatagagataactattttcccaaaacatccaaggtaaatttatatatctttatggatgaggttgggtcttttcagggaaggttggggagacggaagggaaattacttattatcagtcctcatgattcatggattccatatctccgcattcatctattcatttaaatctgtttgcaaccccaaaatcaatactcacagcacttttgcagtcatttgtgacgtgcacaaagcagtgaaaaatttaagtcacccaacacatacgttgaggtcgcacaaggtgacactctgctttcttgttttagctcttataaacacattttcttttctcttggcccatttagtccatggtttttgcatttttgtgcttttctggggtgattttgctatttaaaaatggccccaaacacaatgctaaagtacttactgtctggtgtctctaagtgcaagaaggttgtgatgtgctttacagagaaaatacgtgtgttagggaagctactttcaggcatgagttattgtgctgttgaccatgagttcaaggttaatgaatcaacaatatatatgaaataaatatctttaaatagaaatacacataaaacaaggttctgtattgattgattgacaaaaaagttgtaaccagaggatcacaaaaacctaacaccatatttccccaggagcaactgttcaggatttgcaaattcagctttcatggtgattttatagagcataactattgtgaataacaagaagcaactgtattttgtttcatgcataagatggaaagagaacagaaccagaagtatgatatcgatgaaatggagagaggagaaagaaaagaaagaaatgacactatgaagatttattagttaaaatgttactagtgataataaattaatcagaactttggcctctgcctttgatcctggttcccataatctctaagtgccaggctcagataatgtggcccttgcagggtttgggcagctagtcctctaaccattttctacaggtaaacgtggacatgaaagaagccagggtgaggcaggcagcttccagaagcacacactgggctcagctccttccttcctaacctctattttagctccacgtacctcttcaataccagaaagtcttcttctgattctgccagagcccagctcctagaacctagctcatacactcaccagccttttttgtcaacaattcattcaaatatttatttacttaaatatccattaagcactgttgcttctctcgcccaactccattgcacatgctatatcagttatctgttgctacataacagatcactctaaacttagtggtttaaaacaacaataattacttattattgctcataatttctgtgggccaagcatttgagatagctgggtaggctcaggccctctgtagggttgtagtcaggtgtgggccagggctacagtctcatctgaaggcttgatagaggctggaagatactattccaaggtggctgctcatacggctggtcacttactgctggctattggctagaggcctcagttccttaccacatgagcctccccaaagagctacttgagcatctttccaatgaggcatctggtttccccagagtgagcaatccaaaagctgaggaaaagtgttaagggctttcatgagctagcttcagagacccaacattgtcactctgcagtcagccactctgtgtgcaagggatgggagtaccaggaagtgaggatcactgggcaccatcttggaggctgcctgccatgtatacattttaactctcaaacaaaatttgaagactgaagacccatacttaaagtagcctctgttccaggcagtagagaacaaaatgtaaacgtacttacactaatggagtgtctattctagtggctttggggaatatagacaaaaaaacagaactaaaactctaaggtgggacagggagctgggagtgttagtgtcaggtgggcctatagagctcagccccccttcatcatgttggcattcatgctggctgttcctctgtaggggatgaaattttcccctgccagaagaatgggctctggacagcttgttcagctgcttgctcaggtgtgagcatctgtgcctaatcttccagtcagactgccctagaaacatcatttcttaattagctgaaagggtatctgaaacattgtacttatggtggcaagcatggatctattgctcttcatctataaagttgctgcctgataaggtagaactacacaaatgatagtttcccaactaaatgcattttaaagggcaaaggttgtatagtcagctttagtcctggcataggggaaatggactatggaagtctagttggaagagaagattgaaacatgccagtaagtgcaaaaggatacagtataatttaaataaaacacatggaagacatgaggatgctagtgggatatgatgggctcatccatttctgcaggctccaggagggtggctggcagggcttctttggtgtggggcagaaagaatcaaagcctgtagaataaatctgactccgttctagatttaactcctcatggtgtatcacgtgcaaggtgaagcctgactggcactagggaggattttgaggtaaggaagcattgtctttggttcagtccaagccctcactgactttccaccatcttcaggtgggggtgggcatgtccgtctgtctcccagcctcatgcacacacatgtgtgcacacacatgcacacacatgcatgccttcttatgaagtgtgggtctggctgcccgtgctttttccttcatctcaccatgacttatccttccctcttctattcaaagttcccacttgagagggtccagttgccctgggcacccctccacactccccactcatgactgaaattagttacagtggctttggtatactgtcatcccctttcaccagtgaagaactctattgctatagtgcccaggtcacacaaagctgggccgggtcgccagcgttcccgattctcacctctgtgtccctgggtttcctgctctctggcccagtggaaccacctccacggggtaccattcctttccagccttgtcttttgttcattggcaatgatgttaacaaattaaataggggaatatttgttcatctaatttattggtaaaaaggctagaacaagcttatccaacccatgacccataggccacatgtggtccaggatagctatgaatgtggcccaactaaaatttgtaagctttcttagaacattatgagatttctttcccttcttttctgtagttcatcagctatcattagtattagtatattttatatgtggcccaagacaatccttcttttatcagtgtggcccagggaagccaaaagattggacacccctgggctagagcaataaaatgggcacatcagatttgtgtccacaacagctgacacagtggtttccagtcaggggtaagttacccttagggaacacttggcaatatctggagacgatgtttggctgtcatgattggggaatggggtgctactggcatctagtggggagaggccagggatgctgctcaatagtctgtactagatgagacagcccccgaccctacacacataacagagaaggatccagcccaaatgtcaagagtgccaaggttgagtaaccccgagctaatgtgatgaatggtgccagatggaaatgggtgggaccatcataaggagggggaacagggtaaaggcaaccatcttaatttgtaaattgagtgtgggggatgtgttttgaccacatgcttttgaaaagggaagctgttcattctccagaagcccagcggagatgttggatggatggggccacccatagctgcattcatggacagctggacacgggcccaggaaatcttggcagcgtcactggggccggtgcacttttaagaggagcttgggtgatatgaaattgtttggacaaaatgagtgagaggtcttgaaataatgtcaaggcaggaagaatgcattgacttggagtggctgccaagagcaagcatttgcaggttgttttggggaagcagaactggctgtgttctctttgtcctgtgcacagttggaagacgggaaatggaggaggagagatggggaaggagagatggggaatcagataagaaagtgttttccaacagaagcatcggcacacattggagtgagttcccttcccttaagaggccaggagcttatgtaggaaccaagctccatctgaagcagccacagggctggagcatctcgcagattagttgccagggttctctgattctggccctgttagcctccatctggacacacagcaattgcatgtttagcatttttattacaaaagcaacatacaattttgacccttgaacgttacaggtttgaaccatgtgggttcacttatatgcggattttttttcaacaaaaatattggaaaaaagttttgaaggtttttgacaattttaaaaacttgcagatgaactccatagcccagaaatataaaaaatgttggccgggcgctgtggctcacgcctctaatcccagcactttgggaggctgaggagggcagatcacgaggtcaggagatcgagatcatcctggctaacaaggtgaaaccccgtctctactaaacatacaaaagttagccaggcgtggtggtgggcacctgtaatcccagctacttgggaggctgaggcaggagaacagcgtgaactggggaggcggagcttgcagtgagccgagattgtgccactgcactccagcctgggcaacagagcgagacttcatctcaaaaaaaaaaaaaaaaagttaagaaaaagttaagtgtatattgaatgcacaaaatatatgtagtctattttttcatttactaccataaaatgtgtacaactctattattaaaattaaaatttatcaaaacttacacataaatacttatatgccattcacagtcgaggaaaatgtaaataaatataaagatgcagtattaaatcataattgcataaaattaactgcagtacacactgtactgctgtaataatttcatagccacttcctgttgctattgtgatgagctcgagagttgcaagtacctgcctaaatcactgtgtgatgctcatcatctctgtgtgagcagttcatctctccagtaaattgcatattgcagtaaaaagtgatctttaataagtgatctcttgcagttctcaagtatttttcataatgtttagtgcaataccgtacaacctgaataacaccatgggtcccatgtgaagggtcacagtgaggctggaagtgctcccaagaagtcatgacattataagaaaaagctgaattgcttgatgaggattgtagatggaggactgtagccatggttgcctgccatttcagatggatgagtcatcttgtaaacagatgacagtaaatttatggtattgataaatacagtacagtattgtaaacatatattctattccttatgattttcttaatgacattttcttctctagcttacctcactataagaatatagtatatgatacatataacatgcaaaatatgtgttaatcagttatttatgttataggtaagccttctggtcaacagtagactattagttaagttttgggggagtcaaaagttacacatgaatttttactacagggtgggtggtcagcatccccacattgttcaagggtcagttgtatattcactgtggaaatcctaaaaagcaaagagcaacatgtttccatcaagcaggattttgccagcctctggttaaaccctgaagcctgagcaaggcagtgaaatctccagacctttggggctcacattttagggaaagggcaggtttgtgttgatgctacaaaggtaatagatgcttttgagaagttaactatgtgcgggggtggccaaggtaggccgaagcagcacctgagactggatcatcatgatgcaactctctgagtaaaggcctgagaaggaggaagccaagcaggaggcaggagaggcctcaacctggaggcagaagcacagtgtggtggagatagtgagcaaggtgaggttgcaggtctcgggcctggtcaaggagagccttgtggaggagcaatgaagatttgcgatgtgatgtggatggagaggttccttgtgagcctcactccaccttcagggtagggaattgtcagtaaggaaaggaaggaccaggtgagacttccaatacctgagagatggcggtggcttccacgagggcagcctcaggagctatggggagacatgatggcttgggaatatattttaaagaaaagctactcagaggacctggagaccagctcatctaacctgcttcaagattctccatccctgtgactgcatcagatggagctcagctcctgcacaagctcatggcttccctgcatcactgtgagtggccaatgcttctggtagaaagcacattcctttctgacttggtgagagggaagactcctgaaagcagccagggtctcatcctcagcaactgtggtgctcaatgtcatttcctcaattaggagagactgagggaggaagagatttgctgagggagtggcaggaggagtcaaaagcctcatctggagtatgtggaggtcaacttgtctgttacacatccaaggggggacgtcagataagcagacatgcagatcaggagctcagtggagagaaataaatacccattaaccaacaaatatttttgatgacttattctgcactaggagctgttccaggcatggtgatatggcagtgaacaaggtcatcctattctcacctcccagagctggccctctggtgggaagaacaagacaatactcaaattcaacagtgaatcatgatttaaagggctgctgccttatggagatgtgctgcagagaaaaattaggcagggaagggaggtatgcggcccaggacattacagaagattatttcatgtcaaaaaacatttttctacaactaagtgcacatttaacttgtgtcacaaaaaaggtctcaaaagagcaagggatttgcagtgttttcaggagctcaccagacacctgaaaaccctccttgctgaaccactacctgcccaggtgttcactgaggtgccagacccagcaggctgaggggtacaggtggagttaaggaggagctaagtggcctggtttgtttctcagtttcgtgctttggaatgaagtagtgtcacacatggaaaaaaataactgggaatgttgaattaagaaaaaatagggagcaagttctaaacactatttggaagaaaatgatccctgggaatgctaaagagaatttgagccatgagctgttcctgtagtcagagttaagcattgtgagttggcaaaagcatcaggcgggaaggactgagtctgtgtgtgcaggaggaatgcctgcaggggaaagtcacgggctccgtccctgtctcagttggtgggggtggcagagatgccacagccgtggccaagactacgctgggtgaaaagtgagactctctggatttgccatactgactgaaagctgatatctgaaaagtggagctgagaacagcagcctgggccactgtgggcagtgactggaatggagatggccatttcctgccaaggtggcctgagaaagaggaggttggagaccaggacaaggccccgggtgggtgccggtgggtgccagtcctgagaaggtatgcacaggaacaccatggacattgtttattcccccaattaagtagcccaaaaatgtgccataagctgtccttgcagtgaaccagtgattctgcccaaaccatcaccaccaacatacccaggtcaactccggcacaggaagtcacatggccagaaaagggccatcagccacatcggtgctgacactgagtgcagcacattcttctgccacctgcttgcgaacatatctgcaatgcaccatcaaagccacacagagtgtccctggcgtgtgcctggaggttgctccgggtctgcagatgctccccaagacccgaccacagcctgtctcacttcctttccattcacttcaatatgggattcatgcccaagtgccagcaccgatgtaatgattagtgacaagccaatgaatttttaaaatagtagctatgttaagatttatatgaattaaaaagtatttgctctcattttatttaaaattttgttcctacaaagttactgtctcagtttgagctgatggtgcagtctgctgttctgcaactacataaaaagtaacctgggccctgcagaggggacacaagcatcggggccaggtacacagtgacaggggtatttgagctgggtctgtaaggatgactgagatggctgggaggaagagctgcacgcctcagcagaaagcacacgtggtgagaacaagaagggaaagccacagcatcccggtgcagtccagtgtggtctgtggactgggcatgttggaataggcaggaagggctgatgtgcgctttgagggaggaccgggcagctggagagggaggcgtcaggaagcaggagggcagaaggtgaggagtgaagggcagcagtggaaaggacagggttacgccaagcagtggtcatggatatgggcagtaaggaacatgcaccaagggcgcctggaaaacgaaccttagagaacgcaagtcctgcggaggactcctgggttcctggctgggacaccgcctgggcagggaaggcagagaagatggagaacctggtctcaggtggcatcagaacccagcatccgcatcaccaggattgcaggagcagcagcgtctcaggccctgggtgtgtcagagcccccaggccacgtggaagtatgagacgtgctgggctgcaggggaaacaatggaaatgaggttggaggcccgagaagacccactgcaggaaaagggtggagtgggggaaaagcaggctgggggcagtggctggcctgcaacaaaagcattgtagaatgcaggcgtgagccaccgcgcccggccaaggcgggcagatcatgaggtcaggagatcgcgaccatcctggctaatgcggtgaaaccccgtctcttctaaaaaaaaaaaaaaaaaaaaaactgtagaaaggggaaagcagtccaaagagaagtatttcttccaagagactcatcagcacactgtgtttccagagatgtctttctgttaacagcattcttagactcaaaagtaaatgtagatatactttaaaaaacaaaaacaccttgctaagagatgaatttttagaaacttgttggacaaagaaaagtcattgatagtcaactgctgtgagaggcaagccaggaaatgatgattaataccctcaaattataataaaacccatgcctcattaggggctcgcccaggagtactgacttgtggatagacaccgtctggggaaaactctgtcgcctgtgtcaggctgatgctcttacattttatagccccttgtaggatagtgcatgttgagaagaagccgcttcacatcatcgtggtgcaggatctgtggtgtggtgtgcttcatgtgtgtgttttgtgtgtgtagtgtgtatgtagtgtagtgttagttgtgtgtactatggtgtgtgtgtggcatgtatgtagtttgtgtgtggtgtgtgtgcagtgtgtgtgatgtgtgtagtgtgcatgtagtgatgtggtgtggtttgtgtgtgtttttatgtgtagtgtgtagtatgtgtgttgcatgtagtgtgttgtgtgtcgtgtgtatgtagtttgtgtgtgtggtgtgtttgcagtgtgtgtgggtgtgtactgtgttatgtgtgtaatgtgtatgtagtttgtgtgctgcacgtagtgtgttgtgtgtactgtgtatgtagtttgtgtatactgtgtgtagtatgtgtgcagtgtgtgtgtagtttgtgtatgacgtgtgcagtgtgtgtaagatgtgtgtagtgtgttgtgtgtgtagtgtgtatgtagtttgtgtgtgtgtggtgtgcgtttagtgcatgtgtggtatgtgtccatatgtgtggcatgcatgtagtgggcatgtagtatgggggtgtatgtgtgtggtgtagtgtgtgtgatgtgtgtagtgtgcatgtagttgtgtggtgtgtttcgtgtgtgttttgtgtgtgtagtgtgtatgtagtgtagcatgtgtttagtatggtgtgtggtgtgtatgtagtttgtgtgtgatatgtgtgtagtatgtgtgatgtgtgtagtgtgtactgtgtgtggtgtgtatgtattttgtgtgtgtggtgtatgtgatgtgtgtagtacatggtgtgtgtagtgtgttatgtgtgtagtgtgttgtatgtggtgtgtatgtagtttgtgtgttgtgtgtgcagtgtgttatgtgtgttgtgtgtgtagtgtgtatgtagtctgtggtgtgtgtgatgtgggtagtgtccgtgtagtacatggtgtgtgtagtgtgtgtggtgtgtgtagtgtgttgtatgtggagtgtatgtagtttttgtgtgttgtgtgtgcagtgtgtgatatgtgtagtgtgttgtgtgtgtggtgtacgtgtagttggtgtgtgtgatgtgtgtagtgtccatgtagtacatggtgtgtgtagtgtgtgtagtgtgttgtatgtggtatgtatgtaatttgtgttgtgtgtgcagtgtgtgttgtttgtagtgtgttgtgtgtgtggtgtgtatgtagtttgtgtgtgtggtgtgtgtgtgatgtgcatagtgtgcgtgtagtgcatggtgtgtgtgtagtgcagctgtggcatgtgttcgtagtgtgtgtggcatgcatgtagtgtccatgtggtatggagtgtgtgtgtgtggtgtagtgtatgtgatgtgtgtggtgtgtggtgtaccgtatgtgatgtgtgtagtgcgcatgtagtcatgtggtgtgtttcatgtgtgttttgtgtgtatgtaacgtagaatttggtgtgtgcggtgtgtttcatgtgtgtggtgtgtatgtagtttgtgtgtatgtgtatgtgtgtggggtagtgtgtgtgatgtgtgttgtgtgcatgcagtggtgtgtttcatgtctgttttgtgtgtgtagcatgtatgtagtgtagcatgtgatgtgtgtagtgtgtttcgtgtgtgtggtatgtatgtagtttgtgtgtttggtgtgtgtgatgtgcatagtgtgcatgtagtacatggtgtgtgtgtagtgcaggtgtggcatgtgttcatagtgtgtgtggcatgcatgtagtgtgcatgtggtatggagagagtgtgtgtgtgtgtgtgtgtgtgtgtgtgtgtgtgtgtgtaccatgagggacatgcgctttgctccctggataaatggatggagtcatgtagataattttccattcacgaccagccccttttggttaaaatgtgcctccttggatacttttggggctggcaatatgtatccttctagtttacaaccatgattgagagggaatactctccatgttaaatatgcattggccgcctttctttttgcttctgaaatgtatttatttactgcaagcagtgtctctcctgtgtcagatgtcctcgtgggctgggaaccggcactatctctttagcacgggccctgcagatgggaagtggcgttgcccaggaagtggtctggagaagcggggagaagacagcctatgggccccaggcctcgggagccagggagggtgtcactcttcatgtctcaggcagtggcttgttgctatcatagccccgggctggaggtgggaaggccttatggtgaccacaagtcacagttccgtgtgggccctcaacgtggcctcacttcacctctggggctcagcaccagcgtgtgactgactgctcgaggcagcgtctcgcagctcaggtgggtgaggtggtggtagcgtcctccttggtaatatcactgtgatgaggagcaaggcttctctaacattgtctggactcaggaggagcagttggtttgttctcatgtagattctgcctcctgtatgctgctgggaccctgagggtcagcccaagagtcctgttttgcaatagcccttctgtttgcttctctttgcggtatgtttatttttagaattctttgtctttccccactccccccaaaaaagaattatttaatttggtcacttccatcaaatgctctgattttagcttagttagaaggcatgctgaaaactgtaatgatgatgtgaacagaaagacaactgtgtgttgggagggccaaagagggaagtgcctttgttcagagatgggagggtttgtctccactttgaaagggtttgagtggttttagcaaacgttccctgccacgtggggtcctcaccaaagttctctgtctctgtcttgcccaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcaggtgggccacagctggtcctgctccctgggcccagggggccctgtgaccccacacagacttcctggctacatgcaacacatgtgcctatgtgccctgtgtgcccaaataacacaaccatctccttaagcatcaattttggccaaaaaatgcctctctctgataagagcctttcctctttcacagccacagctgagagggtgggtccctttgtgccagcagtgtgggtttctccacagcagggaaccactgttacccagtgcaaggagggccttttcagagaggcattgataggtgttgattggtttctgtttatctgacaaggtcctaccatacacactgataggcacttgattttatggcttcctaatatctcttgcagaactttctgtgtcaacactcatatagttgcatcacccgttctttggctatctggtatcacctgctatgcaccacaatttatttaactagtacctattgatggacacatttgctgtttatgaataaacgctgctaacaacattgctctagacctatcgtatactacacttgtatgcaacgtctgcaggataaactttgaaagggttgggattgccacagcaaaggatatgtgtgtttatttttttattttttatttttttgagacagagtcttgctctgtcacccaggctggagtgcagtggcatgatctcagctcaatgcaacctctggctccaaggttcaagcgattctactgcctcagcctcccaagtagctgggattacaggcatgtgccaccacacctggctaatttttgtatttttagtagagatggggtttcaccatgctggccaggctggtctcgaactcctgacctcaagtgaaccatcctccttggcctcccaaaatactgggattataagcgtgagccaccgtgcccggccatgttatttttatttatacacttgaaagtacttaagtaatgtgtaaaggtctttctggttttatttactgaatgaatgagtgaataagttttgatcctgttttaccatgccaggactcgagatagattggaaatgccttctgcatcattttcatttttcctcggtatggtttactctgctttgctctccatgtggcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgtgagtatcgtgccttccccctcacctcctgccaccaggcctgtgtggacaattgggaataattcagcttccttgtgactggccccacatgaccctgggaagaggccatgcattgccatttgacaacatgcatgctggcctgttctaaagacatttctaaccaaagctatcacttgtgacccagtgtttattttgcccagtctaactctaaaatgaacactctttttgggcaccgagggatgtaatatttaaagaaaatgtgattcagccccatattctccttttaatggcaaattataggttgcatagcacattctgtggttatccaactaaaattaaaatactgcagtttttttactcaaactacccccttgatctcagactttacttctattttacatgaaacaagatgccaacaggaaagatgttaaggaaaagttcctgggagtagcatccatgagtggtgagtgcaggtttgaagacttcagccttaggcccacagtcattagagggtctgtctgaatcctgggttctgtttgctatcctcagtggttcagtgtaaatctaaattgtagaaggttctgagatacaggccaacgtggtcagtcagttgtccagagaaggtaaagaactgtctttgggaggtgtcaaccttgttccctcgagggggtctggtcaaggtggctcagtggggcagttgtccctgggggaaatgatcccctggtcacctctcagtgtccctacagagatgcttaccttggaaacataaccagaaacagcgatgcagcctcatggtttggcaattggtgaatccccagccgacttcgtaaacttttcctagatttagaagcgttttctctgcctgtccatctattcaaaggaatttcctcagacttcactgtcataccttgtattttaaaaatgatcttagctgagtgcagtggcacgcacctgtagtcccagctactcctggcaggaggatcgcttcatcctcactatgatctcactatcgtttgaggctagtttgagaccagcctgggcaacatagtgaggccctgtctcaaaaaaagaaaaaaagaaaagaaaaattgaccacaatactcttaaaaaaaaaaaaaaaaaaggaagaaggaagagtggcccaggttgccacgcggcagtgcctagagtgatggtctttagtgggatgcagccccagccagcagcagaatgctgtggggagggaagacattgcccctcagtggaggcacctatggctatttttgctgaggtttggcttcttaccatctcagcaataatttccaacatgaatgtcatgggaccatgcacatagcatcttggcatgtgaagtcaacccaaaatagcataatccacacgatgaggctggccaacttctgctggttaagaagcctgctcatagcctctttggccacgaagctgtttcttttttcggagttgtctattcccgaaaacagcagttgcatccttcatggccatgacttttgctctctccttcctttctgggagatgtatataaaccccatgcagaaggctgggaggtgcagctcttgtttgatgaacatgccttgttccctatctgccctgtacagactgacatctcatgtgtcctcacagcacatgtccctgacactgaggcttatggtttatgcaagagagtctcaaacttgccgtgcttcctattcagctggtgtcagagctaaccaggcatgggcctgtgagagaggggcctgggcttctgtgttttcatcgagcaccctctccttagttgtcttcttctcctgggttcttattcctgggttcttattctcctgggttcttattccactttatattgcagttgtccagttatcaccccataattgccaacctcccagataatagcttccaaggctttctcccttgtgttgtccacagctcagtcccacaccttcccgtgctccctccacacctgcagggctcacctgtggactgatggtgcatagcaccccatgcccaggcctggcatcaggcagggtattagtgagagggaagagcagagctaagcctgggcagcaagacccagcttcagaacccatgttcccatgatggttgtagaaccttagactaagggaaactttccccaggctctgctcctctgggtctgtgactgtcttgaggattcaatgaaaatacacaccacgtacaccgcacagcacatgtggtcatcactgatgtagcttttcttctctcttcagtgctctttctccatcatgagcaccaggaaagtctccttgtcagggtatcttatggtgtttttaacagagaaagtgtgaggaaacaccttggaggggtttgccacctggcaatttcacctcttgacaacctttcatctcctacagaacctggctggggttcttggctgttgctgggtgtgtaaaccttccttgttgcagtgtagtgggcgtgttatactgtgagtgtttgaatatggttgtgtatgcttgtggagagcagggagagtttgccagcatactggatacagtccaagtctaccatgcttccagcacggggcagggtctgcatccctgaatacaacgtctcccaagtccaggttgcctagacgttggtccagattctttcatctttagaagtgtttgtttgtgtgtttctttcatgggaaatagagctaaaaggctccagggaactcttgtaaaccatcaccagatcctgtggctgccctctcagtgtgagtgcgtcagctcctgattcactgtgggagtctgtcctatattcccctgttgggtcaggccaacgttgcaggaagtcccagacctggttttgaatcatccaaatctgccctacttgcagatagttttataaaatgcacattatttgcaacgaatagccacagcacaaggtctttggagtcagaactagattccagtcactgctggatgtcctcactgagccagctgctgtttttttcccactgttcttctcgggccttcattcagattctcctaacgaatgtgctcatgtctactttccaatcatcatgtcagctaatccatccatggaccaacattactggagtctgtagttgcatgaagcactaagtgccaggcaccattctggactttgggaagggagaagtgaatcagcaagcacctgccctcatggaccctgcatttcagtgggagaaaagacgctgaacaataggaaagaactgcatttaagtaagggcgtagagcacactggggtatggatgctgggtcttctttctgctgcgtggggaggatggaccttgctgtgagggaggccattgagaagaggcctgaaggcagcgaggaaccatccccacccagggaatggcaaattcgaatgccctgtggcaggagcgtgcctggggagcagggcacccacagaggccagtgtcactggcagagagtgagtggagaagggtggagttgagggccaggttgcagagcactcacggcactgggaggaccctgctttgggcaagttgggggggctgtctttaggaagcaaagggccagggccagctgacattcggtgggctctgcctggctgccacatcatcggtttgctgtggggagttgtgcctgtacatatacttgcaaaccaaatgtgttgatttttttatcgtgatttcagggccttcactttctcatgcctgagcatcagtcagtttgtctccgctctgatctcctgtccaccccacccaccgtgcttttacctgggtcctgtacaggcctgtgggctggcccttaagaggttttcaatgaatgcttgtcacctaaatcaatgaattgtttggatccattctccatctcccagctcgtttttgctttccacttcctgacatgtagtaataccactgtagttctgtatgggggcagctccacacctgtctatgttggggagggaatggggattcttgcacctctttctacctcctcttaaatcattactgatggacagatgcagggacacagcaatagatatagaaatataaaaacatgacactgcgcactctatggtttgtaagattcactttctctgggtaggaggcagtgtggcctgttaacaacataccattcgggttgtctggcctcaaatgctggctccaccttatcaccagctatgggaccttgagcaagttactcagtggtctgtttccttcatttctttgtctgtaaaatggctttaatgtcatctctgactcttagagtcattgagggttatagagtatcataaaccgaaggcctgctgcacggtgcttggcaccgaacgaagcagcttcaccccactcctgcagtggcctggaccacacttggatacatcagtaacatacactgaaggtcaggtcctccatgcaaactctttccatccctgcatcacaggtgtaccatgacctctgcaggtgagtcattcttctgcaggtgagaaaaccaggcaggtcccccttatccttcccttctcttcttcagtctgcagtaggtgtgtttatttccactctgtggctatgaatagatagagtgagagtcactggccataaaaggattcacactaggcttttgcttttatgaagtgacagacttaaataaagaataattatttcggccgggcatggtggctcatgcctgtaatcccagcactttgggaggctgaggcgggcaatcacaaggtctagagatcaagaccatcctggccaacatggtgaaaccccatctctactaacagtataaaaattagctgagtatagtggtgtgtgcctgtagtcccagctacttgggaggctgaggcaggagaatctcttgaacccaggaggcggaggttgcagtgagccaagattgtgccactgcactccagcctgggcaacagagcaagactccatctcaaaaaatatatatattattattattattatttcacagagggggttggaagtttatttttgcattgcaagccataaactaatcaagaggattttactagtttggtggataatatgggtaaacaaaatcccagcgattactcttcacactttcatcgtgagtaccaatatgctgtctccaccattcagatgccagcatttcagtctgagaatcgctttacgtggaaagtggcattggtaagaattggactaaaaggtaaaaaaaaaaaaaaaagaattcctgaaatgcatgcacctccatagccatcacaaaatgcctttgctcaaacagaccttgaaaacactgagggtaaggcagcatattttggagatcaaaatctgattataaatcctaggtaatgcagttcaaaatgcagatgatggaagcagattacgtctgggagatgctgtccaactcggatcccagttttctctcctcagaactatatgtgaaatccacttacagtgagagtacacctgagctagagggcatttaccacttaagggggctaaacttattgtttttcaaacaagaactcgggtgtggaggagcttgtccaaggcaggaaggcaaaaccaggtccctgatgttgtctggggctaagcagaaacagcagccagcaaccaaatccatctccagatggatccatctccacaaccacaggcccctccctattccccatgcaagatgcagcaccagggcatgtccatgtgaaatctcagaacacacagaggcgtccatcagctttcccctctcttgtgtcctgtccacagagcttacccacaccattcaggagtgactttgagaaggtagttacagggcctttgcacatgtgcttgaagaataacgaatataaacagaggctctttgtggaggggctgggcagtgtgggtcagtggttgtccctcacagccgcctgtggcatttctggaggtgatgttcatcacctggcctttgctatataagcactgcccttgtctggggtctagctggccagaagcgagcactggagggggagtcctccagcccacgtttggtgggtgagggtcagagtgctgccttgttggtgacgtcagggaccaaggcaagggagaggagctgagtggggaaggagatcccctgcccccagaggccttgtatagcagcacagtttgctattttgagaagctagtcacagctgtctgtgaaaaatgaatttgttaggaaaaggaaacaaagcttactttataaaaattatatatcccttccccaaaagggaggatccaggattgaggggtccgaagcatatacaatttgaagactctcttatttttttaaaaatataaaattaggcatacaatagaatgtattttttggactaaggaaaaaaattcaataaattagaatttttttaaaggctggtcaatactacaagcatacaaactttagaaaagataatgtaatattttaattaactgcctgacacgtctctataacaccttttgtttcctccatgtccttgacttcactgtgtttgactacatcttagttcaacaatatttaataatatatttgtctatatatagaaaaagagactattcattccttcctctaggttcacacttcattattaataatatcatgtacatttttagaatccttgtcaaatttgggaggggaagataaagtagaacagagtgagcttccctggctgtgactaaaatatcttttgcaatctgtacaaaacctaaggccgtgcagtcacattgctgggctcctcttggtctggaggaggctgtgatcaactcctctctgaccctcatccacttggttcacacaatgtggtttattgccattgtgcacagccaattctcccacacacatcgctctgctaaaatgtaatgggatgtggccttcatttcatcttataaatgatcttagaatggaaatgctctaaaaagtccatgccaggcaaaattttaaagatggaagtattgtttctttgtattaagtgtattgtttttggctaagagtccttgtaaatcttacaaagccaagaacaatttcaaggtgacctttaagacacataagtggctgctctccaaatagctcgattaatgttaaaaataaaaggtagtatttcagatttgtggatggagtcgtccaaccagtaagtcaccaatgctattttaactacagtttctaccttctgactttagaaaaaaaagttacaaaaacagtcattcattcaacaaaataggcatgttttcaaccagacatgcagcaggcattgtgataggacttggctactgtgaggaataagtcagaccttagtccctgccctcaccggactttgactgcagggggaagatgacaaacgcaagctgatgtgctgcaaagtctgcaatgcatggcagtaggtcccctccaccacgacactgggcctacgcagcatgatcttgattttgttttcatttacttgtttatagtccccacccccacttgtgctggatgcacaagggcagagatggggctgttgccttcacgagtgcaacccagcacctagaacatggtcttggtgggaaaaatctctctgggtaaaggaacattctggctgctaacttgaatggtggccactacttggataggaggagggacaacatggttcatcgggcctgtctcaggtgcccaggctggactatcatctagtgtgtcgctaactataggaactgggaagtggccttcagagcaagtgggctgactggatttggcagagcttgacacctcaccaggcagatgcaacaaaagagcagggcagacccagccatcccattactgggtatatacccaaaggactataaatcatgctgctataaagacacatgcacacgtatgtttattgcggcactattcacaatagcaaagacttggaaccaacccagatgtccaacaatgatagactggattaagaaaatgtggcacatatacaccatggaatactatgcagccataaaaagtgatgagttcatgtcctttgtagggacacggatgaaattggaaatcatcattctcagtaaactatcgcaaggacaaaaaaacaaacaccgcatgttctcactcataggtgggaactgaacattgagaacacatggacacaggaaggggaacatcacactctggggactgttgtggggtgggaggagcggggagggatagctttaggagatatacctaatgctaaatgacaagttaatgggtgcagcacaccagcatggcacatgtatacatatgtaactaacctgcacattgtgcacatgtaccctaaaacttaaagtataataataataaaataaaataaaataaaaaagaaaaaaaagagagcagggcagcaagagattcacggggtagcatgggtatggtggccagggcaggcctggatgcctgcaggagagggagggaagtgaagcggtggatgccgagtgggtgtgcaggagcccgggcatctacagaaccccagtccgagccccaggaggcagcaccatgtcatggtcacgtggtgccctgagaccattttggtgccctgagattctatggatggtggcagagttttccttgatggtggcagactggccgggtggtggagggattggcacgtggctgccccaggccacaccatgaggtgttgagagagatcctggctgctcagctgccccgagtgtgcagcatggagcaggggcggctgctctgacggctcacagcaggagaggcacctggagagctgggctgtgatcaggcccagtagtttgcagatgtctggagagaaactgagtcagagaggaagcccaggaggttgtgagcctcagcgatctgagaggcatgcatgttgaagagtgagtgaggaggatgggaagcctgcaggcttggtgggtcctaaagttgcaagaacatcactgtcccctgcagctaagtgggcctgatgtactccactcaggccacagttgctgtacatgatctcttgggaccctagaagtgctcctttccatgatagctctttaatacattagttaaaacgattcccaggaagcccttgttccaagtatgcaggatcagataaaaagcgcagaaaccctcagagcagggaccgacggtgagtgcagtttgccctcagaggccttggtagtcaccccttcccaacccccatgccaccactgaatccccatgtggcttgttcttatatgccctgcagctgaaattcaggtgccctcctgaccttccttcccctgtccattttgaaaagaaataagcagtgtaatctttgagtcatcccttttgtactagccaagttccaggtgcagcatgacacactcgttatctccacctctcttctccccttcctttccctcatgtctgcacacactcccatcccctcacttcttccccctacagcccgcctctctctctctcacacacacacatacatacacacacacacacacacacacacacacttgagaaccgcggctgcatatcatctcctgtggacctgtgcacaacctgtggggcccaacttaaagtactgcatccattctccgtggtttatcctaatttaggtttgtttcctggtcatatagaatactgaagtatatgtctttaggaactgtctcaatttcttagagaaatgggatatacgtgaataaaatttttatgattcccttatactgagtcccacttgcactgcaaaggattaataacatctgtttccaaagcaaggcgtcacctgccatgcaagccacctgctggggaggggaggtgaagggtgtgagcattggtgagaggtgttgttctcatgttcaaggtgacaggtatgttatctggtgtccccaggctgggtcccacccagggcctgctcctggacgagggctgtatggctctgatttgcacacccctgattctggtggacacaaccctttttcttagaaagccagaatcactgtatcttctagtccttagctgcataaaaaaatggggtgcaaaacttctctggactgtctattcttattgttcattggtttatcctgcagggccacccatggagcccgtaacttaagatgcacaaatgagctattgagtgaatatgtgtgtgtgtgtgtgtgtgtgggtgtgtgtgagagagagagagagagagagacagacagagaaaaagaaagaaccatctggagggctggcaaaagcacagatgtctgcgttccatcccctgagtttttaattcacaggtctgtgtaaggactcttccatttgcattcctgccaagttctcaaatgatgctgatgctgctggtctggggatatggtgtgagcctgtttgagatacctgttacctacctgggctggattaacaactatgatcatttgagattttcatagttcattggagggtctgtaactgcatttgcagttgcaattcctgcaaaatgcccaaatactgtattattggactggttccgataaagttatctttgaaaatgcctctatttctagaaacttaagttagatagtaaagaaattcaggccatgagtcagacaggccctgccacttaatagctctgtgatttggacaacttaattttgctctctgagcctctgtttcctcagtaataaaatggggagactgatgttttatctgagtcattatggagatgacttaagtaatgtgtataaagctaagccaatggttctcatgtctctgtggttcctacatccatgaattcttttctttcatcagttctgaaaaacatcttgctacttttttcttcaaatattgctctctgttgttcttgcccatttcttccttcagagactcctattaaatacagtttgaccttctcaattcatcctttatattttttattttcccttgccttttctgtgtcctgtgctatgagtaacgtcgttgaattattcttccagcgcactaatttttccttcatttgtgtccaatctgctcttacgctcattcactgattttttttaattacattttttagaaaatttctagcagttctgtttgtttgtttgtttgtttgttttttcaaatatttctggggcatttttagagtatcttattggttgctaatttccatggttccgttttttattttgttaaacatttcatagtttatattctatatctgattattctactaccgaaacttttggaggatgtaaatctctctctctttccctccctaccccttttctcataactcatgcttccttatgttttcagtgatctttctgagcttatgcctgattgatattaatctgtgggaatcctgagtattcgatgctgggaacactttcctccagagttgaaggggatttcctcttcacaggtccttgctttaaggtgggaatcccacatccaggtgctcactgggctgctggcctgagattctgtccctgtccacagctgtgctgatattggcattggccctttggccaaacccactttaattgctctcatttgccactcactttttgctgttcaagtttcaactcactttttgtcctatacttcaatttcaaaagtgaatttgcggcttaggaaaaaccttttccttgttcattgaggaatgagactgtgttaggctgtcacgagcctcctttgccacaacaaaaactctgttccatcagtgctttcatatgctgccgtaattgatcaaagtatgccattttatttgacacatgtggttttgcagacctaggtcatcataaagagtcatgacctgtctgaagttaaaacttcaaagagagttgtgggctgatgtcaatatcacttcattgatgctgatcaaagtctccttgaagctgaaagacaagatgcgttaaataattccaccttcatgaactaaagcagagggagagaatgagagggcgtttgtaataaaatgttttaaacgacaggtgtgttaaaacagcttggtgtggcctcagatagggattgtgtactgatcttgctcttctttgtgtggaatgcacatgtgcctcagtagtgctatggcgcaaggcagaagcactcagaagttgcattatctatatctttcatggatcagtaaagctggcatttctcctgcctcttgctgacatacacactgttcaggacctcattcgctcccacatcctcctcttcccctctcccagctctctttgagaaaccactgttgggagatggctctgagtgagaactgcccacccaacccagcacaggccccctctgtccatctgcccagcccaccttagccacagtgagcattcatcctttgcacatctaatgcacacagccaatcccaggcatcttccttccccttgtatgagtctgacaactgacccggtgatactctactctgccatggaaaaaaaatggcaggggagaatgagaacacctagtgggctggaatgtgcccggcttttctgttccgtctacagcagatacaggcagtgtccccgtagccctggggaggccaccttgagtgcctcactacttcttacatcctcactttccccttggtgcccgggcatcacctctgtatattctctctcccctaggagggtgcaggagagtagaggagtccagcccttccaggccatgccccagcagagtcaacatgcctcacctttggatagtgttctagtgtctgtgaggcacaaggcctgctcaccccagaggccaaggctgcctaccctgggaaagtagacatgccgcaggtcaaggactgtctcaagaccagttaggacagcttctcagcatcatctcaagctcaagccctggaaatctcaggctttgcaatagcaaaacacaaatctgttaacttactcctcccaagacaattactgggaaaaaatattttgtaaatattcaaaggcttctgtgaacagcctgaggccagatgaccctgaaggcggaaggcagcaagccagacaggagccaggagccttgcctgtgtgcacgccctctctgggtgtctgtagagccataagcctgggtgggtgtcctgatgccaccaccagggcaaagctctcagtaagaggacacagccaagaggaggagcaagccttccaaatcagtttgtctcctatgtttaattaaaaatggcctggtccaggatctgcctgcagccaacagatacctcacagttgctggtggttaatgtcgcgagccttctggtctttgccacctacagatgctgggcctgtgggtttcctttctctgctcttgtttcctgccacctgccacagggggctgcccaggccacatgtccatggtcactacctataccttccagttacctgttgccaggactggccagggctgcttggtggagcacaggaagagaggggatcgcctgcagaacctgtcctcttgaagagcctcaaggaagtgaggcctttgcagaaactgcttgttccaaagcaaagggcactctctgtttcctctgggttgctctctatttcctcctggtaccagctctctttttatactgcttttattgtgaaatataaaacaaacacataagagtgcataactaaataggtacaacttaatgaatgattatcaagcaaacacaacccagtcaagaaatgaaatgcacccagcattgcaggagaccactccgccctcacacactcatacccatctgtacagctggcctcctgggaggcaccacctcctgaactcttgtgttcatcacgcccttgctttttttgttatttttcatttgtttgtttttttagttttaccacctaggtgtacatcactagataaaacaggtggcttttgtctgtttggggactttgtgtatatggtagcatggagtgagttttatgtttgtgagactcatctgtgctttgtatagctaccatttgctcattttattgctttagaatacagtattgtgtgaattcctacaatttacttgctctgtggtcacttacgttgtgtgcagtttttgataagcacagatgaagctgctataagtagccttggggtgcatagtgcacacatttcatacacctaggggtggaattgctcattcacgaggtctgtgaatgaataagttcagtttcaggagactgttccaaattgttttccaaagtgggtgagcccatttatgctcccacaagcaacgtaggaggggccttgctgctccccactctcagtagcacttagaatgatctttctaacttccaccagtctgaagagcgtggaatggtacttccctggggtcttcattcatgtttgccagatgcctaatgaggttgatggcatcatctctcagggaaacctgtgcttgtctgtctcagtttttaacaagaaaatgtcaatcaagacatagggtaagatggagtacagcagattggacatggattcagaaaccagagttcagatcccatttattactactatctttttttctggagagatggcgtctcactctgttgcccaggctggagtgccatggtgcagtcttggctcactgcagctttcacctcctgggctcaagtaatcctcctgccttggcctcccaaagtgctaggattacagatgtgtgccactgcacctggttcagatcccatgtattatctccatgaccttgaggtcacagacgtaaaagattaaattataggaaatactttggagtgacatattgtcaccattctttcaaggccaacttttataggcatatgcatccactcttactgctgtagtatttggatagctctctataccctcaaactataagccactgatatgtatagaataaacataaatagtctcactttataagatactttccctataaaacagactcagttctctctttatatgaaaagattaccatgtggttttttgttgtgttgtgttgtgttgtatttaacagtcaccaactgctggctgtagtcggccatgtggctgtgaaaagggagctcacaccttgggcgctggcaactcggttggtttgggaagaagaggttgttctcacagtggggaggtttcagcacagccacctgctgaggccacagagaacctagatatgtgtcctgtaccctggccagctgccctgagctgtggggtgctgtgcatggccaagcaccgctagaaaagacacttattctgaatttcactcctcccatgccatcgttcagctttcaagtcttgggttagctttttgagataagtctccatggcaagggacaggaaagcatggccatgtccagttctgaaggccatctcaactctccctgtggtcgtgtatctgacttcttgcaaccaggaggaggcatcagaaatttccccagtacccagacgtcccaaggcagttgggcacacttgaactctgccccaagtacagtgcatttgggcacgtggcttaacaattttggacctcagcttcctcattttagaaaatgcaggggccaaagaggcttcctgggacttcatgactcaccctcagaacctaagatctcatgaaccaaagggctgcagctgtggagaggggagaatggggcagtgtgtgtgactacgaagctaaactgggggattcgcacccatttcgtgccttttcagcctccactgggacctcgaactccccaagtcccacaggtcttccaggggatctctcacctccccatgagtcataagccttacgtggcatgcactgcagtgggggtgttgttccctgcctggcatcagactcctgtgtttctgttcaccaggacccagggcagggggttgttctgagggtcgcccagcattaccatgaagacagagccttggctgctcagcacggccagcacagctctggtttcacctctgtctcttcaccccacagtggatgtcattttcttctcctgggggtgttacccgacaatatcatcatttgaaactgtttgaagtccagccctgcctccctttcctgcattgggagcttggaagtccagccctgcctccctttcctgcagtgggagagtggaagtccagccctgcctccctttcctgcagtgggagagtggaagtccagccctgcctccctttcctgcagtgggagcatgggagggactgaggaaggcccgggggatggaggcttccataaccctccatctctggtccagaagatggctggttaaaatgcccaccaaacacccccacccacactccaagctaggtggtagagctgtccatcttggatctaacccaaatgcaggccctggtgaagaaaggtgagtccacagtgctccacagataatcagggcccgtggtgcccctgtgctcatcaccctgagaagcgtcactgctactgagcaccaggctctcctgaccactgcccagagctcctgggccctgctagagcttagccatggtccattcatcaccaacctgctagcatttccttgttgcaagcttgcccactggcatcatccctgagtggtaaactgggccttcctgggttgggtaaagcccttgaccctgaggctccaaactctgccctccagctgccttgccaggtgacaggccccagagagcggctgctgaccattcaggccagggtgcttcctcccagggtcccacctggagactggcgggcctggggatgatgcagttccatcctctcttctaggatccgagccagagacaacaacggctcctacgccctgtgcctgctgcacgaagggaaggtgctgcactatcgcatcgacaaagacaagacagggaagctctccatccccgagggaaagaagttcgacacgctctggcaggtacccagcctcctctccccaccttgtgggtagagtacagggcacgtggggctccttgtcccatggactcttagacatgagaggaactggaccacccactgcccacagtgtggtccccaggccagcagtagctctggagctcatgagaaacacacacctggaccacacctgggctcctgccccacctgcccatcagaccccactttcagcctccaggtggcttctgtgtttgagaagcactggtccagaggccgtcatgtgaggtgaacgaaggttccatggcttgttcagggccactcagccctcagtgccacaaggtgatgtaagtgcagggctgtgttcagagtttaacaagacactctctttggagatctagaaaatatttcttcctaggatattctaactagagcccagaacagcctttcagacaaagacacacaaaataaaggaatggatgcctggggaaggaggcctaggaacagccaagcaggactttgttggtggtgtgagaggctgaattagacagcaaatgtcaggtgccctcctcattgtaaatcgagtctctctctgtggaaactaaggcaatttaggaagcatactccctgggctccaggctgctgcttatgctgattgccacagccctggtctaaaaagtgcttattcctgacccagctactagaaaaccctgaaacaactcccaatttggaagttccttaggcactaatgagcactaaaataatgctcatcactgctttccctgaatcgcagtgagcacagattgcttgtcttaattttgcatcacagctacactggctgatgatgaaggaaataaccgtaacagtacttcgtgcatcatcttcgcagagcatcctataaactgtagtaggttcagaaacagggagaaagccaaccgactctgccaccaccccaccgccccagagcaccagctaccttgaacatgtgtgggtgaggggcataatcagggcgtgttccaatgtcctcacccaagcccagctggggccacacatgcagtcaatgttgaggaaaggactcaactcaaaatcctgtcttttcaaaaactgagactacagagccttagcccctttaaagcacttaaacttactacttccaaatgtgatttgctttctagtgctgtaattggaaaaaaaaaatactccttttttgaatgctggatatgatcatattaaaaaatgttagtcacaacatttacattgtcttttgattttgtggctcattgccatttgtcatcattaaccacaggcttctttcttttaacgatattgattcgaaagagtatttaacctttctacactcaaagccccaaagcacatcagggaggtgagtagggaatgtggccttctggaatgcaaaggcacctggagtcctctatgccagcttaatgctccaaggtcccaggccccatcacttataaacagccattcattcaccttctcctgaaagggcattttatgtgtgtggcgttctgtcaccatttcaaaggctgagcactcaccatagtgttaagcatctctaattattgagaatgtccttcccaagaatctttactatttgtattgattcccctggtagatcatagcattcatccctaattaaatattcctcattgtatattttctaggcactgtgtttaggaaactacgtcaaaaatgccagcaatacgttccaatttcccatgcatgatttcattgatttttcttgacagcgttctaaggtacttctgtaccctacccaactccagggccccagtgctatttcacggagagttggtgattgccataataccctatttcaatattctttactgtagaccagggatctgcaaacccacagaccaactctggctctcagcctgtttctgtgtagtccctgaagagaatggtttgtatgctgttaaaggtgttgttttggataaataaataaataaacaaaggacacagatacggtatgaggcccacaaaagcctaaaataccactttctggccctttacagaaaaaatttgctgcccctagcccaagaggggggatccctagctgtgggcccacttccccagccacccttgtggagtggacttaagcacataaaagcatttatgtgtcttggggccacttcgaaagcccaacagtcagtcagtagctctcagtcactatttgtctatttcctgaccttggtatttaccactttcttacttttttctctttcagctagtcgagcattattcttataaagcagatggtttgttaagagttcttactgtcccatgtcaaaaaatcggcacacagggtgagttcccaagacactggagtctcagtgtttgaggtatcagtgacaatcagcctcattttagacttagctgattgcagatttgggttggatgaggacttctttttacgggttgattaataatgatatcagagcactccgattttgtatatcgtgaatcaaaaaatagccagttgctttaactttaaaaaaattgtaatttatttgtcttcattgcatgcgggaaaaagtaaaagagggtcgaaagaagtacctgcagaaagcgtgctcacttctcaagcagcagcacatcctgatctcattgattgatctgcagtggggaggggaaggaagtggtttcctcagatagagcagtaattgtccatgctctctctaaccaggaaatgttaattttggaggccgtccacaacttccaggttcccatcctgcggtaagtgtcactaggaataccactgaatgagaagctgttgcatatttcacaaatgaaaagcatgttttagctaacaggagtagtaggcattgatattttgattgcgcttcaaaacatactccgtgatgagctgggattgctagtgagtgttaggcagaatcagcctcctattagtgataaactaaccacattttcttttctttttttcttttgctttttttttttggagatggagtgtctcactctgtcaccctgactggagtgcactggtgcaatcacggctcactgcaacctctgcctcccagcttcaagccattctcatgcctcagcctcccgagtagctgggattacaggtgcctgccatcacacccggctaatttttgtattttttagtagagacgaggttttgccattttggtcaggctggtctcaaattcctggcctcaagttatcctcctgcttcgacctcccaaagtgcttggattacaggcatgagccaccacactctgcctagccacattttcttaacttcttgtctagatgaaattctcttcatttttggagaatatacacaatgcgaatgaaacccaatattaaatcagaagtaggcctcttgcaatatttgagaaatgggaacatattttttaacttcatccttgagccgtctatgttaacacacgtaattcacaggacctcagctgtctcctccctccagcctgttaggaagtcaggtacagatttatgctctaagcaggaattattttcctgctcttttcttggggctacatatggcctttttttttttttttttttttttttgagacggagtctcgctctgttgcccaggctggagtgcagtggcgcgatctcagctcactgcaagctctgcctcccgggttcacgccattctcctgcctcagcctcgcgagtagctgggactacaggcgcccgccacaacacccggctaatttttttatatttttagtagagatggggtttcaccccgttagccaggatggtctcgatctcctaacctcgtgatctgcccgcctcggcctcccaaagtgctgggattacaggcgtgagccaccgtgcccggcccatatggactttttatgccctttaatgccatctgtgaagtgcgccctctgcacctcactttttgcctggtaacccttgaaaaacaaaatctgcagaaagccaaatatacatcctgcctccagtagggacaattggctgcccagtagctgagcccaggttgaaacaggggaggctgtccaggggcagcacttgttatcaaatgcagggaacgtgaatttgctaaaataccagtgacctttgggatcaaaatgtaatgcctttatggaagtgtgactttattttgccctttacagggctcacaggcctggcaactctatcttaatattataggctcggtgagacagatccatacacccttcagatggatgagggcttagggctgagaactcttaaaagaatgtcaagccctgtgcttagccatcatcacccaatgactacaagaagttagatattttggaataactttttaattgactggtaagatacatacgggaaaaaaaaggcatacgccctatgtgtacaactcaattaatttccacaaaattttccaccgtggaaccagcacccaccatgaagaagcaacacaactgagcactcagatctacttgtagtttctttcggtggtttgtcttgagcttacaacttaataattccacgtgaagcatgagctagtgaatgtaacagctctaattttgtagccttcagtggaacatatttcccaaatatatttctagatccttcttcccaagtggcaggcccttccagaagccttcccaatgatcaggtgttgcccgtggtcgatctcattggcagggacaggagggggttagtggtgcgattatagaagcaaatttaagtagcatgtcgtggaagggatcctgtatttgttttctgaaacatttactgttcctctttgccgttgtggtttctagacttggtcagcgggtggaataatctcaagaatcaaatcatactccttcccaaagcctggccacagaaaggtgctaaagcaacccctgcttgctgtccaactaagtggtaggaccaacgcgcactcagctcccgcccgcccagtctgccctgtgtgtgcgctgccccccatctcttgccactctgcttccaggcctctttgcccttgctcacacctgctgttcctgggcagccgcgccccaggtacatcatgtgcttttcatgtgggtcctcagtccgtcagctggaagtccaacagtgtgagcatgctttctgtgctcaagcgtcattttaaagtcgtttcagttggcgtcatccgtcatagctaattatcatgtccgaaaatcttttcaaagatggcccacttactttttggtggccagactcacgtgttgcagtgttctggtaattgattatgtaagttacgttgtgatggagggaacaccaaggttttgtgaggcgcgctgcacagtgaggtcaggcagtgcatggtaacttcattatggcttagacgtctaacatagaactgcaaatgtgacatgtaaagaagaggtgtaatctgaggtctagaaaaaccagttttctttttgaggcagtaatgttgacatctcattgatttccatgttttgttctattattggattttgagggaaaataaaaataagttctttttcatgacttttatttataatgacttatttattccttcccccaaaatatgtatatataatgtgtttgaattgctttttttccattctacttttattatcagtggggtaaaattggttcttttatcagtaattctttttattttcatattacttggtgtttttaccgacattttagcatataattgagcatccactcatgaaatagattgcctaaagtatttactagaaacaacagaaataaaagacataaaacccttgagattttatttagtaataattttccaagtttactcatactcaagaagttctcaatcgtgttgaccacagaacagaaagatttaatgcagtgttcgagaggaagaaaaggtttattttacacttgaataaagtaactatgtctgtttttcatgtttacccaaggcaaaacacccccacagattactcacagtggctaaagaaatacctagaaaataagttttggtgcatctttagactacaggagaacatgtcagaaaaaagttgaagaaaatatcagtgaccacctaaaaataaagaagtatatgtgtagataacaaccataacatcatcaaaagagaaatgagaaactgggagtaagtagcactaatgctgacacatagattaatagctttaatatacaaagagattctaaaaataattaacaaaaatattaactgtctactaggataattggcagggaatatcagtagtagtttatagtaaagcaaatataaatagttcttaaacatatgaaatgttgtttaacttcatgagaagagaaatgcaagttaaaactatggtgcttaactgtgtccacctatgatccaaattttaaaagcttgataacactgtagtaaaggcatggtagataagcactttcactcttccttggggaagtctgaaatgatgcaatctgtaagaaaggctctgcaattttatttctaagtatgtacagatattcttgcatttgtgtgaaatcatgtacatgtgaaggtgttttttccaaaattgtataattgacaaagtctgataataatttaaatgcctatcaatggaaaacaaatgaaattggttacagtaaaattgctactatgggaggcagctgagatctagaattgttttcaaaatataattttaagtgtaaaagtcaatgtcctgcaacacacacatacacatacatatatgcagaatgtgttgatatcgtatacagtatcctagaaaaatacagaaaatgctggcaatgctggttgcctctggagtaagagatgggaatgttaagaaatcccacttttcattgtaaactctgttgtatctttttaaatttgaacctgttaagaaattttaatcaatttttttaaaacagaaaattaaatagtagagagtaattaatctgattaatattgtgaaaatacctttctggcaaaaaaaaaagtttgctttctatttaagtttagaagaactttaaagtatacattgaattttttatagaaataagaaactggaaataaatattactaatgatgacacatatataaggccaaaaatatcaacagataatttttaaaagatcaaggttgtaaggtttaagctatagattaaaaatattttaattgcttatcagaaatattttagagctaatatgtatattttcacaaacaaatggggaactttccattatgtaatcagtcatgagaaaagaattgtgagaattatgtcaaatgtcccatcatgttagctaagagataaataactttcttgaacttgttaatttgctcagtgtacatagttgttttaataattcaggcacaaaaaatacatgttagaacttgaactacctatagcatctagatagttaatgaaaagtatgtttagatttgaagatgattatgaatcagataatttaaatttttcataaaattactaacaggctgatgcattttaaacttgtctttagaaattagtagcttactgccaagcacagtggctcatgcctataatcccagcactttgggaggccgaggcaggtggatcacttgaggtcaggagttcaagactagcctggccaatatggtgaaaactcatctctattaaaaatacaaaaattagccaggcgtggtggcacacgcctataatcccagctactcaggaggctgaagcaggaaaatcacttaagcctgggaggtggagattgcagagatcgtgccattgccctccagcctgggagacagagcaagactctgtctcaaaaacaaaaaaagaaaagaaaagaaaagaaattagtaacatacttataaagtataaacaaaattaacttaagaatacaactagtagtctttaaatgaattaaacccctcccaatattagtcctggaatttctttctctgctgctttaagcacagaaccttatccttcttttatggaaaataggtggaaattaaacagcaacatctctaaaaagacttccagggaacttttcagctttgcatttcaaaggcacatcccctaagaggattaaactgaaatgtgtcccagaatttccaattaaaacccatttttcatgttttattccaacacatacattggtgattataatattttaaaacttacatttaagtacagggctcagtgggaagagaaaaaagaaagaaacatcctcaagttgtaccctgttgcttggtaatgccttagtagaccagacccttgagaaaatgtgttttcatataattataaaggaacagattttagatcttcactgtaagagaacagtaattgcagaggtcaagtgttattttcatggatctcagagcaaagctaatagtagcctattccccagccaacagtctgccctcgcctgtgggggtctactgaaccagggtaattccaccaaaaaaaggaaaccaaacctagtttattgcagccaatatttctaaagccagctggctcttttgtcactattattgtgatgactaatgactgtattgtcatctgcattactgctgttgcctaatttgaaaatggcccaagaatctgggagtaaaaattaagatctagtaaatggatgttaggacacttggcaatactctggaatcaggaaactctgaatggacctatcagttccacagaccaataattttttcctcttttgttcacttttggatcaccagcttttaaacataggcactcaaagaatgcttgtcaaatacattttctattcgcagttaaaccttaccaataggaaatcagggataataatttataactggacttattattgcagagtgatatccttacctgaatttataaaatttaaagaaaagtcaccagttgttcttttggaaggtagaaagcgaaggtggctaatgccatctagcggtggactgaaggtttgagcctgttctgagtattagcaaaaatgaagaaagtggaatggtcaacatttcatttacaccttgttgctcactgtgcagaacagatgacacttattgattgggacagaatggctctctcaaatgcaaacataaagaataaaaggttaatagtaatgtagaccggaaatatattttttattaaaattaaatgtcattacattttttaagaatagtatttttacaatttatcattatgccactgtgctcattctttacaaactcctcaaatttttctttttaactgagcattttcttttagagattgttttggttattgttctactaagtggcatattcaccaagtgctttgggaaagatgaagcatggattttgcatcttcatctttatcataaagtaactactgttcttttaactgactcaataggaaacctcccatttcttccacattcttccagttgtggcatcattctttgctccagtcctgttagtcaccagaaagagataggggcagggagcccagggatctgggtaggagagagttgatgtggggttgttgagagacatgagggttctttgtggcttggcttaaaaggcttataatcacatagtggtctgtgttgggcagcatggaaatgaagccccaagctttattggctataaacgtggagttctaatttccgaggaagatctcccatctgtttccctatccataagccaagatagactaggggtgaacaacacactgctagtgagagtataaattatttgtgcccaggggtttagattctctgtgtccatcgctactaattcttactcattcctgacaccctagtatccctttcagcatattttgacaaccccatctctgttttaaaattcttccctgcaggattcatatgtcagggaattgcgttctggtttaattggaacaagccatttggaagtcctcctggtctggagaacattctgtgaggtagagaggctgcaaccccaggataatgtcctcagtgggagggacaggaggtcttatgtcaagaagaggtgatggtccctctcctcaccagtgatggctagtccgaggacatcctttaattccacatctgttcaagttttgtctttggatctcagaatgtgcctgcctgcagggaaaatcaaaggagttgaaatgacagtaaatattaaccttgaaagagactttaaaaaaaataaaactattttcagcctagaattggttgcgggagaaaactgggcaaaagaggaggacagaaagcctaggggatcacccagtttctgtcaggacagttttccagaggcaggataattatattataaatcagaagtgaaaccacagcacagtcctgtaatcatatgtaaatgtttaaaagaaatagattgtcatttggaattattcattcttatttctcttcatcagcataaaggcttgagagagagctaatttttaaagcacattagattatacttcacatctcctagtttttagaagtgattttcattcattcacccatccattcattcatgtgtttgttcaacacatttttattgagcgtccttgtggacgtggcacagttccgagtgcagtgaataaatgtctccccctccttgagcttatattctatttttatttttgatgtgtcatagttacttctgttaatcagttcagtagaagtgctgagatactctgtgacaaaacagatcccatcgacatcatttttacaaataagaccagatgtcctttagccttgtcaacaggcttgggccatggtgaacaatgtctgcctctgaagtgctcagcagaccgtgtgaaagaagaaggtccgggtgtttggaaacaatggctgagtggcggtagtggtgcattgtgacctcattattctgcttttggtttctcgccttgtaatatgaataaggcacatgaggatttagtgtgtgtcataagataagtgactgtcacgttaagcttaatgtctctgtttctgtaactttctccataatctggcagtatctcatttcttcgtggccagtgtttgggcactgaaaaggtcaatcaatacatagaattgtgactcaactcacgctgaaaaaaaaaaaaaagcatctgaatcatggttctcctgtgaattaaatttagtagcaagaatcttgttttaatttggaagaaagggtgggtcaggaaaactcaagatagagactttcaaaagggaaagtccttaggataatgagtagatttccccccccagttgtttcatgatataaactgatgtggaccaaataaatacctgtctcacaggggtactgatttccagcattagctgtggcagctggagcattgctggcctaggtggcagcaactggccttcccttgggacctgtagttactgaccagtgccaccctctgccatccaccccaatgctgctgcatctccaccgaagataaagacttgggtggagacttggaaaacatatgtgcgttggagttgggaagtaggtaggagcagctgatgagtactaattttcctctttaaataatgtccatgtaatatgaaattgaagagcacaagttaaagaaggaaaatgcttccaaggcgaacatgcaaatcatcagcgatctttggtaggtgggaataggatgtgcaagggggtgagtggggaagcagctctatccaggccagtagagttgactctcaccacaccctctgaacacctcacagagtcccttgagttgtagcagcacaagcttgctttagcccttgcaagatccaaataattgcccgaagaatgagatcagccttattttcttccctgtttttcgtaattctttcctttgtctttcctgcaaaagttaaactgtgattattggaaaataaaaataattatgcagatcaacttaacagttttgtggatgaagaaaaacaacctgttgtcctttatgtactttagtcctcccctgcccaagggaaccggcaagagagtactgtgtcattcaatccgtatgagccagaacttgcaccctgggctgcagacaaaggtgagacttcctttcattcaagggacattcacagagcaaagtgcgtggtcacttgtaagtttgtagagttggttcacgaatccacaccacgtccgtgattgcaatacagccacagttagccatggaaacactcacatctagtggcaggcagcaggcaccacatgcccatgagcagtgatggtgctattgaatgaaatggtctttcccacctccctcacccaacgacgttggaaatgtccctgccactcttcagaatttctcatcccttgcaacattgatgctactctgagttcatattcccatgaagatcatgttcttggaaggatgaatcctggtgtggggtccagccccaggtcgtatgtttcttgactgcattgcaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaagtaagttgctatgttccaccagcctcaccctcacatgagctcaggttctagacatgactgagaataacaaaatgtaacctggcatgactaaaccctttttttattaatgctaccattcttgttaatttctggtactattataatgaaagcgtccattacctttaatggcaaaaactgcaattacttttgcaccaacctaatagtacatgcaccttatggaaaattaggaaatagaaacaagcagaaacataagaaaataaaaacatcaaattggcatggtggctcatgcctgtaatcttagcaatttgggaggctgggataggaggattgtttgaggcctggagcttgagaccagcctgggcaacatagcaagaccctgtctctacaaaaaaaataaataaataaataaataaataaaacataaaaaattagccagacatagtagtgcacacatatacttccagctgctcaagaggccaagaagccaaggctgcagtgagccatgattgcaccactgcactctagcctgggtaacaaagcaaggccctgtttcaaaaaacaaaacaaaaaaaagaaaagaagaacatcatatttgtataataccatcccaacactactactgttaactaaacattactactgttaacttaatcttattgtatatatttttagatctttatttgtacacacagatattatttaattaaaacaaaatcattccattataacaatagtttttacatttattttctttaattttatagttacatctcatttttcttacatgaaaattattgattccaaatatgattagtataattatttattggctttatcctatgatttcagataacaatacatattatacaacagttaaaattgctaaatttcgaaaatatctttgtatttcttttggtctttagaaggtacccaacatagaatgtacaagtaaaactactggtttctaaagtcctttgaaatacaccctctgtttgaattggtatgatactaatatgaatgtggttagatttagtagcttcatggtatttcaaatgtaagggatttttgtaaaaaaaaaattcgtgagtaggtaatttttatgattcaagggttaaaaatatagacaaaaatatacacagacatgcgtgctttccggccgggtgccgtggctcatgcctataatcccagcactttgggaggccaaggtaggtggatcacctgaggtctggagttcaagaccatcctggccaacatggtaaaacctcgtctccactaaaaatacaaaaaattagctgggtgtggtggcatacacctgtagtcccaactacttaggaggctgaggcaggagaatcacttgaacctgggaggaagaggttgcagccagccaagatcacaccattgcactccagcctgggcaacaagagtgaaactctgcctcaaaaaaaaaaaaaaaaaaagaaagaaagaaaaaagaaatgcttgctttccaatctgtcccttcgatttgtttttgtgcatgtgtgtgtgtgtaaattagatacacatacatgtatgtatacacacacaaacatacacacatatgtatacattcacaagtatatacatgcgcacatatatacacacacaatcaaaattggctgtgatacttattttaaaatatatgtttgtatatcacagtcattttgtacaatgagtaaaaatgtttctgtattaatcctaagctttttcagattatgaaaggttgtgatctttattctgtgcttaaatttgtgaattaacatagacatgactgtggacataatttcaactagagaatttggggagaggagaggctctctcggtcaatttggggcaaaatgatgtctttacaatactgagtctttcaatctataaacacagcccatctctccatttaccaggtcttcttcagcctctctcaggagagttgtttaccttttcaatgtattacattgaaatatatgcttttaaattctgcacctagaaattcactttcaacaattatgaaaggcattttatattcacattcattacatgtaatctgagatggtgaatcccaagatgttacaggaattcgtacatgtcatcgttggtgaagtttatttacaagttatttaaatattttacagtttagggtttttgcttggttgggacattcttcagtactgttcttcaccattctttttattttatattattttttagaaacagtgtttcactgtgtcacccaggctggagtgaagtggcaagaagctcactgcagccttgaactcctgagtccaagtgattctcccacctcagcctcccgagcagctgggactacaggcttgcactgtcacacctgggtgattttttttagagatgggggtctcactatgttgcccaggctgaccttgaacttctgacctcaagcaatcctcccctttcaacctcccaaagtatggggattgtcagcatgagccaccatgcccagcccccaccattcttttttagtaatggagtattactctcattgtctataaaataagggaatataggttggaaggccagccatccattacaggcttctgaagacacattgccactctgtggcaggtatttccgtgggactgtttccacagggggattatgcttcacaggataagattatctaaaagtgaggcattttggaaagtttcttgtgtgttatgatttctcttgcagagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacaggtattgtcaggtgcccccacacatctggaagctatcccctaagggacagggcccacccctggatgggccgagcagcctgatttccttgggaagccttcccaccctcctgtgccttcctttattggtccatactcagggaccttgacagagggacagggagacatagtctttggattcagctctgttagctctagttgttcagagaagaactcatttgacagttttgtcttttttttcttcctgtagtcattcagtcttggcctagtgatagactcagcctcagaatatcttgacatggaatctcctttctcactgggaagaacactttctttttaaagaaacattttaaataaatgcttttctaagaggtgacagttaagtcttatctgtttggctgaccttatgttctcatgagtgatgacttctgaaaataccaatcactgctaattgattacatccatcaagggagtaattgtgttcttctcatctaaagctgttgttgagatgaagaaactcacttggagtaagacagaatgatggccaccgaggagcttgcctcatttgctgtgctacgtttgtacttagattgtctctttagtctccatggaagggaggtgttcttaccctgactttgtaggtgagaaactgattctcagggttagttctgtgacctgtgtgatactggaacaaggatttgaggtggtgcctggctatctgtgagccaggcctgactactctgttatactgcttttcttgcaattccaagcatgccaggaaactcaatcccattgaacaccaggagaatatggcattgagtcctgaagagctatatgctaacaaagttatttgtcaccactcgtgagttttgttgtttaagaagagggaaggagtagattcacccactgcctgcgtgaggagcatggttgtttgttgtgaaatgggtcactgtctgttatagctgatgagatcattatgactttcagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggtaagtacaacttagctaatattcagagcagcaggtggtaaaaaatgcaagataaatgtacgttttctttattttattattggtatggtttcaaaaagcagttttgctactgaaaaataactatgtaagatatgttcttataatctttgattttactgtttaaaaaataaaaataatatcacaccttgagatttactcaaagtagtatattctaaattatgtttcatggaatgatcaggaatcgaggtattaagtgaagatttgttttgaaaaaagaagaatgggattccttcattaagttaatttgaaaagtttgcattggacagcttgattcttgcaggatttccccgaagcccttttcatgctacttaacattacgaatctcagtagagggtttactgcactgcatttctcaaaccagattcatccatggcatccttttctgataggacatttcataacatgtggtggaacactgtcccacagcatggagctattggagcttggagctccagtactgcagttcagagctccaatattgcagcttggagctattccaaaataactttctaatgaacacctacctatacatgcaaaagttagaaagtgaagatttaccaaataaactcgtcatctgtgtatgtccactacatatgtagaaattgttctattggcttaactggtatccagaagagttgaagtgtcaaaaaatagatgcagtgctggaaagaagagatctagatagttatgtgactgaagctaaaagaaatatgccccttggtttggtgaggcagagattatcaagaattaagggtggacttccagcaaaacataaagtagaaactagttctgggtgcaggtttggacttcctaaaaaataatttcacagtgaccaatccccttgctaatataacttgacccctctctgaaccctcaaatgaaccaataacaactaaaagaagaaaagataagaaagctctatcttcatattaactcatctgtggtgtatacctagggtctatgttaaccaactggaaaacgtgatggcaccaatcccactgagtcaaagagggtgccgaaggcaggttaacaaccctgctagtctctggtgaagtccacatgctcagaaatagatggcagaccttcaaaatctacctagtgggtggcagataggatcctgtgtttcatgccctgcagtggtcagagaccccaccctgagtgacaatacccacccactcacctttccctaagaggcagtccatggactggtaggtgatggggaatggtggacctcggccagcaaagggactgcatgaagggtaagccacaagagccaagctcccaggcaggcaggcagactccaccatcttgagcacaaaggccaggcgagagtacagcaggggtcaggctggccctcctcaccccattcttcatacagtagcttcccagaaggaagccccttcagaggtgaaccactgtgagaaaggcatcagcatgggcctggatagaaatagcagggaaacagagcaaggaagacagcagcctaggatgaccagcatgggacatgctggagaaagaagcctgttgtaatgctggatgtacctcatcatgatcattacagaaaagaagacagcctgtctgaaacaaggacacagaggagatagagaaaatgaaacatgaatgctgggcaccttatccactgctgtataacaaatcaccccaaacttactgccaaaaacaccaccaggtgttggtttccctgccgtcctgctgtgtgggcagggccaggtaggcagggttcagtgcgtctgctcacacaggggattgcacagtggcccgagggacaggaggaccgtttccactctgctcactcacactactcagccactgagcagctggttagacacagcccatgctggagacctctgcggggctgtcagccagctcacctgcacatggcctctccttggggcccttgggcttcccttgggcccatgcttcccttgggcagcatggcagctgcgggctgagagcagttacccaagaggcaggaagtgggggctgccaggcctataaaaccaggcccagaaactacctcagggtcacttccacctgatcctattggtcagagcagccaaggccaccagcttcaaaggatgggatagatagaaccacccttttgaggagaagtgtcaaagagtcaaagaacatggggccaattctaaaactgctgtagatattaaacagcataccattaaaaagtaaactaaactaaaaagtaaaccaaagattgtctttggacaatcaatgaagaaaaaaagccactagggaaataaaagccatcttggaagcagcaaaaagagacaaaactaccgaaaagatagggtagtggaagatttctgtatgaaaacaaagcaaagtgaaatggaaaagaataaaaagtgggccgggcgtggtggctcacgcctgtaatcccagcactttgggaggctgaggtgggtggattacctgaggtcaggagttcgagaccagcctggccaacatggtgaaatcccgtctctactaaaaacacaaaaattagccaggcatggtggcaggcacctgtaatcccagctactctggtggctgaggcaggagaattgcttgagcccgggaggtggaggttgcagtgagctgagatcgtgccactgcactctagcctggccaacagagcaagactctgtctcaaaaaaaaaaaggaataaaaagtgaaacaagatcaaagaaaagtgctagctgtggaagcaaacgaacgctggcactcgggaaaccatgcgtgacagggtagatttgtgcagcatcacaactgaaaaacacaggtgttctttgatccagcagctccttccgagagcaaacacacacatctggtaatgtgcactctagcacgggctgccacggcaaaaatctggaaactgcctgacgactgctccgcagggtttggtccaatcagtcatagcagattcacaggaagctcacaatgcaacccttttaaaagtgacttatttgcatgtgctgacctagaaatatgtctactatacatggttaggtagaaaaattaaaaagtacagtgctcaaagaatatgcccctagttttatgaccagaaaaaagtatacactacctatttatgcatgtatctaggttattctgaagacagcctaaatttcattgcatttaagatttgtcaaaggtttacttttttcatcagttcaaaattcagaagaaacctgaaataacacacatggttgtattgttcatgacttgtaagatcaaaattttaaaatagcacacaaggtgatggaaacagaagtataatcagttgtatcatttggaagagaagtgccagggcaccttatggtctccagattgatgtcctgaatgtctccttgtgatccactgtagtgtcatgaaatcagttttcactgaaatcatgtccccctctccaccccaatgagacctcacacaggtgacatcagcagaagataaccagactccgctgtgtgccccctgaatcccaaacccagagagagggttttgctatgcagttttgacctctgtactatcacttgctttttaaaattaggaaattagaatgcttagatcattttttaatgatgctagcaagtagtgcatgctaaaataattgacctgggtggagaactgatcaagatggacgactaaatgcaactagtatatgctcctccgtagagacggaccaaaataacaagtacatattcacacttccaatagatggtctaagagagaacacagatgcaaccaaggagcgacaggaagcaccaaaagcaaagcacagggaaacaaggcagcctgcttggccaggaatgactgggagctgggagaagcttccagatatggggaaagcataaatgagagatccccagggctccacattccagccaaggacttctacaatcctagcgacagaagaacccctcgacccacgtgggccttaagactaacatagggagctgcctagggatcacacagaggcattgctccatagagggaactcacgctgagtcccacaggcttccaagctctgagtagctgcagcttggtgccatactgagaaccaagtccccaaaggactgcatcttgccctgggactattgctgatgctgccatcaccaggccaaggacagaggggagaatggacaccttcacacaccccagggacagatccccctgctgctacaggctgctgtggggctgagacacaagcaaatcacaccccctatagctgcctgcctacactgctccccctgagaatgtccgcagcctccccaggagcaggcccatagccagcgccattctgagagccaagcctccaaaggtctgtgtccttccttgggccagggctgatgctgccactgccccgccacatagggagaagggaggccaggcactttcacatgccacaaaaacaaataccaccaccactgctgagggctgctgtgggaccaaggctcaagaagactgcatatcccacagctacctgcctactctgcacctattgagagtggccctaccctttctggtggtaggccttcagggcagccactgctggcaacctagagaccacccctccctgcgtatcacagccagcagctgaatgcaccaccagggagcctgagcacaagtccattggcctagtcacatgccccaatacttgagcatgacatcctgttgcagccaccgccaacaccaacatggaccacttgggttccagtgagttgccctaccaccattactgccatcacccacatcacacccactccccaggaacccaagaacctgcccacatgcccagccactgcagcatccacacaatctacctgaaagcccaagggtcagccttcttagacctactaacaccagtgctagtgtataccgccctagggcccaaggacaggcatactcagctcactgctgtcaccactggggtctgaagactggcccacctagcatcctattcacagtacaccttcacaacagcctccactaataaccataccctaaggcactgagaaaatcacaggtgtcactgaggctgtttatggccatagaaattatacatagattaaatactgcattcaccccaaatcaaacccaaagtgccctacatatatatatgtgtgtgtgtatatatacacacatacacatacgtgtatatatacacacatacacatacgtgtatatatacacgcatatacacatacacatacgtgtatatatacacatacacatacacatacgtgtatatatacacacatatacacatacgtgtatatatacacacatatacacatacacatacgtgtatatatacacacatacacatacgtgtatacatacatacacacatacgtgtatatatgcatacatacacatatgtgtatatatacatacatatacacatatgtgtgtacatatacatacacatacacatatgtgtgtacatatacatacacacacatacacatatgtgtacatgtacatacatacacatacacatatgtgtacatgtacatacatacacatacacatatgtgtacatgtacatacatacacatacacatatgtgtacatgtacatatatacacatatacacatatgtgtacatgtacatatatacacatatacacatatgtgtacatgtacatatatacacatatacacatatgtgtacatgtacatatacacatatacacatatgtgtacatgtacatatacacatatacacatatgtgtacatgcacatatacacatgtgtacatgcacatatacacatatgtgtacatacacatatacacatatgtgtgtatatacatatacacacatatgtgtgtatatacatatatacatatatacatatatatacatatgcacatatgtgtatatatacatatatatacatatgcacatatgtgtatatatatacacacatatatgtgtatatatatatatacccaacatatatatacccaacaacatatatatattttcaggaaaaagacctcctctacaaaagcaatttcaaaaaactggaagaaatgactgttgtaccacatgggcagatatcaatgtaagaacacaggaaacatgaaaaagcaaggaaatatgatacctccaaaggaacacacaattctccagcaaaaaaatcccaatcaaaaagaaattcacaaaaccccagatgaacaattcaaaatattgattttaaagaagctaaataagatataagagaattctgaaaaacaatagagagaattcagaaaaacagttcaggatatgaatgagaaatttatcaaagaaatagatatttttaaaagaaccaaacagaaattctggaactaaagattcattgaatgcaataaaaaatacatcccaaactccaccaatagactagatcaggcaaaagaaagaatctcagaacttgaagacaggtcttttgaaacaacctattcagacaaaaataaagagaaaagaataaaaaagaatgagcaaacccttcatgatatatggggcagtgtaaagcaactgaatattcaaatcatcagtgtccccaagggtgaagagagaatgaaagattagaaatcctatttaatgaaatattagatcaaaacttcccaaatataacaacaaacctagacatccagatgcaggaggcccaaaggtccccaaacagatacaatgcaaaatcatcttctccacagcacgttataatcaaaccacttaaagtcaaagcaaaagcaaatatactaaaaagagcaaaagaaaatcttctaattacccataaaggaaccaccattagactaacagtggatttctcagcagacaccttacaggccaggagagaaggggatgacattttcaaagtgctgaaagaaaaatactgccacccaaggagaccatgtccagcaaaactattcttcataaataaaagaaaaataaagcctttcccaggtaagcaaacactgagggaattcatcaccactagactgatcctagaagaaatactcaaaggaatcttaaacgtggaagtaaaaggacaatatttaccatcataaaaacacacaaaagtataaaactcactggtaaaccaaacatacaaataatcctgttaaatagtgggctaagaacatagatagacatttctcaaaagaagatatacaaatggccaacaggtatatgaaaaaatgctcaatatcaccaaacagcagggaaatgcaaattacaaacacaatgagataccatcttaccccggctagaatggctgttattaaaaagactttttttaaaaaaatgctttgcagatgcaggaaaaaaaggaactcttatacactgtttgtgggaatgtaaattagtatagtcactacggaaaatattagagagacttctcaaaacaaaaacaggctgggcacggtggctcacacctgtaatcccagcagttttggaagcccgaggcaggcagatcacaaggtcaggagatcaagaccatcctggctaacacggtgaaaccctgtctctactaaaaatacaaaaaattggccaggcctggtgacaggtgcctgtcatcccagctacctgggaggctgaggcagaagaatggcatgaacccaggaggcggagcttgcagtgagctgaaatcacactactgcacactccagcctgggcgatagagtgagactccatctcaaaaacaaaaagaagaaaaaaaaactaactacacatagaattaccatatgatccagcaagtctactattgggtatttatccagaggcaaataaacttgtatcaaagggacacatacactcaacgtgcttatcatagaactattcacaatagcaaagatgtggaatcaacctaactgtccatggatggatgaatggataaagaaaatgtggtgtgtatatatatatatacacctctagaggtgttcactggttacttagggtacaccctatgtaaatgaagaggctaaagtgaagttacaaagttatttacttggtgtacaccctatgtaaatgaggaggatgaagtaatgttacaaagtcatttactgagtgtacaccctgtgtaaatgaagaggatatttcctgtcatagctgaagtgtttccatttgatttagttctaggaagtccttaggttccctgcctccaggccctattctcctgtctcaatttcactcagcataatgtcctctaggctcatgcatattgtagtgaattcccttccttttgaaggctgaatgctattccattgtctatatagagggtgttttgtttatccactcatctgctgaaggacacttgggttgctttcatgttttagctattgggaataatgctgctatgaacatgaatgtacacaattttatgcttttctttctttcttttttttttttttttgagatggagtctctcgttgtgtcacccaggctgcagtgcagtggtgtgatctgagatcactgcaacctctgccttctgggttcaagcaattctcctgcctcagcctcccaagtagctggaattacaggcacccgccaccacacctggctaatttttgtatttttaatagagatggggtttcctcttggccaggctggtctcaagctcccgatctcaagtgatctgctctcctcagcctcccaaagtgctgggattacaggcatgaaccaatgtgcccggcccacaattttattcttaatggaatttctccctctgctttgcttttaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagtgagccagtcctgcttcattttctcactgtggggccattagaacagataagcaccagattgtctttacaacaacctgaaaatcctaatctgagtctctcattatcttttaccagtaagcagttaatgtgccctcagtctattccaaactgagaatgaaatatctgatgctcactgaagagtgtgtttttcccattgtgtgtcaacacatgtaaatatacacaaaatataacccagatcattactcattagagttgaaatagaaataatgactatttacagtatcttaattacattttttagatcttttaattaaaacatatataccaaaaagggcacaactcttagcatgcagtacagtggttttccacaaatgaaacatacccatgaaatcagcccccagatgaagaacagaaccccagaagcctgtttcctctgcacacacagccttccccaggggtgacccaactgactccaacatcacagattaagtgctcctgtttttatacttcgtataattgaaatcatacaatgtgtactccttcatgtcttggagtggctgttttgttttgtttgactaacacctttaaaaaaaaaaaagcttatgcatatcttgcatgttgtaggggatgaaaggaagtgaagtcaccgctatgttagagaaaggagagcggatggggtgccctgcagggtgtccaagagagatgtacgatctcatgaatctgtgctggacatacgagtgagtacctgacactgactgtgatgtattcagatgctctggaaacaggtgaaatggttgggcgtctaaaaaaaaggataaagttcaccttttcatgaatcaggaatgtgcccgctttctaaacaaacaacggtgggggctggtcttgctttagagaccttgctttctggcccatgcacttacatgtagtagagcctaaagagcaagtttagatggggactctaacccgagtgtccaaatttaaatgtcgataatggtggagagatggggcaagggcagtcaaagtaaaaaagtgtttgtaagagtttggggctggatgccatttttggcatagaggatggcagaagcactcggtaggggatggtatactttcctgactccctgattaccatgagcagtgaggggtgacctcggactctggccagctcacagatacattggctaaggttgcacttccctagaatctacctcatccttgaagtggtggcctcagtccaccctgactgccgtcatacgtctcgcttagtggatcccaggtgctgttatgcttttaaagtacacctggcattattcttaggtgatgttcagggcagctcagcaaggaaggaaaatgcattgccactgaaaattaggagtacagttttgccaggctcagcagcctgcttgtgcgtgcatagcacggtgaccccaagccgccatctccagttccctggtactgaactgtgcacacagagcccacacagctgagaatcgatgtggtttgtgatcaggaggacatcacaaatcctggccatggatttgatgctttgcggaatcaggtttgccttcagatacagctgacattgccagagcctctgaaagatgagggctattccaaatgctgcagatgccacctgggattccgagacctcccctccccaccctgggagtatcactctaccacaattgtgagtgacagggaaataatctcattctgtatctagaaaccacccagggggcagccacaaaggcagcaggcaaactgtgggtatatgcttccctgcccctgctgctgccgtggctcaggagaggagcctggcctgggccccggagcatcttctccaaccccaagtgttagtgcaacagggagagctaagtgtcagcaagagggaagtgctactcatggatctaagaggatgtttattcctaagtcttggcttaattctcccagtgcctaaactagaatcgtaagaaccattggcaggtaggcactggcagcactggaccctggggagggcagcccttgggcacgtggcagcctatgaccctttactgaaagtgttctttggtccagcctgcagctccctttgcaaggcttcccttcttgtagaagggtgaggagggtagagtttaaaacattgtgatacaaatgcaaaaactttgaattaaaaatgaactcgcagtgggggagtttttgcatttaacgttgatgctgatctatgtacttctgtcgattcttctttgtggtgtgtgtttaacagtgaggagtgaaaggtgggtgggaagagagcagggtgcgcagccaggggcaccacctcccacttggctcccaggtgggtgcagtgaggctgctgaataccctttgggctcgtggtgtattcttgtgactcaaggaatcaggataggggctgctgggccgacctctgtcctccatggacgcacgtaacagtgggcagttatttccagagtggtccaccaggggcagaccggggagggaaagcagtctacgtgatattcactggatgttcaccagaattacagcaaagtagagcagtagaacagtctccttaagagagtattctttctaaacgtattttcccgcctggagatttaagatggaacctgagtgaggttcacaggcaggcaatgtctttccccttggttcccaccccagtccgctctgcaggggtgcatttcagtgagttctgcaggcttggaggagtcagctccagggcacaagccccagtcaaaaggaaatcatgacaatggcccatgccccatattagaaatcacagctctttatcagactttgatttatttcccaacaaagctatatttctgaaggttacagtgtttctagtagtgacctcaaacagggttgggggaggtggggagatgttctgaaacttttgaagcagctgtgtttgtctggggtaatacctgagctcgttgcctcacgccaaggaaatcaaagatgcagacacacaagaagtgagtttaagagcagaggtttaataggcaacagaaaagagaaaagctctctttcctgcagagagacaagggctcccaagtggttcttccggctccgtgtggaaatgcaagggttttatagacgagcttgagtctgattacatagggcccaaagatcggttggacagccaggccatttacataacacgaaaagaaactggctgccccaccctaatcttttattatgcagatgaggtctctccttggccgacgccatgttgcctgctttttttttttttttttttttgagacggagtctcactctgtcgcccaggctggagtgcagtggcgcgatctgggctcactgcaagctctgtctcccgggttcacaccatactcctgcctcagcctcccgagtagctgggactacaggcgcccgccaccacgcccagctaatttttttgtattttttagtggagacggggtttcaccgtgttagtcaggatggtctcgatctcctgacctcatgatccgcccgcctcagccttgttgcctgcttttttactgcacacgtggcaacaaggaaagtggaagagggaacctccatgttgaatatccctggctccagggatcccttttctattgacacagctgccggcatttacctatgtgagcttttagcttgcttagctatgcttgcagcttgatttttcaggctgctttttgttataaaagacatgatttaggagctgctttttattgcaaggaaaccttacagaggactctgttaccctcactatctgcctaaataatttctttctagctctgaatcactttgtctaaacataagaaattcaatgaggtgcagttgaatgaaaaaaaaggaaaagattccttggagcagggccacaaggagaactcagaagcgccaagggctggtcctggtaacccaggctattgcttgaggccctccagaagatgcagggggtccctcactgcaggcattgtcatcagttccagggtgtggtcctggagggaattcaaagggacttcccagcctcaatgacaaagccctgagaaggcagacagcatccctcacccttgtaagacagccagagattacctccaacccctttttagtcttaatggactcttcagctggacctagaaaccaaattgataccaggccagattaacaaaagaaaagcttaccaattttactagttttacatgtttatggggatcctcacaagacagtgaagtctaaagaagtggccaaaacaacatgcttttataatctttagacaaagaaccatacatttaaggagaaatgacaggacaaataaaatctggctagaaggagtaaattttctagagaaggcgctaggagatatgaggagggtgtaaaaccagtggaagataagggatactgtgttaaatatgtttactcaggcccattgcagctccaatgcccagtctctgatgataaggggcattttctcatcctgctacaggaagggtctccttcccagaggaatctttatggcttgctgcaggcatgaagagacaggtcagttagtcctatccgaaactacaatgtatccaatattttcaactcaaaataatcaatatcccaatctggcatattttgggatggcccatgcttcactccttccccctctcactttccaaagaggaaacacaacatcagagtcctgccctgtgcaggtcactcaaggaggcagcgtgaaagccaggaaggaaacactggccctaagaaaagcaggaatcagtcaggaagccttccactgtagtgttttccagagccaagtcatgcttggggtgattaaagacaccagtggggaaagcccttgcaaatggagagaagttggtgctcttgatcctgaaaaacggtttcctaatagtcccagccctccagtgggggcctctgccgaatggagaaatttcctgggctctccaggttctctgagagtcagggaggctctagatgcggctcaaattcctgtttaaagatcaacaagcccaagataaaacatgaattcccaggaccttggtgagatgtcccctggctccctgcacaacctcagctccaaggctttcctctgagcggcacatcctctgagagccctgggtcattcacagggtcggtggccactgccggagctcctgctatgcaggctgccaccccaggtgcaagcctcacagaagcctcagaccctgtccctatcagaccttatagttggggctggggcagacaggcaataaacaataagctaaaaataagtgtgtcctatgatgtgtcttaggaaagggatgactccagtgggaattctaagcaaggagggcacaggggcctggaggatatcacgtgtatatatggggttttttaagccctctcgtgtcgaagtagtttctcacagttgcctgcagcacagaagcacattggagcttctagaatgtggtggattcaatgaagggactacaggtggtcctagtatattctctgttttgttttgttttgctttgttttttcattttttcctcagtagtaaacagccactctctccaaggtgatatatagagacagacagagagagcgggagggaggtagatgaagggagagaaggagggagggagggagagaaatagtctcattagcacaaacccaggtatggttgaagggggtttattatgagtaacaaaagatgctgctttcagcccaacaatcaggaaattccaagggttttaggagctctgtgccaggaacccaggataaagaccatatatctctttatataaaatcacacactggaaactttaaaagagaacagaaaattatggggagggaagcctcacacttccagcaggggctccagataggccgcctttagggattgcagctgagacctgcaggctaagaagcaaggttgagtgcagggatgaggggagaggaggagggtcactgggtacaaggagcagagcagaatctgcactctggcccgaaagcagagtggcaggccagggcaggccaggaagctgggcacgcaagggcactgcatcaccctcctgctgctgaagcacagctgtgtcccagcttcctggaggcagcatctcccatggatgtacaggagagatttcctaggagacctgaccaggtgtttttcctgaggacgagtctgtattcctgtttccctgcatttgtttgctccttggctgctgggcagatgaacccccagagcaagatccaaaggtgctctttgtaccatttggatccccacagttggagcagagccccctgttttgcaaagatgctgaagtgtgttctctttgactgtagaagtttaggagcaagacagaggctgtccctctgggtggacacatgctcctgtaccagaggcttggccaccatatcccctctcggaacacacttggtggccagagacaaagcccctctcagtgacaccctgggaggcccgtgtccccagacatgaccacagatggctgaccacactgatcaattcgagcagttttatcattttgctcactattgaaagctataagagaaaccatgtattttgatgccatttgacaaagctacccattttgatttgtagaagccactctgctcttataatgatgagtgagtcttggtcctgatgcgcgttctatggctgttctcttgtgtcgacattgaatcatatgaaattgccattgatataggtcaaaatggctgaatgtggacggtttcctacaatttaacctcacattctgtttcactttttcacttattgtatttcaacttcacccacttgcaatatatccagaaatcttgcaaaataagaaaaataacttctaagtgaggatcgattatcagggttttagtacttacttccaactgatctgtacaggatgtctgtgtaagacaaaacagaagtgtctgtaagtgtttgtttagagactgcgaactgttaatgcttttgcccatagtttactgacattagtgcctccctggccagcagtggcagtaaggactggctatattaaggtggatcatagacaagccctgggtctttgctcctgccatgacatgttttgagctttcctaagaacccatatcaacagcccattttcagaaaatccagagccatcgattagagcgtggaaagggagaattaaagttatgttcgtatttcttctcttaacaagattatgagtcagatgttgactatatctgcagaacatttgccaagtattttcagacacctgttttgctaaaatcacagagtgacagcctcttcgtgttgcctgtggcacagaagcatattgtgtgccgcatatctgaacctggggctaaaacactcccagttctaatgcaaaaagtctcctactttagggtggacatgaatcaccgggaggtcttgttaaagtgcagatatgggttatttaggtctacagtaggccgacactatttttgacagccttgtggtcaccctggggtggggggcacagggaccacgctgtgagctgcaggccctagagttagccaccagggagcagcaccactggtactcagcctgcagaggccctgcttgtgatcagcaatttttcacaagcacattgacaaacaagaatgcatctcttccattccagtgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaatcaagtttgaccagtgcagtttctaagcatgtagccagttaaggaaagaaagaaagaaaaaaaaaaaaggcctggatactgcttttgctgtctctgttatgagatggaagacttacatgtttgtgataaaaggggaccatgagaatgaattggcttggcttactttccccctgaaatcctctctcctgcagactgtcttgaagacctggtgactggtaaataaagccctgcatggaggctgcacagcaggggcaagaggcccatcccccagcatctcactgaggacagcttcaggctgccttcctctgaacgtggtccacaccttcctctcctccacagagagggtgccgccagaatcccctgtcgctttctgtgtctgcaatggggggcagcacagggatcaaagccatctaaagagtttccaaagaaagtattaattcagaacaagccaaagaccctgagcctcaccacaaacaggccttttggagtgtgaatttgagttgaagatacaagatcggagaatgattttctggtcttaactaatcctcatcttcatgtttgatctttaagaagtcatcacccattgatttcagttttgctgtacctcttgaaagttaaagagacatctcagcactttaggaggccgaggcgggtggatcacttgaggtaaggagtttgagactagcctggccaatatggtaaaaccccatctctactaaaaatacaaaaattagccgggcatggtggcatgtgtctgtagtcccagctactcgggaggctgaggcaggagaatcgcttgaacccaggaaacggaggtcgcagtgagccaagatcatgccactgcactccagcttgggcatcacagcgagactctgtcaaaacaaacaaacaaaaaaacaacttaaagaggtaatttagccatcattcttatgccagcagatataaataaacttggacccatctggtcttcagctaaacctgagacattttaaagtgcatggacagccatggacagcaggccctcctctaacaggggatgcaaggcatggagaaagacaatcagtacccaagctcagccacagaagacaggagtcactcatataacttgtgtttagaagtttttggtagccacgcacactttctgaaatcacactatctggtggtttaatcatatttttaaagacagaatccctgagtgctgagcagattctcaaaacacatttagaatccctgaaattagaaagatcaatgacaaaatatctgtcagccaggccacaaacaggtgtaaaattatgaaaggagtggttggatgtgccaagtttggtaaagtggtgactgcatctgagaaagaggctgtgaggctgaactcttggtggcttccttctgtaacttccagagggagtcttcaacacaggccccgtgctcgtaggaatacggtagcacctatgtaggaagtgcgtggagttttctgtcttctttctgtgtgatttttggcctttttatcagcacttctcccctcccaggagcctggggatgccaaacatccagaatgtgatgggacaagatgggggcaggggcctcacctccctgcagaggtccggccaggtctccttgtccctggacaatctcctgagcctctctgcttggtggagcaggcacctgtgtgcagaattcccactgtggccagcacgaggaagtcttttctagtgaaaatgtgtcttgtggtcaggaataattatcctttcccctgtagccaccaaggagggcaaatagagaaaggtaacctaattgaaggattggtcatgtgaaaagggctacatttgggaagctgggaaaggcctccaggcttctagagcagctagcttgggctggattctcatacccaggctgccccttggattgttctacccaagcttttccctggggtctgggctcactccataaggtaaggtgccttttaccttatggtccttctttagcaggtaacaaaggagcatcaggggcaggctgccctggtggcatcacactggctagtgaggccgtgaatatcttgtcccccagcagggccgacagtttctatcacagaaaacagtgtgttcagtggtgaaaatcgttgcatgcatgttttcatctgagcgtgtccttctcccatactccctatcagccagccctgcctgtagctgctgtatggtgattgcacttggacatcagtccaatgactgcaagtcggcctggattttcacttgcagaggctacagctgcattgtcaggtctcccagccctgcagagagctccctccactggttagcagtgtgttgtgttttccattcatttcagaagagctacattgtgtcactggacatttttaaaaactgtgatttttaataaaaatttaaaatttgctttgtgatga

SEQ ID NO: 1843 - DNA, 96832 bp, Homo sapiens; identical to SEQ ID NO: 1841

SEQ ID NO: 1844 - DNA, 18215 bp, Homo sapiens
atgagtacttcaggtttctcttttaataaacaaaaccatccaaggtacagttccaaagtacaaaatcaaccaggtctgaactgattggtgataagagcacacagatcagtccttccttaaggaaacagtttcctccctgatgccctctttggtcactatgcagatccggagtgcgtccccagtgtacacatctctctcagccgcagaaatgaagacatctttcaccagccgcatggctctgtccaaggacagcggaacatgctccacattctgcatgttcttaaaaccaacctggtgggacatgaaacttgggtgagatgtcatgtgacagtgagcacaaaggaaaggttcaagtttcttccaataccctcatgtgtacgaggatttgtgatgaaaatactacacaaaattaaaatgtccttcagactgaataaagacccttccagacctggatgaattacacacatcagaaatctgacaacgattccctggcaaagctcccactcttgagaagcacatgacccggagaggtggacgtatgcaagcaaagtgatcagagaattgctataactaagaagaaaataagagccaggagagccccaacagatgtccactaagtctcctagaagaagacaggcttcagcagaaaggacttttaagtaggtgagcgctgaaggctacactgaagagcacagaacattccagactgaagatgtgggacggagttaggaaaagcacatcttttctgagaaaagcagagttagggtctgggtgtagtggggtgacaggagatgaggtcaataagcaataagcagaggagtagctatatatgacatccttcagaaaactgagcaggaggaattagggaagtaaacttgtaggcagaaaggatgttaggaaataaatccaataatctaataatgtaggtctgaatttagccagcagtaatcacaaagagggacgaattagaaatacaggcggcctttgaataacaccgttttcaaccactcaggcccactgacacataaattttcagtaaacacactgagaagtttttggagactcgcaacactttgaaaaactcagatgagccaagtagcctaaaaataccttaaaaattaagagaaaggtatgccacaaatgtataaactatatgtagatactagctattttatcatttactaccataaaatacacataaactgattataaaaagttaaagtgatctctcaatgttctcctttgtttttcattgtgtttagtgcgattattataaaccttaaataacaagtggcccaaacaaagcactattagtgatgctggaactgctccccaagaagcagggaaagttatgacatcacaagaaaaagctgaattgcttgatatgtactgtagattgaggtctgcagctgtggttgtccaccactccagacagatgattctccttgtaaacagatgatgtaaacttacagtatcaacaaatacagtattgtaaatgtattttctcttcctataattttcttaataacattctctttcctgtagtttatttatcataagaatacagcacataatacatatgtaaaatacgtgataatccacagtttacattattggcaaggcttccagtcaacagtaggcttatttgtaagttttcttggagtcgaaagttatatgtggattttccagtgctcggggaactggcgccccaatccccgtgttgttcaaggctcaactgtatgcttgggagttcaagtacagtattgggtaacacagaaagggggggtaagagggaaaaaggcatttttatgatcttcaggtaaagacagcaagagaattagccactacagacataaaagagttggaagccatgagaatacaggaaaacaatcaaaaccatgggagtaggtaaggacccacaagagagtaggcagaacacagagagagaccatgaggtttctgtaggacacgtctgccaaactcaaacagtaatttataagaaagtctttatatcttggctctcctaagctaatgaagaggagaacttggaggaaggcacttcaactgaacaccatgacaagttggacatagtatcattacctggacacagtatcattacctggttgtcaagcaggggctgtagcatggcacttgctgagcctccagccttgaaggagtctctctggtaagaccctactggatcaaagctgtatacagccccctttccttaaagaagaaaacagtattcataaggatggtatccaatcacaatcccaaatcatcgcaaaaataaatcaggtcaaaacgtgacacaaaacggactatcaccttggctaaaacttcagggaacagttggaacacagccactgttgcactggtgacagctgcagcacacacactgttgcacatgtgacagccagaacccagtcaccattgcacaggtgccacccagcagacagccccaatccccgtgttggtgtgttgttcaagggtaaactgtaggcttgggagttaaaatacaatattgagtaacacagaaagggtgggtaagagggagaaaggcatttttatgatcttcaggtaaagatgacaagagaattaaccactgcagatgtaaaacagttggaagccatgagaatacacaaaaataatccaagccatggtagtaggtaaggacccgtaagagagtagggagaacacagagagagatggtgaggtttctgtaggacacatcagccaaactcaaacagtcatttgtaagaaagtctttatttcttggctctcctaagctaacgaagaggagaacttgaaggaaagcacgacttatgtatatagacaggtccaagggacacatccgcaagacacagtaaaacgaagagaattctgtaacctgtaaaatacgatactgcttttgtttaaaagaataagaaaactatttgtacaagcacaaaaaagtctggaaagataagtaactgtggctggtcatctttgagctctgaattagaggcaagaaaagaagggaattaattcatgtgcttctatcttatttgagtttgttacaaagaacacaggtgattctacaatcgttaaaaaggcctgttaaaaacaaccgtgttctgggtatgagaaatcacgagtcatttacaaggtatgattttttaaaaacataactgatttagaaaacacattatataccagaactcagtaccctgggagatgtgatatagggacaatctccttactaaccatgtacaactgccactgttagctttgtatgttttctactatagaactgcgtaaacttggccaggcgcggtggctcacgcctgtaatcccagcactctgggaggctgaggtgggccgatcacgaggtcaggagttcgagatcagcctggccaacacagtgaaaccccatctctactaaaaatacaaaaattagctgagcatggtggcacgtgcctctattcccaactacttgggaggctgaggcaggagaatcgcttgaacccaggaggcggaggttgtggtgagccgagatcatgccactgcactccagcctgggcaacagagcgagacttggtctcaaaaaaagaaaaaggattgtgtaaactgaattctctggtggagaaggcaccatctgaggtcacctaagaaactgggaagtatttttgctggaagcaagcttgggacaagacatgagatcacagcaggcaatccactaacctcaatatacaaaaaaagaaagagatgtaaggtgtaaaggcagaaaaatgattgtatctctcatgaggatgacaggccacaagtaaactgaggcccaaaagctttacccaaggatggaaccaatctcagaaaaccacacacaacaaatttaaaaaaataaaccaaagaaagggtgggctatgtccaagaacacagctttaaagaccccctagaagaagcaagagagacactagtaaaatcagtataaaacagcaaaaatcaataaataaaaacaaaaataaatgtagaatggcatgaatcttgattacaaagtgcttttcctcatcaaagtaaaatccaaaaagcacaatcatttcaatgtaaaaaataaaatcagacaagtcttaaaagaaatacagctaagctttggatgggagaagtttttctaacaaggcaagaaactgaatgtcataaagaaatgattgacagattagactgtatgaaacacagcaatttctgtgtagcaaaaggcaccacccaaaagagacaaataacactcttgggagtatctataatatcacagacatttgacacagtcgaatgtagttcttgaaaatcagtaagaagaaaactaacctgcaaataaggaaatgggcaacagttaatatatgaatcagtctccaaagaggaaatttataaagtcaataaacatatgaaaacatgcccaagaatatatataaatgaaaataataaactgttcaataggcaaaaagatgtttcaaaatgtgttaattctaatactgggaaggttatataaaatcgggtactcagggtactggcgtatccttcagaaagagtatactcaacaaaatacaaaaaaaaatttatctgacccaatacttcaactactcgaagtttattctagcaagacaagcataattggggaagtacacaaaaatgtatgtacaaggatgttcatcatagtgtttatattaagaaaacaggaagccaaaatgccctttagaggactggttaggtaaatgatgctatgtattacagcagcaaaaacagaagacaaaaaaattttttgttaattaaatacaaaaatcattatgcatatagcttagatctccttgataatacataatgtatagttacagaaaaacagataccaaagtcctacttacataaaactgcatgagtgtatgtataaacatgtactgattgttttcactacagaaaaactaaagccacttttaatttgggagaaaaatttttaaaaggcatgagagcagctaagagattaaagacagagaggttagtgcagacagcggttgacaccaagggaaagagctgtggaccttgctgtcctgaaggtttcaatatggagcactgctctccaggtccctgcatccaccaacacagaagacagtaaaggaagtctcctgagacattagcagaggctctggacttaggggaccaggctctagagtggcaaagggtaggagcaaaacacatgaaatggaaagttgatgtaaacaaaacacagaccttcagcccccttcctcctctgaggcctaaaaagctgccaaccgggcttctcttcctgtagtcccacctcacctcaggaaaaaagattaaagaaattcttcatctgaagaaaatgctgcttacttaagcacccagttaacggctgtcagttgacaagccatgtcaacaaggactttcataatcaaattttggtacaagactcttcaatgtgaatggacagcaaaaaaaaaaaaaaaaaaaaaaaaatcagagatttgaaggaagcctctaacatagaagacagaggccaaaaatgaacacataacatgaaaaaaaaaacattctgatgaaatacagaaaactgcaaagaaagtaaacaggattttttttaaaaagacaaaaaataagtacaagctcttggaaattaatgacaccagaaataaaagcaatcagtaaaggatgaaaagctaaaattaaggaaatcttcataaagtagaacaaaaaagacagacatggataacatggggagtcaaaaataaagtaccgggtcataatccaggtggttgtggagaaggtgcagaggggtaggggaggaggagaggaaagaaggtggagaaagaggataaaacaaataagaaactctaggcaaggaacatcactatacaatttcagaacaccagggtaaagaaaagatcctaaaagcaaagtctcaaaaaggtcccgttttgtttttttcagaaatcttttaggaggtaagcctctaaaataaggaaataaatcaagaaagaggagaacacaggatgtgggggaatctcaggatggcagtggtccatcctggagcaaggggaaaagggatccacctagtatgtgaggtctgacaaccagatgaattgtactcagagaatgtacaaggaactgacaaaaagtttaaagaaatctgagccaattagagatagttaacttaagaaaaaaataaaaacgagttacacaagaaagaaaatattaatgcatgctacttggcgcaacaaagatcaatatctatctggtcataataaaaacattaaaggtctatgttaccaaaagtgtaatgtgttaaaggaggatgctaatgaggaagaggacacaaaagagctaagaaccatcatctaccagaacaaaacaccaaaagatatctcaaaagagtgcagtacaaatacagagttttggaaaatggaggtaagtaccaggaaatacaggtaaaagagctgaaaactgtcttagggcaatggaaaaaaaagatagaggactgctttattattcacacaaattcctctataaaataaaaattagtttaaagaacacttaaaagccaaccagacagacaagcttagaaagacagttctagagacacctgaggttgtcaccaaaactagcaacactgttacatggaaatcaaagaacagggctctgaagtgaaacaaaagccaaacctgaatcttaggtctgctgcttagtaggtatcagctttcccagattagactctctaactctcggaaaaactcaaaggatgctgtctggcctgctgaaattcaatggcagctcagctatttttaatgttgctaaaatctgaatctattaatctgacattaaagccaggcataatgtaagtcaaaaaagacaccagaagcatccagcttgctaagttaggcaaattaatttgtagctagactctaattacccatgttaaaggtaattcatttctatttttactatttctacactttactttttctcttggttttcaagtaaggttgaaagccttaaaaagaaattgtgtcaacctaatttgtctacgcctaaaccatggcaggtaaaatgatcagaatgttccccaaggctgtgtatgggggcggatgttaagagtcagagatagcgcacgcaaagaaaacgctcatggaacagaaagcgataggagtcaacaaccgagaggcagggcgctgaaatgaagcttgaccctttcctcttagaattttccctcacaggatttagggtccccagtccccttgctttctttctgtgtccaactgagatgttctgtgatgtggccagccgcatgtattcccctggaggctctgacccaagccaaggcctgccttgaacattcccaggcgctgacaatgttgtttaggctattgcttgaaacactgagaaattacccctgttgctaaacacacagaaactatccctggccctgaaccaaattccttcaacactcaaatcaactccctcaccttggacacatcttttcctgctgtctgctgagaggactgctgcagcactaaatgcttttgactgattaccctgagatttagtgttctggaaccccaactaggttcggggcagtcccttacaggaattcctctgcccctacttttagggcaacttcagccacaggttcagccagaaggaacacagaagatgggcttactccaatgatatcctcatctagacacttctgtaacttcttatctcaatggactactctaaatgacacagatggactacttatccatctgtgtcaatggactactctaagtgacaaagatctgtcctgggacactgtacttgtatttgatttttagatgcaaccaaaagccaatccaaatgagaacatttggattgcaaatgagaacaaatggattggaacatttggatggaaaacattggtgcccatgtggcgtaatgcagctctggaacaaaaatgggatggaatattaagtaacaagacttaatattctcagggaatcctggtctgactctgacaaaatcagagaggtgtttcaaaaagttctgaaaacactggagtagatgcttattattaattaccccaaatgacttctagaaccgttaaagaacttttttgaagtgtatttgttaataaaaaaattttcaatactcagaatcacatttaggtcaagctttctaggtccgatttctttctataagataaaaatgcctaattatttactactaactcatgcaagttcctgagaaaatagcaaaataactggctgctcaacattcactattagagcttcaatgtgcctttggaggtcatacattagcttcagtttcttcatcactttcattatcagaaatgaaatgagaattgtgtcagatggtatttatggttcttttcaactctagatggatacacacatctagggaataataactcctcccccccaccattttccagaaagaaggaattctaccttcttcatcaagtccaccgatgatgttgtaaacatagtatggaaagaagcgccttgaatacaggattgtagacagcattgcagcaattgcccccgtagtcatggccttattattggaatgcttatacatctgcaattattgataaaagtcacaggcatgtagaggcagaggccattatagactagaacaatcaacagtataaagtgaataaataaatgcataccacagtggaaggggaaagcatgcctatttccttcatgatcaaccaacacagtattactaacataaaattttaagggaaggaatgccaagtttgccctcagctctctggtttagactctattttccataccacccttatctcaggtactgctaatccaagagctaatgtgtatgaaagggcacatgaagtggcctaaggaagatgggtttaaatccatctctctccctcactctgcatatagaccaggggtcaacaaactacccctgtagtttggctcaggggccaaatccagcctactccctattgctatgaatattgtccgtggctgctttttcactacagaagcagatcaaatgaggcccataaagctgtaaatatttactatctggtcctttacagaaaaattacggcaatccctgatcaaacctagatgtaagtccctctctttgtggagcagatctctgtgagaacagaagacacagggcagcacccttactctgcatgattttaatacacagcagtggtcgtgatccttaaaacatctacagtagagaacacaagcatccaaaacagggtcttagcatgacaatacagtgactgcaaatcctagctttactatacctttgcgagccctacattacccactggtagagaaacttcacaaaaattataaacataaaatgaattcaagatcaccaatttttgttaaccacatagcaaacatctctaatgagaaacttaatggccaggcatagtggctcacacctgtaatcccaactgaggcgggagaatgtttgagcccaggagatgaaggctacagtgagctacaatggcgccactgtactccagcctgtgcaacaaagtgagacgctgtctctaaataaatagacagatagatatctaactagcaccgtaaaattaaataatgacagtcaaaacactgaaaaatgattagaaatgaactacaagtaacaggtaagttttttatagaggaatgcctttccaagataaaaactataaaaaattattcataggccgggcacagtggctcactgctggcctgtaatcccagcactttgggaggccgagatgggtggatcacctgaagtcaggggttcgagaccagcctggccaacatggtgaaaccccgtctctactaaaatacaaaaattagacaggggtggtgacaggtgcctgtaatctcagctactcgggaggctgtggcaggataatcacttgaacccaggaggcagaggttgcagtgagccaagatcatgccattgcactccagcctgggcaacaagagtgaaactctgtctcaaaaaaaaaaaaaaaaatttcattccatttcatttcgaaaccaagcaccaacatttatttacttcaccacctaataaagtatgagagaaaaacttcaggaaggggtgtgtattatgtagaattcaccattccttgttttattaacaatatcatgtttacttttgtcttctaactcccatttataaaataagcattaggaattatcatataaatatgccaataaatgtaagtcactatggctttcaatgtaagtttctaaaaaagcattaacaattgataaatactgagtgaaatcctttctacacattcaaaaagcatgtgtcagttaaataaatatactatatactccagtaaccactcataagtgtaaataatctcaagtgttattcatgaataggcaaaacagaatgtgatcacccctgacttctggcagctggctatcaactgaagctggtcaggtgacagacgttaatggtgcatgttgtgcctcccatccaagctcccagcttattcattctttcgtatttctactcatgcatcctgccaactaagagcacagcactgtaaagaggaaaagcttgtcaactgatggtgatgcaaaccaagctcctgtgtcaaatctttcctgggctctctcctgccacagaaattgatttgctttgtttttgagggaagagtatcttcagaagaagaactcctcccaggctccttctaaaagggtagagaacccttcatatgatacaagactttaacaaatggaatgtgctgctgtttcacattatgctactttaatgaccctgcattaatgatatcatttcatttctagcatacatttgtaattcatctactaacctagtgactctctagctatctgaccaacagtcatgctgtaggcttaaaagaatttaatgaattactattaatttaaaatagtgtagaaatgtacaaaagcatctacctttagtcttgcttcaataatctttgtcagcgtaagacagtctccatgaaaaccgctgcatccaatgactgttttgtctgttctgtaaaaagcacatttcagaaaactgagctggttagatagtagagcaaaacatatcttcggcaattttaaatttaaaattctgattcccactattccctaaatggtaatgggacaaacagtcacccttctggggaggaggggtctgtattccatcttaccccttattccagatgaattacaggtggatcaaagactttaaaaatgcgactatgaatggactaaataaatcatgggtgaattttttttactatcttgggctgaggaagatacgtaggtaggttaattgactgatttttgagacggagtttcgctcttgtcacccaggctggaatgcagtggcgcaatcttggctcactgcaacttccgcctcctgggttcaagcaattcccctgcctcagcctcccaagtatctgggattacaggcacccgccaccacacccagctgatttttgtatttttagtacagatggggtttcaccatgttggccaggctggtctcaaactcctgacctcaggtaatccacctgccttggcctccaaagtgctgggattacaggtgtgaaccactgcacccagcctcgtgaaggtagatttaaacaacacaatccaagggccacacagaaaaatttcataaatttgactacataaaattctacagggaaatttaagaatagctttttaaaaccctaagaaaatatattagtagcatctacccccaaagtctaattttaattctataaaaattcttacaaataaggaaagcaataacataaaggaaagatgggtaacttctatgaacagacaagtcacagaaaaaagagacattaagtcaccataaacataagagcctctatgttactcagaaatccaaatctcaaaaagagactatttcaaccaattatactggctaaaaatgcctaactaactaaatgctggtgaggttgtggaaacagtataaactgattaacctgttagatgggcaatttggtggtatttattaaaaatttaaatacacaccactctcaccaattctattgctagaaatccatcttgttaatatacttatccaagtatgcaaagggatgctctagactcaccagtgagtactcatttaaatagcaccccaaaacaaaacaaaacctaaatgtccatctgtatggagaggattaaaatttggtatagacatacaaattcaaccgtgtatttcaaaaattaattcctagatcttgatatgaatctataaagaaacctaaacaatattttgcagaggccacacaattcctcttggaaacttacgaatgactcgcacaaaccatacctgtcctactaggagagcagctgacacctctagggtcatcactaacatcacctgatctatgcctaccatcaacctcactgcactaaggtgaagacgtccaatcccctataaggctttactgcctttactgacaagattggttgacaataccaacagggaaagacagaaatcttagaacttcaagatgcttttcccaaatatccaggtgcatcaaaggaatgggagttttcatgcaaagaatacagtctgaaacaggtttggaagaggcaagcttagttctaggtcagacccacaggacgtgggatgagggatatatacaggcattcgttaatgctgcattgttcttattctctatctctatatctgacgtgtttcacaaaaaaaaaaaaaaaaagtgctcacttcaccagcaaacgtaactaaagcaatatttaaaagatgagtaaaagctagtacaaggatggtatccataaagttgttttaaaatcttatttctaatatttactactttcaagttgtacaagtgtcgtccttgaggagaaaaaaaggtaacacaagagcaccataaacagaaagcagaaagggggtatcaaaagatgcaagtggagagaaacagaactgggaagacgaaaacaaacttcattgctttttaagatgtgggccatccctaggagcaggaaagacaacgtatcttttcttctgtacctacttcctacaatacaaggagggtccatccaaaggacctaaacctcgtaagtcccattcctattacaattcaagtttaattaacccaggaattcatgaccatttataagcatttccaaaactggtaaatacagaccactgccaatctgcagtatgtattcagtatttatgcaggctttttgtttttttaagttttggctttattttcatgttttaggaaaaacatagctagcctattaaaactgagctgtggacataattgcttaggatatttctaaaacgaatgtttcaggtaaaaaaaaaaagtgtggggaggcagatttaaaaaaaatatcatttaatggattaatggtgctgtggtttgaatattcccttcaaaactcatgttgaaatttaattgccattgtgatggtactgggagttgggaccaggtgtttaggtcctagggctcagctttcatgaatggacattatcacagcagtgggttcgcttgctcttctttctttctctggccttccaccatgttaagacacagcaggaaatttttcatggtaaaatgctggggtgaacacatttaggttaccgaaagcacttttggtaccctgaatacagcaaatattattaagactgcacattaaattattaggaaacattaacttagaaaatggttttctaataaaaatgctcccaacagcaacttaaaaactcatgaaacaaatcatttagaagtagaaactctcacaacatcaaatcattacaaaggcattgtgaaatgtctttagaaatatttacttacaatttgtaacatttggggctatcccgcgtatgaattgaaaacccttcactcaatcgagtatcagaagcaacaattgcaaaatcttctccagcaattgccagtatagtactgaggaaaaaagaaaaaaattaattctccagggtggtaatcctatccctacaaatagaagaatgctccatagtacataatgggataaaatactctagatgtcaacaaaaacatgattcaaatgggaagaggaaagatgagcgggaagagaatgaacgcctggctacgagttgtctgggaaaaaaaaattattaataagcctaaatcagggcaaagtctccttggcaggagttaacagaaaagccaatgaattatcatcaccaacacattaaatacttactcgcgcaaggtactactaatacagaacaactaaataccacatctgtgcccttgaggatcaggtatagacagtggtactacaacgcaagctctatgagtttagagaagatgagatttttttttcttgcttcatttctttatatccaagtccttatataacgcctatataatgcttatttctttatacccaatcccttatataatgacaaatagatggacaaacagtaaatttttccctctgtggctgtacaatttgacagcttatcaaagagacttacagtagaattccaaaagcagaccgcctgggttctaattctggctttcccgtttcgcagatatgagactgtgggtaagttacttctcaaagcgtcaatttcatcatatatacaacagagatcactgcagttgctacctcattagggtgttcaaaggatcaaatatgtaagcccttatagcagtccctgacatgtaactggtcctctagtaagtgttagctataagtgctatggcactggagtatgactaagcacctgggctctggaattacatgagacagagacccactcttgctacttactaggtatgtgatcttggacaaatcctccaaatgcaagttgatgataacagtacctgtgtcacaaggtgtgtatatatatttgggtgtgtatattttaatgtacaaggcttgactgataactataaccactgcttcaatgcaatagtggaaattaaaggcatggtgcctcacagacgtaagcactcaggaaacttaagccactatttttactgaggagggatttgtgctaaagctctcaagaagaaaaggatggcattccaggtaatataaacagcaagcaatggcaaacaggtaattattcaaatagtacatacattcaagcaactcattcaggcagccctttttgcataagcacatgtagtgacgttaaggtttatgtgatggacagggttcctactgtagaaaatcccaaatgccaagctaaagattttggaattttagcaagaaatcatgaaggtattctgagcaagaatgatctgtagttgtaactactcaagaggctgaggtgggaggactgcttgagcccaggtgttcaaggctgcagtgagctatgatcgtgcctgggcattagagtgagacctggtctttaaaaaaggaatgcaagagagagaaaagttccatttacaaagtggggttttaggaagactgctctgacaataacatagtatgtgaaatgggacagaaacactgttctaatactactaatgcaatagtaaggtagcagggtgaacagtaaatccaaaatcatcacaaacacacaaaatagacaaatttttatatctacgcaaatgttttaggaactgggaaaaccaattatgacatccaagatttagaacttagatgaacagaatgatggcataattataagtattttaaaggagaggaggccgggcacggtggctcacacctgtaatcccaacactttgggaggctgagggggggggggggggtcaattgcctgagatcaggagttcgagaccagcctggccaacatggtgaaacccatctctactaaaaatacaaaaattagccaggcgtggtggcaggcacctgtaatcccagctactcgggaggctgaggcagaaatgcgtgaacccaggagttggaggttgcagtgagctgagatcgcaccgctgcactccggcctgggtgacagagtgagactctgtctcaaaaaataagaagaaaggagaagaggagatgaaggggaataattagcttgctttttgttttgctagctgtcttgagttgccctgagagcagaaaaaccagttaaaaatgttttactgaagaagccgaatcgagggactcatgagaggcagaactggaaaaccagatttgggagtaatcctcccagcaatgagacatgaaagagtgctgagcgataaacaaggcggctaatgacttaactacatttaaagacagagtaggaaaagagaatgaggcctcattttgcggaagcgaaggctgcctgagagccagctgcagtaaacactaaagaaaaagaacaatgactgagaaaaagtaatcagaaagatctaagtaatttttagggcagtaatggcttaaactggattacaagggattaaaaagtgagtaacgagtagggcatactgaacactgaaaattcttatttatagagaatagccttacgaaacgggtccaataaccctccctacaatatacaacttaattagtcatcacaggaagtgttaaggtgtataatggaaaagcatccataaactcagtggtgaaatagctatgaattaagtcctggctcaacttcacaccagctctctgaccctgacagtttaacgtctaatataaccctaggatgctaatatcatctaacattcacttttcatgaggattaaataagatgacagcttgcaatttacaaaatgcatctctcttgattctcaccaaaaactatgaagctactaaggaagataaggaaatttaggttcaagaagttcagaagtacccaaagtgtcctttagtggcagaaccaaggctaaaatcagactttcgttatctttctaacacactcccaaaatgtgcatttatatttcaaatttatgaggaaccaattaacatttttgctttgtttttaaaatttatttttgtagagatggggtcttgctatgctgcgcaggctggtcttcaactcctggcctcaagcgatgatcctcctgccttggcttcccaaagtcctgggattacaggtgcgagccacactgcccagccaatattttctgttttaagaaccatcggttcgttcaaattgcgtgtgtatattttaatgtacaaggcttgattggtaactataaccactgtttcaatttacagctcttccctgtcaagagtcttaaacagagcatctttctataaccctaaatctctggcgtgccaccacggaaaattatactactcaagataaagctggtaattaaaataaaaaccaaaacttgaacataacatacaagaacacacatactaaaaggtccatcttctgagtattttgttttcctgaacttaagctaaacgttaaaaaaaaaaagcacttatctatgaaactaagtttgctcagccaatcccaccttctatttgaaataaaacaaaatgattaaactgctacaattagaaataacagaaatcaggcggctacaattagacatctcggctaccaacccagctatgcatctaacaacacagaccaaacaaccctaacttttaagtttcagacgctaaccctctaccctcgccggctggcataagaaacgtgtacatgaggtccagttttaatggtcttccacagagcagaggctatgtttcaatttctactttactgtcttacagcagcaaggagcacggagtggcggtccacataaaaactcaaatgacatgactgtaatgggaaaccctaaaaaccaaggctgtatcgcaatcaccaagtaaacttgagcaaagcgagcctgaagagggaaacacagggcatgagaggacggcagggagaccggccttgtgcggaccccctcagctcagggttctgaggcctgcaggagcccggggcagcgccatcacggcggtgactcctaaataggcttcagcagatgggggaagggcgaaagtgaaagccgcagctctctggggtttttaccctccgttgaaaacgtagggcgaaaatcgcagctgcaaagggcccgcggctctgtgcggttccatccccaagtctctgccaggagccgaatacatggctgtagaggacaacatcgcacggctgcgcctgcggatccgacacttgctgtctcacggcgagatggctgccttgaccggacgttacgccacttccggcttctc

SEQ ID NO: 1845 - DNA, 9885 bp, Homo sapiens
gggccacccagaggctgatgctcaccatggggcgcctgcaactggttgtgttgggcctcacctgctgctgggcagtggcgagtgccgcgaaggtaagagcccagcagaggggcaggtcctgctgctctctcgctcaatcagatctggaaacttcgggccaggctgagaaagagcccagcacagccccgcagcagatcccgggcactcacgctcatttctatggggacaggtgccaggtagaacacaggatgcccaattccatttgaatttcagataaactgccaagaactgctgtgtaagtatgtcccatgcaatatttgaaacaaatttctatgggccgggcgcagtggctcacacctgcaatcccaccagtttgggaggccgaggtgggtggatcacttgaggtcaggagttggagaccagcctggccaacatggtgaaaccccgtctctactaaaaatacaaatattaatcgggcgtggtggtgggtgcctgtaatcccagctactcgggaggctgaggcaggagaaccgcttgaagctgggaggtggagattgcggtgagctgagatcacgctactgcactccagcctgggtgacagggcgagactctgtctcaaaaaatagaaaaagaaaaaaatgaaacatactaaaaaacaattcactgtttacctgaaattcaaatgtaactgggcctcttgaatttacatttgctaatcctggtgattccacctctctgttgttcccattttacagaaggggaaacgggcccaggggcagggagtgtggagagcaggcagacgggtggagagaagcaggcaggcagtttgcccagcatggcacagctgctgcctcctattcctgtgcaggaagctgaaagccgagctactccacacccgggtccgggtccctccagaaagagagccggcaggcaggagctctctcgaggcatccataaattctaccctctctgcctgtgaaggagaagccacagaaaccccaagccccacaggaagccggtgtcggtgcccggcccagtccctgcccccagcaggagtcacacaggggaccccagatcccaaccacgctgttctgccgcctgcggtgtctcaggccctggggactcctgtctccacctctgctgcctgctctccacactccctggccctgggaccgggaggtttgggcagtggtcctgggctcctgactcaaaggagaggtcaccttcttcttgggcgagctcttcttggggtgctgagaggccttcggcaggtcatcacgacccctccccatttccccaccctgaggccctctggccagtctcaattgcacagggatcacgccactggcacaaggagacacagatgcctcgcaggggatgcccacgatgcctgcatgtgttgcttctggttcctttcctccagttccaaccgccgcactctcccacaccagtgtgacagggggcccatcaccctagacttcagagggctgctgggaccctggctgggcctgggggtgtagggccaccctgcccttccccacctggaacctggcacaggtgacagccagcaagcaatgacctggtcccaccatgcaccacgggaagagggagctgctgcccaagatggacaggaggtggcactggggcagacagctgcttctcaacagggtgacttcaagcccaaaagctgcccagcctcagttccgtcagggacagagggtggatgagcaccaacctccaggcccctcgtgggggtggacagcttggtgcacagaggccattttcatggcacagggaagcgtggcgggggtgggaggtgtggtccctagggggttctttaccagcagggggctcaggaactgtggggacttgggcatggggccatcgactttgtgcccagccagctaggccctgtgcagggagatgggaggagggaaaagcaggccccacccctcagaaaggaggaaggttggtgtgaaacatcccgggtacactgagcattgggtacactcctcccgggagctggacaggcctcccatgtgatggcaaacaggccgacaggagacacggctgttgctcgtcttccacatggggaaactgaggatcggagtcaaagctgggcggccatagccagaacccaaacctccatcccacctcttggccggcttccctagtgggaacactggttgaaccagtttcctctaagattctgggagcaggacacccccagggataaggagaggaacaggaatcctaaagccctgagcattgcagggcagggggtgctgcctgggtctcctgtgcagagctgtcctgctttgaagctgtctttgcctctgggcacgcggagtcggcttgccttgccccctccggattcaggccgatggggcttgagcccccctgaccctgcccgtgtctccctcgcagctgggcgccgtgtacacagaaggtgggttcgtggaaggcgtcaataagaagctcggcctcctgggtgactctgtggacatcttcaagggcatccccttcgcagctcccaccaaggccctggaaaatcctcagccacatcctggctggcaaggtgggagtgggtggtgccggactggccctgcggcggggcgggtgagggcggctgccttcctcatgccaactcctgccacctgcagggaccctgaaggccaagaacttcaagaagagatgcctgcaggccaccatcacccaggacagcacctacggggatgaagactgcctgtacctcaacatttgggtgccccagggcaggaagcaaggtctgcctcccctctactccccaagggaccctcccatgcagccactgccccgggtctactcctggcttgagtctgggggctgcaaagctgaacttccatgaaatcccacagaggcggggaggggagcgcccactgccgttgcccagcctggggcagggcagcgccttggagcacctccctgtcttggccccaggcacctgctgcacagggacaggggaccggctggagacagggccaggcggggcgtctggggtcaccagccgctcccccatctcagtctcccgggacctgcccgttatgatctggatctatggaggcgccttcctcatggggtccggccatggggccaacttcctcaacaactacctgtatgacggcgaggagatcgccacacgcggaaacgtcatcgtggtcaccttcaactaccgtgtcggcccccttgggttcctcagcactggggacgccaatctgccaggtgcgtgggtgccttcggccctgaggtggggcgaccagcatgctgagcccagcagggagattttcctcagcacccctcaccccaaacaaccagtggcggttcacagaaagacccggaagctggagtagaatcatgagatgcaggaggcccttggtagctgtagtaaaataaaagatgctgcagaggccgggagagatggctcacgcctgtaatcccagcactttaggaggcccacacaggtgggtcacttgagcgcagaagttcaagaccagcctgaaaatcactgggagacccccatctctacacaaaaattaaaaattagctggggactgggcgcggcggctcacccctgtaatcccagcacgttgggagcccaaggtgggtagatcacctgaggtcaggagtttgagaccagcctgactaaaatggagaaacctcttctctactaaaaatacaaaattagccaggcgtggtggcgcttgcctgtaatcccagctactcgggaggctgaggcaggagaatcgcttgaactcaggaggcggaggttgcggtgagccgagatcatgccactgcactccagcctggagaacaagagtaaaactctgtctcaaaaaaaaaaaaaaaaaaaaaaatagccaggcgtggtatctcatgcctctgtcctcagctacctgggaggcagaggtggaaggatcgcttgagcccaggggttcaaagctgcagtgagccgtggtcgtgccactgcactccagcctgggcgacagagtgaggccccatctcaaaaataagaggctgtgggacagacagacaggcagacaggctgaggctcagagagaaaccaggagagcagagctgagtgagagacagagaacaataccttgaggcagagacagctgtggacacagaagtggcaggacacagacaggagggactggggcaggggcaggagaggtgcatgggcctgaccatcctgcccccgacaaacaccaccccctccagcaccacaccaacccaacctcctggggacccaccccatacagcaccgcacccgactcagcctcctggggacccacccactccagcaaccaacgtgacctagtctcctggggacccaccccctccagcaccctacccgacccagcttcttagggacccaccatttgccaactggggctctgccatggccccaactctgttgagggcatttccaccccacctatgctgatctcccctcctggaggccaggcctgggccactggtctctagcaccccctcccctgccctgcccccaggtaactatggccttcgggatcagcacatggccattgcttgggtgaagaggaatatcgcggccttcgggggggaccccaacaacatcacgctcttcggggagtctgctggaggtgccagcgtctctctgcaggtctcgggatccctgtggggagggcctgccccacaggttgagaggaagctcaaacgggaaggggagggtgggaggaggagcgtggagctggggctgtggtgctggggtgtccttgtcccagcgtggggtgggcagagtggggagcggccttggtgacgggatttctgggtcccgtagaccctctccccctacaacaagggcctcatccggcgagccatcagccagagcggcgtggccctgagtccctgggtcatccagaaaaacccactcttctgggccaaaaaggtaaacggaggagggcagggctgggcggggtgggggctgtccacatttccgttctttatcctggaccccatccttgccttcaaatggttctgagccctgagctccggcctcacctacctgctggccttggttctgcccccaggtggctgagaaggtgggttgccctgtgggtgatgccgccaggatggcccagtgtctgaaggttactgatccccgagccctgacgctggcctataaggtgccgctggcaggcctggagtgtgagtagctgctcgggttggcccatggggtctcgaggtgggggttgaggggggtactgccagggagtactccggaggagagaggaaggtgccagagctgcggtcttgtcctgtcaccaactagctggtgtctcccctcgaaggccccagctgtaagggagagggggtgccgtttcttctttttttttgagatggagtctcactgttgcccaggctggagtgcagtgtcacgatctcagctcactgcaacctccacctcctgggttcaagtgattctctgactcaacctcccatgtagctgggactacaggcacatgccaccatgcccagataatttttctgtgtgtttagtagggatggagtttcatcgtgttagctaggatgatctcggtcttgggacctcatgatctgcccacctcggcctcccaaagtgctggaattacaggcgtgagccactgtgcccggccccttctttattcttatctcccatgagttacagactcccctttgagaagctgatgaacatttggggccccctcccccacctcatgcattcatatgcagtcatttgcatataattttagggagactcatagacctcagaccaagagcctttgtgctagatgaccgttcattcattcgttcattcattcagcaaacatttactgaaccgtagcactggggcccagcctccagctccactattctgtaccccgggaaggcctggggacccattccacaaacacctctgcatgtcagccttaccagcttgctacgctaaggctgtccctcactcattcttctatggcaacatgccatgaagccaagtcatctgcacgtttacctgacatgagctcaactgcacgggctggacaagcccaaacaaagcaacccccacggccccgctagaagcaaaacctgctgtgctgggcccagtgacagccaggccccgcctgcctcagcagccactgggtcctctaggggcccgtccaggggtctggagtacaatgcagacctcccaccatttttggctgatggactggaacccagccctgagagagggagctccttctccatcagttccctcagtggcttctaagtttcctccttcctgcttcaggcccagcaaagagagagaggagagggaggggctgccgctgaagaggacagatctggccctagacagtgactctcagcctggggacgtgtggcagggcctggagacatctgtgattgtcacagctggggagggggtgctcctggcacctcgtgggtcgaggccggggatgctctaaacatcctacagggcacaggatgcccctgatggtgcagaatcaaccctgccccaagtgtccatagatcagagaagggaggacatagccaattccagccctgagaggcaaggggcggctcaggggaaactgggaggtacaagaacctgctaacctgctggctctcccacccagaccccatgctgcactatgtgggcttcgtccctgtcattgatggagacttcatccccgctgacccgatcaacctgtacgccaacgccgccgacatcgactatatagcaggcaccaacaacatggacggccacatcttcgccagcatcgacatgcctgccatcaacaagggcaacaagaaagtcacggagtaagcagggggcacaggactcaggggcgacccgtgcgggagggccgccgggaaagcactggcgagggggccagcctggaggaggaaggcattgagtggaggactgggagtgaggaagttagcaccggtcggggtgagtatgcacacaccttcctgttggcacaggctgagtgtcagtgcctacttgattcccccagggaggacttctacaagctggtcagtgagttcacaatcaccaaggggctcagaggcgccaagacgacctttgatgtctacaccgagtcctgggcccaggacccatcccaggagaataagaagaagactgtggtggactttgagaccgatgtcctcttcctggtgcccaccgagattgccctagcccagcacagagccaatgccaagtgaggatctgggcagcgggtggctcctgggggccttcctggggtgctgcaccttccagccgaggcctcgctgtgggtggctctcaggtgtctgggttgtctgggaaagtggtgcttgagtccccacctgtgcctgcctgatccactttgctgaggcctggcaagacttgagggcctctttttacctcccagcctacagggctttacaaaccctatgatcctctgccctgctcagccctgcaccccatggtccttcccactggagagttcttgagctaccttccatcccccatgctgtgtgcactgagagaacactggacaatagtttctatccactgactcttatgggcctcaactttgcccataatttcagcccaccaccacattaaaaatcttcatgtaataatagccaattataataaaaaataaggccagacacagtagctcatgcctgtaatcccagcacattgggaggtcaaggtgggaggatcacttgaggtcaggagtctgagactagtctggccaacatggcaaaaccccatctctactaaaaatacaaaaattatccaggcatggtggtgcatgcctataatcctagctactcaggaggctgaggtagcagaattgattgacccagggaggtggaggttgcagtgagccgagattacgccactgcactccagcaggggcaacagagtgagactgtgtctcgaataaataagtaaataaataataaaaataaaaaataagttaggaatacgaaaaagataggaagataaaagtatacctagaagtctaggatgaaagctttgcagcaactaagcagtacatttagctgtgagcctcctttcagtcaaggcaaaaagggaaacagttgagggcctataccttgtccaatctaattgaagaatgcacattcacttggagagcaaaatatttcttgatactgaattctagaaggaaggtgcctcacaatgttttgtggaggtgaagtataaattcagctgaaattgtggaacccatgaatccatgaatttggttctcagctttcccttccctgggtgtaagaagccccatctcttcatgtgaattccccagacacttccctgcccactgcccgggacctccctccaagtccggtctctgggctgatcggtccccagtgagcaccctgcctacttgggtggtctctcccctccaggagtgccaagacctacgcctacctgttttcccatccctctcggatgcccgtctaccccaaatgggtgggggccgaccatgcagatgacattcagtacgttttcgggaagcccttcgccacccccacgggctaccggccccaagacaggacagtctctaaggccatgatcgcctactggaccaactttgccaaaacagggtaagacgtgggttgagtgcagggcggagggccacagccgagaagggcctcccaccacgaggccttgttccctcatttgccagtggagggactttgggcaagtcacttaacctccccctgcatcggaatccatgtgtgtttgaggatgagagttactggcagagccccaagcccatgcacgtgcacagccagtgcccagtatgcagtgaggggcatggtgcccagggccagctcagagggcggggatggctcaggcgtgcaggtggagagcagggcttcagccccctgggagtccccagcccctgcacagcctcttctcactctgcagggaccccaacatgggcgactcggctgtgcccacacactgggaaccctacactacggaaaacagcggctacctggagatcaccaagaagatgggcagcagctccatgaagcggagcctgagaaccaacttcctgcgctactggaccctcacctatctggcgctgcccacagtgaccgaccaggaggccacccctgtgccccccacaggggactccgaggccactcccgtgccccccacgggtgactccgagaccgcccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggggccccccccgtgccgcccacgggtgactccggcgccccccccgtgccgcccacgggtgacgccgggcccccccccgtgccgcccacgggtgactccggcgccccccccgtgccgcccacgggtgactccggggccccccccgtgacccccacgggtgactccgagaccgcccccgtgccgcccacgggtgactccggggccccccctgtgccccccacgggtgactctgaggctgcccctgtgccccccacagatgactccaaggaagctcagatgcctgcagtcattaggttttagcgtcccatgagccttggtatcaagaggccacaagagtgggaccccaggggctcccctcccatcttgagctcttcctgaataaagcctcatacccctg

SEQ ID NO: 1846 - DNA, 14876 bp, Homo sapiens
accctggctggaggatattttatggactataaattcctaaacaattataataacttagttatttatcctatccatggatcacctggaagtttacaatgtgatttaaaatgcattctatcattccaccgacctgcagtgaattttgttgtcattattactccagggatacctaaaggggaagtttgtttataattcgtacccactccttgtagaaaggattcaagacagccgatgatgaaaacacccatgcttgcaagtgaaggttctgcctgtcacttctcgcagaggctgcagaaaaggcccaggaggctgttgatgacatgaacgaccaccaggagaagctggagcaggctgatgcacagaagggcggagaagagggacacgtgccagacaacagctgcagagggctccaggcagacggagttccagagcgaacggtcatacagataattcctatcccaaaaaataaggagaccaggggtcaggcgataagtaaggaaagccaaacaggcaaccccagtagaaaactggggtctcccctgaccgggtcatgggactgggctcatgagggtgaccgttactgctccatttgcaattttctgagtatcagaggagcaagatgctaggatgtgtgacccaaaggagcttgtagttcgtctgtgtgtctttttgtctctctctctctctctgtctgaaaagaccaagcccaagcctccacccatttacctactatgcaggtctttgaatgggtaaccatatttccaagcttgtgtctgattgaaggatgaaacatcaaacatgcaaaaaggaccatctttcagagcaactccagaagtgacaaagcaaatcagggctccaagtaaagccaggccacctgacaacagagcagtaagcacctgcggagggaggagaaacactgagctaagacggggtcgcagctggggagcctgcggagggaggagaaacgctgagctaagacggggtcgcagctggggagtctgtggggcggtctgcacaggtctgacttctctggtctcagtgttcttccgtcctgtcatgggggagaattctgtccatggcaccccctttgaagcataacccatggtggggaggccgtgaggggtttctaggagagaaaggaccaagaagcagaatcgcaggccccggatctccctgaccgtgagttcgcctgagctgctcagcagcttggcatcacaaaccttttgcacattacagccattcagcctctgagctaaagaagaagctaccacaggcccaccactgactcttctaaggaaaagctgcattttcaaaagttccaggttcccaactctgattcttctctatttcaaatcaaggataaaaaaaaggaagggagggaaggaaggaaagaaagaagcaggaaagaagggaaggagagaagtgggagggagggaaagaagggagagaaacagcgagagagaagctgcagccaagctctgaaatgactccacttctgtcgctgtgtttctccagctgagagctttcttggccatcagtctgtgctcccactgccctcccagaaaataactgggtttccttccttgacaggtttctagcctgcttctacattggcttctttctcgttccttccttccttcccttccttccttctttctctctctctctttctttttgagacagagtctcactctgtcgcccaggctggagtgcagtggcacgatctcagctcactgcaacctctgcctctgagttcaagcgattctcctgcctcagcctcccaagtagctgggactacaagcatgcgccaccacacccagctaatttttgtatttttagtagaaatggggtttcactgtgttggtcatgccggtctcaatctcctgaccttgtgatccacctgcttcagcctcccaaagtgctgggattacaggcatgagccaccgtgcccggcccatattggattctttcttagggttctagatttttttctccctcccccaaaaatgcctattttaaaaatgtgaataacacctacatagcgtttttctgcagagtcatggagtcattctcccactgaggtcaagctggtttggagttggggagggatcagacaaaggtgcatagtaagttttgactctgagttaaaggagtcaagatgaatcagtaagcctagggcagtggttcccaaaatggggtccctgcccagccgcatcacatcacctgagaacctgttagaaatgcaaaacttccccgccatcctgaatcagaaactctggggagggagcccagcaatccgtgttccggcaaaagccctccaggtgattctcatgcacattcaagtgtcagaactacgtgccacggggaaaaccagaatgagaacagacagtgaatgaaatgtgcaagtgtttatttatttatctatgtacttatttatttatttattttgaaacggagtctcgctctgtcgcccaggctggagtgcagtggcgccatctcggctcactgcaagctccgcctcccgggttcaagagattttcctgcctcagcctcctgagttgctgggattacaggcgcccaccaccacgcccagctaatttttgtatttttggtagagacggggtttcaccatgttggccaggctggtctcaaactcctgacctcaggtgatccgcccatcttggcctcccaaagtgctgggattacaggcgtgagccaccgcgcctggcctatatttgattttttaacatgtaactgagtcagtgggcttcccaacatgtgggctgcagatatcagagcaggctgtggagttaccataaggccacagattcatgtctgagaacgagtgtgtgtgtgtgtgtgtgtgtgtgtttgttacacacacatatactgagatctttcaagtttatacagttgctgctgtaattaataaggtagaaatttattctgggcctcagtttatctgtaaaatggaggggttagattagaatctagtgattagatgatctctggaaaactttcctgttctaagaaaatattagttaaaataactaggaaaatttccatcaatgacacatgattacagtgtcataactcatgtccatattgtccaacaccctaagagagtaacagtttctcacactggtacagacgtctgggtcctcacactggtacagacgtctgggcttcactaagcactactcccttgacttgatcagctcccattttacagatgaaagcctgaaactggaaagatgaagcaacttgcccaagaacttagcgttactgagggtcacagtgaggacctgacttcaggccccaagaccaaaattgcctctttaccgccctgcctctagagtaatagaggtggagacattctgggtgttagaagagtggaatctggtgcttacgcttcgacagagcccactcttactgaagcagccgtatctccagcccatcaaggagatgaggatagctgcagtgagtacctgcaggagagagaagaatgttgagatggggaaatcgactttgccggctgtttctaggtgctgcccacagctgttagagtggctggcagctcacatgaacgcagtcctgttgactctgactctggggacccacatttgtatgacgagcctgatctaacgctgtggatgttaactttcacacccgacctgcctggtcccaagctaggcttcctgtctcttagagcttctacagacccaagatcagcttgttagaataaacttttctgcaaggaatcaaaacactcttcccatgccaccttcctgctccccgccggggtctctttgagagttcacgttcagggaaccccggacacttaccatgaggcctcctccccagagcccagttcccagcatggcatgcctgccaaggaggcccctcaacaggtaggtgacatcccagttaggaaggaggagtgccacgttggccccagcagcaaacagggctgcagtcccaaggctcagtcccaggatacgggagcaagtccgtgagcttgcctgcgtgcagggagaggacaccatcctggaacagatagaaagggagtcgcagcagctctgctgtggggggatggggaagggaactccagcagcatatcatgggtgagggaaacagactacagaaaccgccaccttccagggtcagaccaatgagagccaagcaacctgcttaaaaactctgctccttaggaatcttccccagtgactaggatttaattgtttccttttctgctaacccctgttcacacatacatagtttgcattccatcatattttgtttatgcctctattacagccagtgattatttctgacaaaaagaaatgtttaaaggtgtcttcatgatgtccattgtctccacttctattcaacgttgtactggtcctggccagtgcaatacgaaaataaaaggaagcaaaagccacacagataggaaagaaagaagtaatattgtcggccaggcatggtggctcaggcctgtaatcccagcactttgggaggctgaggcaggcggatcacgaggtcaggagttcaagaccagcctggccaacatggtgaaaccccgtctctactaaaaatacaaaaattagctgggcacggtggtgggtgcctgtaatcccagctactggggagactgaggcaggagaattgcttgaacccgggaggcagaggttgcagtgagctgagatcatgccactgcactccagcctgggtgacacagcaagactccatcttaaaaaaaaaaaaaagtaacattgttattattcacagataatgtgatcacattatgtagaaaatcctaaagtttattagaattaacaggtgagtttagcaacgtcatagaataaaagattaatatacaaaaattatattgtatttctatatacaagcaatgacaaattgaggattgaaattaaaatatatcatttacaatagcataaaaatataatacatatggatgaatttaacaaaatatttgcaagacctatatagtaagaattgcaaagcattgctgagaaaattaatggagacctaaataaatggagacatataccatgttcctgaaccagaagactcaaaatagttaacatgttctccctaaattgatgcaaagatttaaagcaatatcagtcaaaatcctaggagagttttgttatagaaattgacaaactgaatctaaatttatatggaaatgcaaagcaattgtgaagattagccaaagcaattctgaaaaacaaacaaagctggagaacttacgccatgtgatttcaagacttacaaagctacagtaattgaagacactgaagccacgcgtaaggaaacacatatggactactggaacaggctggagctcagaaacagacccggtccaggaaaaatgattttttttttttcttgagacggagtctcgctctgttgctcaggctggagtgcagtggcgcgatctcagctcactgcaacctctgcctcccaggttcaagcgattctcctgcctcagcctcccaagtagctgggattacaggtgcccgccaccatgcccggtaattttttgtatttttagtagagacggggtttcaccgtgttagccaggacggtcttgatctcctgacctcgtgatccgcctgtctcgggctcccaaagtgctgggattacaggcatgagccaccgcgcccggccaataaatgattttttaagaagatgacaattcagcgggaaaaagtctcttccacaaatggtgccggaacaatgcacatgcaaaacaaaactgccttcactattacttcacaacatattcaaaaattcacttgaaatggagcatgggtctaaaagctttataaaatttctagaataaaacaaaggagaaaaacactgggaccttgggttagataaaggtttcttactaaaatgcaaaaagtacaatccacaaaacatgattaatcagactgcttaaaaatttaaatgtcagctgggtgcttgcctataatcccagctactcggaggttgaggcaggaaaatcgcttgaacccaggaggcagaggctgcagtgagctgagatcgcgccactgcacttcagcctgggcgacaagagcaagcgactccatctaaaaaaaaaaaatcatgctaaaagaaataagccagacactaaaggacaaatattgtatgattccacttatatgaaatattcaaaataacaactttatagagaaagaaagtagactggaggttatcagggactgtggggagggaggagagaatggggagttattgtttaatggttacagaggttttcaggttttgttttgtgttgttttgttttttttttttgagacagagtcttgctctgtcagccaggctggagtgcagtggcgcaatctcagctcactgcaacctctgcctcctgggctcaagcaattctcctgcctcagcctcccaagtagctgggactacaggcatgtgccaccacgcctggctaatttttgtatttttagtagagacagggtttcactatgttggccaggctggtcttgaactcctgacctcaggtgatctgcccgcctcggcctcccaccgcgcgcggtggttttggggtttttttagagatgcagtctcactatgttaccccagctggtcttcaactcctggactcaaatgatcctccagcccgtgcctccagagtagctatgaccagatctgggccactgcccacggtttaagggttacagactttctgtttggggtgaagaaaagttttggaaatagataatggtaatggttgcacatcattgcaaatgtaattaatgtcactgaattatacactttaaaatggttaaaatgacaaatctgatgttactttaccacaataaaaaatcaattaaaaaatttgtgattactcaaatccttatcagtaatcaataggtgaatcaagacaaattgtgttatccatacaaatgagttctattaggtaataaaatgcgtaaatttctgctacatataacatggatgaatctcaaaagcattgtgttaagtggaagaagccagaaacaaaagactactcacatgtttctatatatacgaaattctagaaaaggcaaaacttttaacggagagcagatgagcggttgccatgggctgagaatgggaaagaggattagtatggggcatgggaagctttctgaaggggtggaagcattctgtgtctagattctggtggtgaatacataactgtacatattgacaaaactcattaaactttgcacttaaaataggtgaattttattgaattttaactatatatcaataaagctaattacaattaaaatgtcatatctagataaattataaaatgcctcttccactccttatgttcctctcttttatattttcattgatatgtgaacttcttgttttttagaaaaatatgaattaaggccgggcacggtgacttacacctgtaatcccagcactttgggaggccaaggcaggtggatcgcctgatgtcaggagtttgagataagcctggtcaacatggtgaaaccgtgtctctattaaaaaatacaaaaaaattgctggacgtggtggcaggcacctgtaatcccagctactcgggtggctgaggcagcagaatcgcttgagcccaggaggcagaagttgcagtgagcagagatcgtgccattgcactccagcccaggaaacaagagtgaagctctatctaaaaaaaaaatatatatatatacatatatatatgaattaaaataggactagtaatatttgggcagactcatgtcaatgtggatctgaaaaaagtcagcgtcatgacatccccaggaagtggcctgttcccactgtgcagttcagttacacgtctgtctccccttaaggctcgctatttatttatttatttaatttatttatttattttttattgaaaaaaatttatttttagccgggtgcagtggctcacgcctgtaatcccagcactttgggaggccaaagccggcagatcacctgaggtcaggagttcaagaccagcctggccatcatgacgaaaccccatctctactaaaaatacaaaactagccgggcgtggtggcgcatgcctgtaatcccagctactcggaaggctgaggcaggagaatcacttgaacccgggaggtggaggttgcagtgagccgagattacgccactgcactccagcctggacaacaagagtgaaactccgtctcagaagaaaaaaaaatgtaatagaggtgaggtctccttatgtggcccaggctggtctcaaactccttggctcaagggccctcccacttcagacacctaaagtgctaggatgacaggcgtgagccactgcacttggccacttgaggctcttgacacgcctataacacactgctttgcacctaatcagaaaatatgtgtatagaggccaggcacggtggctcacgcctgtaaccccagcactttgggaggctgaggtgggtggatcacgaggtcaggagtttccgaccaacctggccaacatggtgaaaccccgtctctactaaaaatacaaaaaaattagctgggcatggtggcgggtgcctgtggtcccagctactcgggaggctgaggcagtagaatggcgtgaacctggggggctgagatcacgccagtgcactccagcctgggcaagagagtgagattcggtctcaaaaaaaaaaaattaactgcgtggtggtgtgcgcctgtaatccaagctactcaggagcttgaggcaggagaatcgcttgagcccgagaggcagaggtggcagtgagcccagatcacgccactgcactccagcctgggtgacagagcaaaagagagagagagagaggagggagagagggagggagggagggaggaaggaagaaaggaaaggaaggaaggaaagaggaaggggaaggggaagggaagaaaaaaaatatatatatatataaaagatatggatcagaggctctatatatatgcacacacacatatatatcatatacatataatgtataatgtgcgtatatatgtgtgtacgtacacacacacacacacacaatagtcccccatatctgcaggggatatgttccaagagctccagcggatacctgaaaccacagatcataccaaactctgtatattcagatgcttctccacttatgatggggtcgaactcctataaacccgttgtaagtcaaaatatcctaagttcaaaaggcatttaatgctggcaacacagtagactgtccctgactcacaatggttcaacttacaattttttttttttttttttttttgagacagggtcttgctctgtcacccaggctggagtgcagtagcacaatcattgttcactgcagccctgatctgggctcaagtgatcctcccacctcagtctctcggatagctgagaccgcaggcatgcgccaccatacctggctaatgttttagttctatagagacagggtctcactatgttgcccaagctgatctcaaactcctggcctcaagtgatcctctcacctccacctcccaaaatgttgggattacaggcgtaagccaccacgcccagtcccaatttacttttgactttgtgatggtgcaaaagcaatgagtattcagtagaaaccgtaatcccatcataaagggtaaggagttcactgatgatggagttaggtccctagaaacctgtcgtaaagttggaaacttagaagtcaaaccactataagtagaggactgtctgtactatgctttttcctatacatacatatctgtaataaagtttaatttataaatcaggcatagtaagaagttcgcaacaataataataaaatagaacagttataacaacatactgtaatgaaagttatgtgaatgtggtctttctcattgaaaatattttatgtaagttttttgaactgcagttgaccacagatagctaaaactttggaaagcaaagcttcagttaaggggggattactttacatcacacataaataatgaaatatttcacagcatgaagaattaaacattgggggagggccagggctgaaaaactatctgtaggtaccgcgctcactacctgagtgacgggaatcactcataccctaacctcaacatcacacaatagacacggaacaagcctgtatatgtatccccggatctaaaataaaagttgaaattatatttttaaaatttgcattaaaggccaggtgcagtagttcacgcctataatcccagcactgtgggaggccgaggcgggtggatcacttgaggtcaggagttcaagacagcctggccaacctggcgaaacctcatctctactaaaaatacaaaacttagctgggaatggtggtgtgcgcctgtaatcccagctactcaggaggctgaggcagaagaatcacttgaacctgggaggcagaggttgcagtgagccaagatcgcaccactgcactccagcctggaccacagatcgagactccgtctcaaaaaaaaaaaattgcattaaaaaagaattaaacataatgtgtaaaatatatttgtaacttgtgtgagataattaacacccatgtaaacacaaccaatatcaaacatacgtcattacccatcacatcactgacactcaggtgtgccctctccaatcctgccttctttctggattccttcctaggaactactatcctatatttcatcttcaacatatccttttaaaaacagttttacgacttaggaactcagaattgttttagaaacttgtttagtcgggtgttttccatttttcaagactgtagcttttcttttctttttctttttttttttgagatggagtcttgctctgtctcccaggctggagctcagaaacagacccggtccaggataaataatttttttttttcttgagacagagtctcactctgtcgctcaggctggagtgcagtggcgcgatctcagctcactgcaacctccgcctccccggttcaagcgattgttctgcctcagactccccagtagctgggactacagctgcacaccaccatgcccggctaatttttgtatttttagtaaagacagggtttcaccatgttggccaggctggtcttgaactcctggtctcaagtgatcctcctgcctcggtttcccaaagtgctggaattacaggtgtgagccaccaaacccggccagactgtagcttatggtaaagaagacaaggggaggggtgccctgggagggtgggggtaggagagaggaagggtgccctgagaaggtgggggttaggagaagggaggggtgcactgggagggtgggtgtaggagagggaagggtgccctgagaaggtgggggttaggagaagggaggggtgcactgggagggtgggtgtaggagagggaagggtgccctgagaaggtgggggttaggagaagggaggggtgcactgggagggtgggtgtaggagagggaagggatgccctgagaaggtgggggttaggagaagggaggggtgcactgggagggtgggggtaggagagggaagggatgccctgagaaggtgggggttggagaggggaggggtgctctgggagggtgggggtaggagaggggagaggtgccctgggagggtggccagaggacaggggaggagtgcacagggagagtgggggtaggagaggggagggatgcacggggagggtggaggtagcagaggggaggggtgcatggggagggtgggggcaggagagggcaggggtgcttggggaggggttgtaggaaagaggaggggtgcactgggagggtgggggtaggagaggggaggggtgcactgggagggtgtgggtaggagaggggaggggtgccctgggagggtgtgggtaggagaggggaggggtgccctgggagggtgggggtaggagaggggaggggtgccctgggagggtgggggtaggagagaggtggggtgccctgagagggtgggcgtaggatatgaagcaacagtgactcctaccccaggggcccaagggtcctggggcagggtggggtcaggaatcgggagggatggggtgtctcttcccccatcaaccctctggctgacaggccaccggactcctcagtcacagcaaggaacctgtcctgctcctgggagcagggcgcctgtggagaacggccccctcacagcctgcccacactgctgcgatgtccccgcatgtctgcacatcctccctccgagacggtcccatcgtgcagtgcggggcttgcagtgtgtaattctgtgttgaggcaaattaaccacccagggtgttaacaactcacaactttaatccactgcccacccagatgtctgaccggggcccaaggaaagatgggtgtgtggttggcctttcaagcgggtgctctagatcatggggccaggagacgccgttgtgcaggaatgcatttagtgccttcaaatcacggcacctctgagaaagcaccgtctacacacttcagcaacatcaacccccctgacgatctcttctacagaaaacgttcccatcagaaaagtctgttttttttgtttttgtttttgttttgttttttgttttttttttgagacagagtttcactcttgttgcccaggctggagtgcaatggcgcggcctcagctcactgctacctccgcctcctgggttcaagtgattctcctgcctcagactcctgagtagctgggattacaggtgcacaccactacgcccggctaattttgtatttttagtagagatggggtttctccaggttagccacgctggtcttgaactcctgacctcaggtgattcacctaccttggcctcctaaagtgctgggattacaggtgtgagccacagcgcccagcccagaaaactcttaaaggggaaactaaaaatgatggacagcgagggaaaactaccagctggagcatggcttttggatgagtggaattcagagccctggctgtccgccaatcaaacactaaaagcacttgccgcactgcggcttcgtgtgaatttcacccctcctcctgactttattcccctagaaattataacatttggagaaacccttccaaaaatgtgaaccaggaggttagcaaagaggtggcctaatttgatatctgaagagacaagcaagatcagaaggtaaaaccttaaaaccaggctgctggggagttccttgttctgtcctgaggtcctagctaggtgagcacgtcatcggctagatgtccaggcaacaacagaagtgatcggctcaattccatggaggaagagaccgcacattctctacatctgtgtctctccctcgccacccagcaaggcttttctttcattcttccttcagtcggatatttattaagtgatcactacctgacagacacttggggggctagggatataacgatgaaaaagatgtaatccctttccttgaggagcttaaagtctagtggggacactgctgacgcaaaaagcaattctttttttttttttttttttttttttttgagacacagtctcgctcttgttgcccaggctggagtgcagcggcatgctcttggctcactgcaacctccgcctctcgggttcaagttattctcctgcctcagcctcccaagtagctggaattacaggcatgcaccacgcccggctaattttgtatttttagtagtgatgggttttcgccatgtgggtcaggctggccaaaaagtaattctaatcaagtgtggtaagaaatagagcagacatgagcagggcgggagagggcctctaccccagtaatgtcaggtgactatcaggtgatggccaggcggttgttacactgtctttctaaaataatattggtcacagccagcgttgggaaagacagtctcccaatagatagaaaatacctgaacttggtgatcagcagcttcctggtaagagctcaggaattgggcgagtgggctcaagcatctacactaagaagcaaaatggtggagtttagctggtgtgtgtgaccttcctctagtgctgctccgcgggtaagggaaaaacgcctcaagtgagcatgcgcacgacttcagtaaacacactgcgcatgcggcccctcccaagtgcctgtgcggcaggcaggcgccaagtcaagggtctaacagcacatttgggtgtctcaagtcacgcacttggcccttttccaagtgtactttacttcctttcattgctgctcaaaaactttttaataaaccttcactcctgctctcaaacttgcttcagcctctccctctgccttaaacccacttctgcccctcagccgaatctctcccccgagaaggcaaggattgagtttgctgcagactcgctggattcacagctggtaacagtaagtaccaggcaggggcatccaacttaaggtgtcatggaagcacatggaggaacctaatcctatctggcagaagcaaaacgaagcttcccggaggaagggctgcccatgcccaaacttgatggacgatgagatactaggcaggaagagtattctaggtgcaaaggccagaagttgacagactgaggcaacaggagaaggtaagtgaatggcgcaaagtcacacagacgccaagctgcagagccaggctcactggagtggaagcgtgcactctcatctgtgaggctaggctgttccctggccgtcacctcaccctttcatctctgcttacctgcatctggtgtcaagaatcagaatgggagagacagaacctggagaaaggctgcgtcttcagagtggggctccactcctccagctccagggctggacctgaaggttgtctttccaggactctttccaggagggccagggaggctctgtatatacgt

SEQ ID NO: 1847 - DNA, 14876 bp, Homo sapiens; identical to SEQ ID NO: 1846

SEQ ID NO: 1848 - DNA, 14876 bp, Homo sapiens; identical to SEQ ID NO: 1846

SEQ ID NO: 1849 - DNA, 16350 bp, Homo sapiens
gttacagtggttaaagtcaaacatttattaggtatctgctgttgggggtggggtggggagattgtttgagatactgcaacagacacaaaagcaaagaaagaaacatttctgccagcttacaggctcacagaagaatgagacacttacgcatggccatgatacacagcagtgaaaggtttaagtgccataaggactagaaaaggaaggagaaagacctgtggatgagggccgttaagattttcatgaagaaagtagtgtttaaggtgaactgttttagtgtgagaaggatttcaacaagaaggcattcaacaaacatttattgagccgttatgtgccagacactgtagtaactgggaatgaaaagacatgggagaaaagggaccaaacttgcctagagaacaatgaatagttctatttgggtatgtgtaggaatgaagtggaaagtaaggcttcgaagagccttgaatgccaggctgaggtgttctatgaaaaacaacaaaaaacagcagcagagaagttttgttttttattagctgcagtttagaaagattgatgcttcagaacatagacagaaggaccaattaggaaattgctatgattactcagttaataagtgtaggcagtgataattgaaaagagggaaatgatatgagaaagtttgtggaagtgaaatcttaaatgatttaataccattgagtttatgcgaaagtactaaaaactcttgaggttttctgtctatgtgactagaaaatagaaatatatgagtcaggactttatgggagaaagttttagcattggccctatgatgatgtagatatggatgggaagtccagtatagatgtccaacagtcatttcttatttactaagcaatgtctaatatttggggcactgtttagggtgaccaggatacagtgctggacaaagcagactgggtagtaaatgttggtgaattaacttttaaaagatgactcttggcttcttgggagaacaaattgtaggagagcaggaaaagaaacatggagacagatgagagcaatgtgacgtggacagtgttgatggctgtggagatgcagagacatgagtaagtaaatcagctgaatactttagaggtagacttggtagggctttgcagttggattggggaggagacatgagagaaagggtgtaatccaagttttggcttgagtaggtacctagtggtgctgcttactaatgatgaagacagagggtggggtagcagcctagaagcacatgttctatgaagtcaaagaagacacctgtgtgatcctgagcctgccctaaagcagctcacagagaagaatctaggaagtggagggacttagggcttatgcagtccaccctctacctgaaggactcactcctaagcctgcttgctacttcttgggatctttgcctcaggtcaaagaacaggtaagaagagaacatcatgggctttggaatctgacaaactgggttcaactcctacagccatgccttactggctttgtgactccagggaagttagttaaccttccaagcctccttttcccatctataaaattatatcctacctaggctgggcgtggtggctcatgcctgtaatctgagcacttcgggaggccaaggcaggaggtttgcttgagcccaggggttcgagaccagcctgggcaacatagcaagaccctgtctacaaaaaaaaacaccatttttaaaaatgagctgggcgtggtggtgcagccgcttatagtcctaactacttgggaggctgagacaggaggatcccctgaaccaggagttcaaggttgcagtgagctatgatctcaccatcacactccagcttgagtgacagagtgagaccctgtttcaaagtaaataagtaaaataaataaactatagcctgcctcacaaggttgttaggaggtaaaatgaggaaatgcacaataaggacttggaacagaatcacatatggagcagtggttagtaaatggtggtgtcacaactggctcccagtatccacactggcctctgtgcagaaatggaggtccagatgtgagactgcaagtcctcagccttcagagggacagagctggatacaggggagagcccccgacaggggagatctccttgtgccgaactctgcaggacattccagaattaagccccaaagaagggctgaaggacaggatcatgaagccatgaacaaggcctggatgctgctcaaaagcaagggcccggccttccctgatgggattttctctctcaaacctcattctctacctccctcccccttcccagtgtgggtagggaacaatcccctaccctcaaccttccaagactcttatttgatgcttttaaacttttttctttatttagacagaaaagaccaactctttaaaagtaaaatgcaataaataaataagttaagcatagagaactgtctgaaactgactccccggtctccccttaccacccccacccccaccccattttcttttccctaaaacctcttcctaaagaaaatgatcaggtaataaaccccttgacccctccccacacccctcctcccaatacccaattaccccccaaagcaaagggagaaattaagagagagaaaaaaatccaagggcaacattgtctaaactcccagaaagagagatggcagcgtccgggccaggccgggcgggctggataacgcacgggtggtagtggtatttacacagagggaaccagcagagactgtaaacatttttaggggttcaggggaaggtcttttcctcgtgaaaggaggagggtctctgtggctgactggcagagaggcagccctcagggctcccccacaccctccttagagggggcccttgggggaggcagtgagttttaaggctgggagcccaggaatcagggatatcctacctctagctgagggtggaggggagtgagagccagcttccaagaaacccctaatgtggggaagaggctggggtgagggtgagctgggagtgtgtggcaggcccctgcggctctcctggggcctgcacgggtagaacaggcccactgttgggggaggcaagtacaaacgctgggtacagaaggcctgtcacaggagcccagcagaaggcagataccccggagccttcgagcctgttcctcgctccctcacaaaggccaaaagggcatctaggaggaaatgggcccttggagccagggaagcatagccatggcccttcagagaggcaggggggtgggaggggccggtgtcttgtgcccccgggggccacgaagcagcgtttgccccagaacccagtcaaggcccagggcaggtgtgcggagagggccggggccagtcgtgggaagagggtgtgaggcgccccttcctctgggatctccagacctgtgaaggaagaaacatgggtgaagcatggggaagagacccccgatgcggatcacgggctctgggggaggggagggggctggggtgagtgacagcatctaggatggggctgcctgaggaaggcagatcatcaggcctcagtccaaacggacccatctgcccccacccccagccatgagagcagggatagaggagacaggagggagggggcaaaccatacaggaaaccaaacggtattaggaaggaaatagatagcccatgagaaaaataaagactggagggggagagaggcaaagagatgacaacagacaggcaggcagagaaatcgagagagagacagagaagggggtgcgtgtaagagacagacacctggaaaaagaaagggaacacccgcagagaaggccagggcagagcccaggtcacggctcagggatggagtctcatggggtgagaccacccccggcccccagttagtgctctcattcctttttggaaaggaacacagaaagcaagagaaatgcacagaacacagaccacagtcaccaaccactgtagaccaagcacgtcccgcgagctgcccccggccctgaccttgggcttgggggtgcttccctccgcggcccctccccaaagaacaaacaatcggctccaaagacaacacgctcgttccatgcaacttacaggggcccggagcaggggtccggggatgggggcttcggccgacaatggacacgggccctgggctgggggggcccccagggttgggggagttaagcagccaggattggggggaaaggggagaaacagaaaatgtgggtatttttcttgggttgtgttttctcaagggtttggtccaaaggagattaaacagtgcgaaagtaaccaaggctcacagctctgtggccatgaggttgaggtggtggccagcaatggggtggaggagacctaagtaaacttcacaggcggcgcgacatttcaacctcttccacctaaaccagagcaactcccaagaggcctgaaaatgggctcccccagtctgtcctgtgcactctgctgccccatgggtctgctgctacatgggaaaaatcacctgaagtccagggaaaccagggctgatgtcctcacttctcaggacaacagagattctaggagccaaggattctagggccctctggcaccctcagccaaccccttaatcctccagtcctgttcccctaattccactctaacccgaaggaaaaccagaaagagacacacacagacatggacactgaccagacaaacgagaccagatattgtggaaggtccagggagtggacacatatatacaaagacttggctctttctggggtcacggagggtgtgtgtgtgtgagagagagagagagagagagagtgactcagattattgaaaaacagctgagggagctgccccagccccctgcttcaagtgcccagggtcaagggtggggtgggcatccctgagggtggtggaggacaggggttgggggtgtagtccaatcgagggccctggctgcagtgtgtgaagctggggagggaggccacaacggagcgggacccacctgggggccctcagtagggccggttggcatccttaggccgctttagctggactttgaggcgcttcatgccgatctggaagccattcatggcctggatggcagcctgggcactggccggattgtcgaaactcacaaagcctggggtgagaggggcataaggcccggcccagccccacctcgctcttccgtgcttaggagacctctggcactaccctgtgtctcccaagtgtcccaaatgcctagaaagctgcctgccacatagcagcattccttaggaatttgttgattgatgggttgaatggatgaatccagtccagccactccaactaccacattcttcccagcattctgtgccagtgaccccttcctctgcctggatagctctgagcctgccctttgaaaacggccacttccagaccctaaatggcttctgaagcagagaagaacattccctttctcccctgaggaagactttcaaagatgtgaaggcagctaaaaccgactccccaagcccaccttttgcaaaccaaacatccccagaccataagcctatttcagacctcatgggacatgaatttggccagtttttaagagaaacgctgaaggaagaagagatgggccgaggcagcagctgggtgtggcatgttgggtgtgtcaaaatggctcttttgtactcttggataatcagtatttcaaatactgggtccactgtgaccataaatgccttcaaatatattagaccttgtcctgatttggagtatggcaaaaaatgtgccatatcatattcttaccaaaacatttgctttgattggtggctcggtcaacaaagactttggctgagatgacgtggccaaaggggacaaacatctggaggatctctgagtcagtgaactcctggggcaggtggtagatgaagatgttgcagccatcagggcctgggtggcgacagagacagaagaaagagctcagtgactgggaggcacacaccccagaagcaaatgtcccagggaaagcagatcctgggagtgccctccagtcccagtccttgacagtgtgggccaagtctccggccactccctccccacttgctttcatcctgacacgtgggcaagagctgggctcagcgcggggtgacagggagtccccaagcccataacgagggcattcctgtctcccaaggccccagccagcaccttctctttgctgctgctgctgttgctgctgctgctgctgctgctgctgttgaggtggtggtgggggctgctgggcgaccagggctggaggctgcgggaacgcaggtgcaaccaggctgtaggctgctgggtaggctgctggggtggggagaagagagaggctgatggggcttccctgacttcttgagccctcccagccaaccctgtctcccttcccctagcccaggccagtggcacctgcagggctgagaggtggtcagggaaggagctgcctcagacccctgggtgtgctgcccttaaagacccctccccacagttgggcttgtcagtaaagcctgaagagggtgattggcagggagccaagaagcccagacccagttactgggcctcttttcctcctgccacctctcccacctgagcaggggccctggctagggcgcctcacctgtgtagtgctgcatccccgcgtaggcctgctgcagggggtccacgggggccgcggggctctgggctggggagagcagcacagactatgagcgtggacctggcacacagtgggggccctcagtgcctctctgggcctctgggccgaggccaggcaggtggggagcagagcttctctgggcatggggtgtgaagtgagaaggcagaaatgcacaaagcagtgggaagaggggaaagagcccagcgttaggaagacttgggtctgactgtcttgcaaccctggacaggtcgcttcactgctctacacctcagcttcctggccgagcccaacaggaaggatcatccccgcccaggatggcagggcaggaggaagcacctgtacccccaaagctgggagggaaggtgtgtcctgcctccctaatgggagtggtggtttagatggttgctgggacggagtgggcaggcagagagtcccacctgggtaggggtgaaccccgttgggatacagagcatcaggggcaggctgcccagtgggctgggtgggcaccgggctgtagccgttgacgcccagggcagccggaatggcagagacaggcgtggcagcgatggcaggaggggtgctggttcctggggaggagaaagcgacagggagagagcagaggagcagacacacacacaggcagagaaccagtcagcaagtctgtgggcagaggggaggaagcaggcctctctgacccctgagtccctcccagaccccgaggcttccctgagcaatgccctgtgcccctccctacccctaccatgcttagctcccttgcccggccttgcccaggccatacctgaggatggggtgatgggggtggcgatgaggccattggcattgatggcagccatgtgctgcatctgcacggcagccatggtggccatggggctgaggtaggcactgtgagccgctaccagggccgcctgctgctgcatcagctggggggaggggagaggagagtggggcaggccccctgtgcccaagcctggctccctcccagcccggggccttggcatcgggagggtgggggcaagatacagggggtcaggagggctggcccggcatcaggggcagtgctcacggcctgggtgtaggcgctgtaggctccaaactggagggcgatggggctgaacatgcccaactgggtggccacctgctgcatgcggcggagacctcgctccttctcagtgtcagcaaacttcaccaccaggctggacgaggcaccctgggcacgggcccacacacaggtcagaggtgcagggtcagggtctctcctccccaaagccctcaggacctggtctccattccacccccatggcatggcttggcctctctgagagggcggccaccattttgcgtatgaaagatggggagatattaatcccactctctccctatgctaggatgtgcaagaggctagaagaaaaaatgaggaatgtgaaggcacatgcttggaaagtgaaaagcctactggaatgaaaagggcatcattggctactctgtgaggactctgaactggaaatcatccccaccctgggttgccacagcaaatgtttaatctcaggctagtcttcccttgtagctgccctgcgtgccttaccacgactcctgcccccacaccccagtcctcatggtgtgcctcaaatcttaatactagtctgagctgaataaaaaccaaattggagcatttgcaaggatgatggtagaatcctagaatctcaaagctggaaggggcatagggtcattggacacagttctctacccaatgctgtgtcccctccaccaaggccccgtgaaatgtctgcccagcctttgctggagagctgtgagttatgggaagtgcacagccttctgagtcagccagttccaatttagaggtgggctctagactggtcactgacctaacgctgctgtgcaggggcagggaagaggggtgcacgtggggcctctaagcaagtgtcctggcgccccagcaaatgagggtagggggatatgggaaggctggagaagagacgggggtgaagggagggctggggaatggagggagaaggagagggatgtgagggaatttggctgaaggtggatggggaataggggaggagtggggaggtggggaagtgccatttgaaatgtgagggtgtccctaagcagtttggttcttctgccaggacattcctttccaataaattcaaatagcccatcctgagtggactgcttctctgggccagggcctggcaggtgggcagggtgggaaggagaggcccgggggcaggggagtggggctcactggcagggtccggctgctgtgaagggtgttgatggccgcctgggcctcagcgtgggtctggaacttcacgaaggcgcagcctggagaggttgagatggaggaggagaggggtaagcacccatccctgcgggaccccgcggtggaacccgatgcctagggagtcttgggggtggaacaggaaggggaagggcccggtggggaagggggaagtgggtggactacctttgctggtgccatctggcccccggagcacagtgcactcgtcgatggtcccgaagggctcaaacatcttccggacgtcctcatctgtctgctgcttccctagcatccccacaaagagcttccggtcttctgggtggtagggcacaggaggagggcatgttcagggcctcctggctgccttcccagcccttcttccgcccttccctggagctcctaacactacttctgctacccttagggtccaatggctgtaggggctgatggttggggaatggggtatagttgcagagggtgctcatcccagctctgagggactcgcactccaccctgggcctcagttttgccatctgtacccgccccagatctcacccgctctggccacactgactcctatctcaccgcagctgggaactcttcagaatcatcaggctttctccctcaagaaaggctacccctcgacaactccaggccctgggcctgggggtgggaggagagggacagagtccaaaggcacagaacctacctcctcggctctcgctgtcggctggcttgacctggatcggcctgttcatctgaaggagagaagagaaggcagctgctggggacctcctctgaacacccaagagccctcccaggccaggccctgcagagagactagaggggcaagccccaggccctctaagtttctgatgggaaggaagggacagggcctaatactgttcaggatgaaggcctgaggggatcagaggcacagagagagaggatgtagagggagaggctcatgggcacagctccaggctcaggttgggctcctgatgacttggccagggatgggtgctgctgtcctgagtgggagaagggggcctgcacataggacccggggcctgagagagagcccgaccaaggagttatttaataagaattgcctcaattctacaaagtgggcgcaacagaggccactctgaagaagccccaaggaggactctagactgagggagaccccacaaaggcccagacttccttctgacctctagaggtgtgtctgcctctctttctgcccccctataccccttgaccccagggggaaggcactcgggcagcacaaagggagcagatgcccagtctccgtggcaacgggagaatgcgcaccatggcaaccgcccactcagcctgatttatccgtccccgtcgccctggcgaccgtggtgacgtcatcacttctgctgctccacacacccagagaaggagtggggtggggggtggttaacagggtatgctgggggtggaggatttggtgggggctgggaggtgggggaggggcccagaaaaccttcctgattctggagggaggcttgcagagcaggccctgcaggggccatcccatcccttctcctgcctccctcctccagagcaaatccttggtgcctggagggctctaaaggaggagttgctgtcccgtgctccttcgcaatttaccctgtgcacggaagtcctccagagctctaacctctccccgacccctgcagtatctccctttgttcagtcttcagtggaaatggagaaattcctagttccactctccatgttcttgtctggtgagaggacttggaaattactcctgcaggttgattttcttaaccagggtggggagtattataggaactggagaaagaggagaaggacttagtatttagtgtctgaaaatattttgctcttgaggactctgacagctggaaccacacctggttgccccactcatctgatggtggggcagtagttccagtgaccagaaaaattaaacctcaatttacattctgagggtgaggctagaggtaccctcaggaaaggtactggactgggagtcaggagacctggatttgaggactagccctgccctgccacttactagctgggcgaccttggacaagccactagtcccctctggacctcaacttccttatctgtaaaacaagggggtgggccaggcgatgtctaatcaggttccggtcagctccaggctccagcatgtggagatcctgtgtgtggcatcacttagcgccgagaagtgcagaagtcacagttgcccctgccccttctcaccctggatcctcacccaggtgtcgcatcatgccagtcagtctggccgactccaccagttaggtattcccggcctcggaccaaacctaagccccacctcaactgatactcctttcccagggccccacccccgccccccaaatctctggatctgagagcagctggtgaggagggagggtaacagtcatacaaatcctccagccaatctgcccccagctttatcacccgccaatctgggattatcccatcggaggctcaatctccttaggcatgtgtgtgcgggtgcgcatgcgcaagcaaagcgtgtcgtgggggcagatgctcagggtgcatgggctttcacctccttctctcctgtgctctagccaaagcactcaggaaattccctcacaggcacctccgcagccaggcacccacccctacacccacgccaaaagaagcagaatcagaaccagggttgggggattcttacgcttggcgctagcccccttcccagcaggcctggggatttgctgttctagatggagatgggaacctgggacccagagagaaaggatgcagttccctcctggcataggctcccaggcacaaaaatagcatctcgagaaatacccacggctgatgtggattcgcacaaagagacacacaagtgtacagaccacagcaaggaccgtgctgacggtaggctccccctacaccctcacagacaggacccttggcgctccagtgtccccttcccagcctccttcttcgtggcctggcacttcctgtggggagctcaggcttcgttagctcagctcagacacacctgccccctcccctgagtccagctgtgccctgtttacctggcaaccaggcgcagcacctttcctccctagttactacccaccaggtgacaagccctccctcgggcctcccaaagaaggagtggctatttataccccaacccagtatagccgagcccctccaccacggtcacttttaaggccttcatctttctcgccaatagcaaaaactccacttccaagaagacctcacagttctcacaaaatctaattcttttgagggtacagcctggggtcctgccactcctggctccacacttgttcccggcgtcccagaccactcacaggttctctccgtggggccagaatccaccttcctgactgcagaccgacagggaaggcccatgtcccccaagtgggattttggttcagggtgaagggggaagagctggacagagggcaacccccactccaccacctccatgatgccacaccctgctcagaggacaaattcagggacctgtggcagagccactcctgggaactcttaggggagagaaaaggaaatggggctcaacagctataggcccagcccccattctttctctttccctctgcagcccaaaatatcaccctagtatggtagcaccttctagatttttggggtgacagagatggggagcaaggagagggggctaaatgtctgatttttttaaaaaaacctgcagtaggaaggcatggagattaaacagtaggaagaacagttatgcaggagctgacacactgcacacacatgcgtgtgcatgcacacacactcatgcatgcacacacacactgcatgcacacacacgtgcaaacacacactgaggggagaatgcaggtagcaggagaagacttagggaagacaaagggtcacagacatctgctccccacaactgccctgggtctgttccttcaaaccccttggatgggggtccctcttggaggatggaaccctcatttcctactggaagctgtgtcaggtccctctggattctgtcccctgggacaagggctaaagtggagaattcagcgtcacctagaagctctggagaagggctagacaatcattaaccaggcgcccttcttcctcacccccaccctgggctggacttcctcaagaagggcaggtggtgcctctccacacccaggatggagctctgcctgagctgccaggcagctggaggggcacagacctagggtggacacctgcagctggtacacatgacctttggggctcatgcccatccccaggctgtctctcatccatgtctccactccagtcctctttatctaccttttcctctgaccccctctcatttctgcaggggctctgagatagggagacaacagaaaaagacaaacagcgatggagatgaaaactgttgatttgtgaggggcctccacagagaaaaacagggaaggcaagttgggactggatggggaccaagcttcccagggatacgtgtgcccaaaccccacacatctggcctgtcaagagctcacatgcctgtgtgcacaaacacacgctcgccttgggtcctgcagctcacacacgtgcatggcccttaactctggctgtgacaggcaatgcctattcttgacactgactgggataagatctttggtgggcgtgggggtttgggtggatttgccgcagttggctttgctttcctagcagtactcaaaggttgaggccatggaagggcttgggacaatcagcaaggctggctgggaagaagacacaaagagataggaccttgcaggagaggggccacctctgaggccacccctgcctccctgggcatacctggtggcatcaggcctgatcctctacaatgtctgtccctgcccttgcctgctacttccaggcctacctccagcccagacctgcccaggcctgcccaggccctgctctaccctgatgctctgtggctctgttcctgggactcttcctgggagacagaagggagatgagagctcaagaaccagcaccgagatgccaatctagccggcaccagctgcctgttctctgggcactcctccctcatctcacagccacccagcctgcctttccagagtgacaaaagagtgcctgggtgccccctgctcaccctgatccacacttggtgtccagagacttttccccacaccttccaaccagcgagtcctccctctagtgttgccccatgggcagcttgggaagtggggaaggggctgcatctgctcctggtaaaagtcatgtttacgccactaatcgctgctttccttctctccaggtaacaagaaatgcatgcatctacagcaagaaagatggatgctacagagagagagggggacttcctggtgatgagaggaggtggaaattatgctcagtgtcaggagggtggtgagcctcctgccacttctatggcccttctcagtcccctggccctgcaaagggcaggactcacccctggaagcgtcttctgttcgtgcagggcgctctgggccttcagggctgaatcccgggcacagtatgtcaggaaggcacatcctgaggaggggcaggggcagagaaacacggcggggggtgagtcctccatctcccctctctgaaaggctcccttccaaagactgacgactgggaagctttcccttcttgtcatcttctgcctgctggggtagagaggtgtctccaaggggtagactctctgccccagaagtggggcagacacctggaggcctaaatactggtggtgatgggagagggaggacacttgggctgtcaggagatgggctttgtgtagggagagaaggaccatgtgaccgccagacaagtaagagtagtgtggctttctctcctgctgagctgttctcctttcccctctctccctcacctccacctccctccatcttgatcaccatcatccctctcttctcccattttccctatttcctcatctctccccacctccaccataggcaggtggaggacggagagtgaaatagagaagggaagggaagaacagttagttagccggaagtgcctcttccctgtgccaggtggagggggagctggtgtggcccctgggatccccggtgtgtggagctctccaagtgctgaccctgaccgcccccacttagccgcacagcccttggataggcctgaggagcaccctcccttctcccccactctcttaactttctaagcctcccacactttccagatctttaccaatctccagccttcatgccctgcttcctagtccctctctttagtcctggagctgccctgcccagtccagctccacgctttccacattgaacacctgaccctgtgtcctgacccccatcccaatattatctgaggctgctcagattctcagtcttgctgcacacgcacacacacacacacccctacccagctgcttatctcccaaaccagctctcttgtccctccattctttcttgagttcatcccatgacatcaacacacccatatgtctgggatccacatctttgcagccgtcttgacaactcttcagccaaaagaggccctccttagtccttcaccggggtttcctgatcactctagctgagttctttttcagctcctccatccactttcctcaggcctgaactcttctccttccacatcagcccttcccagccgctccacccctccagcctggcttaacttcccccagcctcccagcccaccccgaagcctcttcagcctgcccgacccctcacccttgtgcagcccggtgtacttgtccttgatgacagtcagctcaaagatccgaccaaactgttcgaagatgggcttcaggtccttctcctccagatgcctcgggatctgccccacaaacagcttgatggcatccggctccttcattgaggcggcccaggaggaggggccgaggggagcagggagaggcccaaaggccaaggggagctgcccagcaaggagataagtggtggggcccgggggcccagctggggctggctttccctttggcccccaaccacgctgctaagcagaggggcggctcttcacacaaaggaggcccagggagttgagtgctaggggtcaggggtctaggcagacgctgtcatgccaccagggggcatcgcctaaacaaacgatctccctcccagagatctggcaaatgtcccaggatgggggtgagtatggccaagacctggagggttaggtggtagccgggggtgctagggcttagagggctgggaactgggagttgagatgagagctggaggcgg

SEQ ID NO: 1850 - DNA, 16758 bp, Homo sapiens
gttacagtggttaaagtcaaacatttattaggtatctgctgttgggggtggggtggggagattgtttgagatactgcaacagacacaaaagcaaagaaagaaacatttctgccagcttacaggctcacagaagaatgagacacttacgcatggccatgatacacagcagtgaaaggtttaagtgccataaggactagaaaaggaaggagaaagacctgtggatgagggccgttaagattttcatgaagaaagtagtgtttaaggtgaactgttttagtgtgagaaggatttcaacaagaaggcattcaacaaacatttattgagccgttatgtgccagacactgtagtaactgggaatgaaaagacatgggagaaaagggaccaaacttgcctagagaacaatgaatagttctatttgggtatgtgtaggaatgaagtggaaagtaaggcttcgaagagccttgaatgccaggctgaggtgttctatgaaaaacaacaaaaaacagcagcagagaagttttgttttttattagctgcagtttagaaagattgatgcttcagaacatagacagaaggaccaattaggaaattgctatgattactcagttaataagtgtaggcagtgataattgaaaagagggaaatgatatgagaaagtttgtggaagtgaaatcttaaatgatttaataccattgagtttatgcgaaagtactaaaaactcttgaggttttctgtctatgtgactagaaaatagaaatatatgagtcaggactttatgggagaaagttttagcattggccctatgatgatgtagatatggatgggaagtccagtatagatgtccaacagtcatttcttatttactaagcaatgtctaatatttggggcactgtttagggtgaccaggatacagtgctggacaaagcagactgggtagtaaatgttggtgaattaacttttaaaagatgactcttggcttcttgggagaacaaattgtaggagagcaggaaaagaaacatggagacagatgagagcaatgtgacgtggacagtgttgatggctgtggagatgcagagacatgagtaagtaaatcagctgaatactttagaggtagacttggtagggctttgcagttggattggggaggagacatgagagaaagggtgtaatccaagttttggcttgagtaggtacctagtggtgctgcttactaatgatgaagacagagggtggggtagcagcctagaagcacatgttctatgaagtcaaagaagacacctgtgtgatcctgagcctgccctaaagcagctcacagagaagaatctaggaagtggagggacttagggcttatgcagtccaccctctacctgaaggactcactcctaagcctgcttgctacttcttgggatctttgcctcaggtcaaagaacaggtaagaagagaacatcatgggctttggaatctgacaaactgggttcaactcctacagccatgccttactggctttgtgactccagggaagttagttaaccttccaagcctccttttcccatctataaaattatatcctacctaggctgggcgtggtggctcatgcctgtaatctgagcacttcgggaggccaaggcaggaggtttgcttgagcccaggggttcgagaccagcctgggcaacatagcaagaccctgtctacaaaaaaaaacaccatttttaaaaatgagctgggcgtggtggtgcagccgcttatagtcctaactacttgggaggctgagacaggaggatcccctgaaccaggagttcaaggttgcagtgagctatgatctcaccatcacactccagcttgagtgacagagtgagaccctgtttcaaagtaaataagtaaaataaataaactatagcctgcctcacaaggttgttaggaggtaaaatgaggaaatgcacaataaggacttggaacagaatcacatatggagcagtggttagtaaatggtggtgtcacaactggctcccagtatccacactggcctctgtgcagaaatggaggtccagatgtgagactgcaagtcctcagccttcagagggacagagctggatacaggggagagcccccgacaggggagatctccttgtgccgaactctgcaggacattccagaattaagccccaaagaagggctgaaggacaggatcatgaagccatgaacaaggcctggatgctgctcaaaagcaagggcccggccttccctgatgggattttctctctcaaacctcattctctacctccctcccccttcccagtgtgggtagggaacaatcccctaccctcaaccttccaagactcttatttgatgcttttaaacttttttctttatttagacagaaaagaccaactctttaaaagtaaaatgcaataaataaataagttaagcatagagaactgtctgaaactgactccccggtctccccttaccacccccacccccaccccattttcttttccctaaaacctcttcctaaagaaaatgatcaggtaataaaccccttgacccctccccacacccctcctcccaatacccaattaccccccaaagcaaagggagaaattaagagagagaaaaaaatccaagggcaacattgtctaaactcccagaaagagagatggcagcgtccgggccaggccgggcgggctggataacgcacgggtggtagtggtatttacacagagggaaccagcagagactgtaaacatttttaggggttcaggggaaggtcttttcctcgtgaaaggaggagggtctctgtggctgactggcagagaggcagccctcagggctcccccacaccctccttagagggggcccttgggggaggcagtgagttttaaggctgggagcccaggaatcagggatatcctacctctagctgagggtggaggggagtgagagccagcttccaagaaacccctaatgtggggaagaggctggggtgagggtgagctgggagtgtgtggcaggcccctgcggctctcctggggcctgcacgggtagaacaggcccactgttgggggaggcaagtacaaacgctgggtacagaaggcctgtcacaggagcccagcagaaggcagataccccggagccttcgagcctgttcctcgctccctcacaaaggccaaaagggcatctaggaggaaatgggcccttggagccagggaagcatagccatggcccttcagagaggcaggggggtgggaggggccggtgtcttgtgcccccgggggccacgaagcagcgtttgccccagaacccagtcaaggcccagggcaggtgtgcggagagggccggggccagtcgtgggaagagggtgtgaggcgccccttcctctgggatctccagacctgtgaaggaagaaacatgggtgaagcatggggaagagacccccgatgcggatcacgggctctgggggaggggagggggctggggtgagtgacagcatctaggatggggctgcctgaggaaggcagatcatcaggcctcagtccaaacggacccatctgcccccacccccagccatgagagcagggatagaggagacaggagggagggggcaaaccatacaggaaaccaaacggtattaggaaggaaatagatagcccatgagaaaaataaagactggagggggagagaggcaaagagatgacaacagacaggcaggcagagaaatcgagagagagacagagaagggggtgcgtgtaagagacagacacctggaaaaagaaagggaacacccgcagagaaggccagggcagagcccaggtcacggctcagggatggagtctcatggggtgagaccacccccggcccccagttagtgctctcattcctttttggaaaggaacacagaaagcaagagaaatgcacagaacacagaccacagtcaccaaccactgtagaccaagcacgtcccgcgagctgcccccggccctgaccttgggcttgggggtgcttccctccgcggcccctccccaaagaacaaacaatcggctccaaagacaacacgctcgttccatgcaacttacaggggcccggagcaggggtccggggatgggggcttcggccgacaatggacacgggccctgggctgggggggcccccagggttgggggagttaagcagccaggattggggggaaaggggagaaacagaaaatgtgggtatttttcttgggttgtgttttctcaagggtttggtccaaaggagattaaacagtgcgaaagtaaccaaggctcacagctctgtggccatgaggttgaggtggtggccagcaatggggtggaggagacctaagtaaacttcacaggcggcgcgacatttcaacctcttccacctaaaccagagcaactcccaagaggcctgaaaatgggctcccccagtctgtcctgtgcactctgctgccccatgggtctgctgctacatgggaaaaatcacctgaagtccagggaaaccagggctgatgtcctcacttctcaggacaacagagattctaggagccaaggattctagggccctctggcaccctcagccaaccccttaatcctccagtcctgttcccctaattccactctaacccgaaggaaaaccagaaagagacacacacagacatggacactgaccagacaaacgagaccagatattgtggaaggtccagggagtggacacatatatacaaagacttggctctttctggggtcacggagggtgtgtgtgtgtgagagagagagagagagagagagtgactcagattattgaaaaacagctgagggagctgccccagccccctgcttcaagtgcccagggtcaagggtggggtgggcatccctgagggtggtggaggacaggggttgggggtgtagtccaatcgagggccctggctgcagtgtgtgaagctggggagggaggccacaacggagcgggacccacctgggggccctcagtagggccggttggcatccttaggccgctttagctggactttgaggcgcttcatgccgatctggaagccattcatggcctggatggcagcctgggcactggccggattgtcgaaactcacaaagcctggggtgagaggggcataaggcccggcccagccccacctcgctcttccgtgcttaggagacctctggcactaccctgtgtctcccaagtgtcccaaatgcctagaaagctgcctgccacatagcagcattccttaggaatttgttgattgatgggttgaatggatgaatccagtccagccactccaactaccacattcttcccagcattctgtgccagtgaccccttcctctgcctggatagctctgagcctgccctttgaaaacggccacttccagaccctaaatggcttctgaagcagagaagaacattccctttctcccctgaggaagactttcaaagatgtgaaggcagctaaaaccgactccccaagcccaccttttgcaaaccaaacatccccagaccataagcctatttcagacctcatgggacatgaatttggccagtttttaagagaaacgctgaaggaagaagagatgggccgaggcagcagctgggtgtggcatgttgggtgtgtcaaaatggctcttttgtactcttggataatcagtatttcaaatactgggtccactgtgaccataaatgccttcaaatatattagaccttgtcctgatttggagtatggcaaaaaatgtgccatatcatattcttaccaaaacatttgctttgattggtggctcggtcaacaaagactttggctgagatgacgtggccaaaggggacaaacatctggaggatctctgagtcagtgaactcctggggcaggtggtagatgaagatgttgcagccatcagggcctgggtggcgacagagacagaagaaagagctcagtgactgggaggcacacaccccagaagcaaatgtcccagggaaagcagatcctgggagtgccctccagtcccagtccttgacagtgtgggccaagtctccggccactccctccccacttgctttcatcctgacacgtgggcaagagctgggctcagcgcggggtgacagggagtccccaagcccataacgagggcattcctgtctcccaaggccccagccagcaccttctctttgctgctgctgctgttgctgctgctgctgctgctgctgctgttgaggtggtggtgggggctgctgggcgaccagggctggaggctgcgggaacgcaggtgcaaccaggctgtaggctgctgggtaggctgctggggtggggagaagagagaggctgatggggcttccctgacttcttgagccctcccagccaaccctgtctcccttcccctagcccaggccagtggcacctgcagggctgagaggtggtcagggaaggagctgcctcagacccctgggtgtgctgcccttaaagacccctccccacagttgggcttgtcagtaaagcctgaagagggtgattggcagggagccaagaagcccagacccagttactgggcctcttttcctcctgccacctctcccacctgagcaggggccctggctagggcgcctcacctgtgtagtgctgcatccccgcgtaggcctgctgcagggggtccacgggggccgcggggctctgggctggggagagcagcacagactatgagcgtggacctggcacacagtgggggccctcagtgcctctctgggcctctgggccgaggccaggcaggtggggagcagagcttctctgggcatggggtgtgaagtgagaaggcagaaatgcacaaagcagtgggaagaggggaaagagcccagcgttaggaagacttgggtctgactgtcttgcaaccctggacaggtcgcttcactgctctacacctcagcttcctggccgagcccaacaggaaggatcatccccgcccaggatggcagggcaggaggaagcacctgtacccccaaagctgggagggaaggtgtgtcctgcctccctaatgggagtggtggtttagatggttgctgggacggagtgggcaggcagagagtcccacctgggtaggggtgaaccccgttgggatacagagcatcaggggcaggctgcccagtgggctgggtgggcaccgggctgtagccgttgacgcccagggcagccggaatggcagagacaggcgtggcagcgatggcaggaggggtgctggttcctggggaggagaaagcgacagggagagagcagaggagcagacacacacacaggcagagaaccagtcagcaagtctgtgggcagaggggaggaagcaggcctctctgacccctgagtccctcccagaccccgaggcttccctgagcaatgccctgtgcccctccctacccctaccatgcttagctcccttgcccggccttgcccaggccatacctgaggatggggtgatgggggtggcgatgaggccattggcattgatggcagccatgtgctgcatctgcacggcagccatggtggccatggggctgaggtaggcactgtgagccgctaccagggccgcctgctgctgcatcagctggggggaggggagaggagagtggggcaggccccctgtgcccaagcctggctccctcccagcccggggccttggcatcgggagggtgggggcaagatacagggggtcaggagggctggcccggcatcaggggcagtgctcacggcctgggtgtaggcgctgtaggctccaaactggagggcgatggggctgaacatgcccaactgggtggccacctgctgcatgcggcggagacctcgctccttctcagtgtcagcaaacttcaccaccaggctggacgaggcaccctgggcacgggcccacacacaggtcagaggtgcagggtcagggtctctcctccccaaagccctcaggacctggtctccattccacccccatggcatggcttggcctctctgagagggcggccaccattttgcgtatgaaagatggggagatattaatcccactctctccctatgctaggatgtgcaagaggctagaagaaaaaatgaggaatgtgaaggcacatgcttggaaagtgaaaagcctactggaatgaaaagggcatcattggctactctgtgaggactctgaactggaaatcatccccaccctgggttgccacagcaaatgtttaatctcaggctagtcttcccttgtagctgccctgcgtgccttaccacgactcctgcccccacaccccagtcctcatggtgtgcctcaaatcttaatactagtctgagctgaataaaaaccaaattggagcatttgcaaggatgatggtagaatcctagaatctcaaagctggaaggggcatagggtcattggacacagttctctacccaatgctgtgtcccctccaccaaggccccgtgaaatgtctgcccagcctttgctggagagctgtgagttatgggaagtgcacagccttctgagtcagccagttccaatttagaggtgggctctagactggtcactgacctaacgctgctgtgcaggggcagggaagaggggtgcacgtggggcctctaagcaagtgtcctggcgccccagcaaatgagggtagggggatatgggaaggctggagaagagacgggggtgaagggagggctggggaatggagggagaaggagagggatgtgagggaatttggctgaaggtggatggggaataggggaggagtggggaggtggggaagtgccatttgaaatgtgagggtgtccctaagcagtttggttcttctgccaggacattcctttccaataaattcaaatagcccatcctgagtggactgcttctctgggccagggcctggcaggtgggcagggtgggaaggagaggcccgggggcaggggagtggggctcactggcagggtccggctgctgtgaagggtgttgatggccgcctgggcctcagcgtgggtctggaacttcacgaaggcgcagcctggagaggttgagatggaggaggagaggggtaagcacccatccctgcgggaccccgcggtggaacccgatgcctagggagtcttgggggtggaacaggaaggggaagggcccggtggggaagggggaagtgggtggactacctttgctggtgccatctggcccccggagcacagtgcactcgtcgatggtcccgaagggctcaaacatcttccggacgtcctcatctgtctgctgcttccctagcatccccacaaagagcttccggtcttctgggtggtagggcacaggaggagggcatgttcagggcctcctggctgccttcccagcccttcttccgcccttccctggagctcctaacactacttctgctacccttagggtccaatggctgtaggggctgatggttggggaatggggtatagttgcagagggtgctcatcccagctctgagggactcgcactccaccctgggcctcagttttgccatctgtacccgccccagatctcacccgctctggccacactgactcctatctcaccgcagctgggaactcttcagaatcatcaggctttctccctcaagaaaggctacccctcgacaactccaggccctgggcctgggggtgggaggagagggacagagtccaaaggcacagaacctacctcctcggctctcgctgtcggctggcttgacctggatcggcctgttcatctgaaggagagaagagaaggcagctgctggggacctcctctgaacacccaagagccctcccaggccaggccctgcagagagactagaggggcaagccccaggccctctaagtttctgatgggaaggaagggacagggcctaatactgttcaggatgaaggcctgaggggatcagaggcacagagagagaggatgtagagggagaggctcatgggcacagctccaggctcaggttgggctcctgatgacttggccagggatgggtgctgctgtcctgagtgggagaagggggcctgcacataggacccggggcctgagagagagcccgaccaaggagttatttaataagaattgcctcaattctacaaagtgggcgcaacagaggccactctgaagaagccccaaggaggactctagactgagggagaccccacaaaggcccagacttccttctgacctctagaggtgtgtctgcctctctttctgcccccctataccccttgaccccagggggaaggcactcgggcagcacaaagggagcagatgcccagtctccgtggcaacgggagaatgcgcaccatggcaaccgcccactcagcctgatttatccgtccccgtcgccctggcgaccgtggtgacgtcatcacttctgctgctccacacacccagagaaggagtggggtggggggtggttaacagggtatgctgggggtggaggatttggtgggggctgggaggtgggggaggggcccagaaaaccttcctgattctggagggaggcttgcagagcaggccctgcaggggccatcccatcccttctcctgcctccctcctccagagcaaatccttggtgcctggagggctctaaaggaggagttgctgtcccgtgctccttcgcaatttaccctgtgcacggaagtcctccagagctctaacctctccccgacccctgcagtatctccctttgttcagtcttcagtggaaatggagaaattcctagttccactctccatgttcttgtctggtgagaggacttggaaattactcctgcaggttgattttcttaaccagggtggggagtattataggaactggagaaagaggagaaggacttagtatttagtgtctgaaaatattttgctcttgaggactctgacagctggaaccacacctggttgccccactcatctgatggtggggcagtagttccagtgaccagaaaaattaaacctcaatttacattctgagggtgaggctagaggtaccctcaggaaaggtactggactgggagtcaggagacctggatttgaggactagccctgccctgccacttactagctgggcgaccttggacaagccactagtcccctctggacctcaacttccttatctgtaaaacaagggggtgggccaggcgatgtctaatcaggttccggtcagctccaggctccagcatgtggagatcctgtgtgtggcatcacttagcgccgagaagtgcagaagtcacagttgcccctgccccttctcaccctggatcctcacccaggtgtcgcatcatgccagtcagtctggccgactccaccagttaggtattcccggcctcggaccaaacctaagccccacctcaactgatactcctttcccagggccccacccccgccccccaaatctctggatctgagagcagctggtgaggagggagggtaacagtcatacaaatcctccagccaatctgcccccagctttatcacccgccaatctgggattatcccatcggaggctcaatctccttaggcatgtgtgtgcgggtgcgcatgcgcaagcaaagcgtgtcgtgggggcagatgctcagggtgcatgggctttcacctccttctctcctgtgctctagccaaagcactcaggaaattccctcacaggcacctccgcagccaggcacccacccctacacccacgccaaaagaagcagaatcagaaccagggttgggggattcttacgcttggcgctagcccccttcccagcaggcctggggatttgctgttctagatggagatgggaacctgggacccagagagaaaggatgcagttccctcctggcataggctcccaggcacaaaaatagcatctcgagaaatacccacggctgatgtggattcgcacaaagagacacacaagtgtacagaccacagcaaggaccgtgctgacggtaggctccccctacaccctcacagacaggacccttggcgctccagtgtccccttcccagcctccttcttcgtggcctggcacttcctgtggggagctcaggcttcgttagctcagctcagacacacctgccccctcccctgagtccagctgtgccctgtttacctggcaaccaggcgcagcacctttcctccctagttactacccaccaggtgacaagccctccctcgggcctcccaaagaaggagtggctatttataccccaacccagtatagccgagcccctccaccacggtcacttttaaggccttcatctttctcgccaatagcaaaaactccacttccaagaagacctcacagttctcacaaaatctaattcttttgagggtacagcctggggtcctgccactcctggctccacacttgttcccggcgtcccagaccactcacaggttctctccgtggggccagaatccaccttcctgactgcagaccgacagggaaggcccatgtcccccaagtgggattttggttcagggtgaagggggaagagctggacagagggcaacccccactccaccacctccatgatgccacaccctgctcagaggacaaattcagggacctgtggcagagccactcctgggaactcttaggggagagaaaaggaaatggggctcaacagctataggcccagcccccattctttctctttccctctgcagcccaaaatatcaccctagtatggtagcaccttctagatttttggggtgacagagatggggagcaaggagagggggctaaatgtctgatttttttaaaaaaacctgcagtaggaaggcatggagattaaacagtaggaagaacagttatgcaggagctgacacactgcacacacatgcgtgtgcatgcacacacactcatgcatgcacacacacactgcatgcacacacacgtgcaaacacacactgaggggagaatgcaggtagcaggagaagacttagggaagacaaagggtcacagacatctgctccccacaactgccctgggtctgttccttcaaaccccttggatgggggtccctcttggaggatggaaccctcatttcctactggaagctgtgtcaggtccctctggattctgtcccctgggacaagggctaaagtggagaattcagcgtcacctagaagctctggagaagggctagacaatcattaaccaggcgcccttcttcctcacccccaccctgggctggacttcctcaagaagggcaggtggtgcctctccacacccaggatggagctctgcctgagctgccaggcagctggaggggcacagacctagggtggacacctgcagctggtacacatgacctttggggctcatgcccatccccaggctgtctctcatccatgtctccactccagtcctctttatctaccttttcctctgaccccctctcatttctgcaggggctctgagatagggagacaacagaaaaagacaaacagcgatggagatgaaaactgttgatttgtgaggggcctccacagagaaaaacagggaaggcaagttgggactggatggggaccaagcttcccagggatacgtgtgcccaaaccccacacatctggcctgtcaagagctcacatgcctgtgtgcacaaacacacgctcgccttgggtcctgcagctcacacacgtgcatggcccttaactctggctgtgacaggcaatgcctattcttgacactgactgggataagatctttggtgggcgtgggggtttgggtggatttgccgcagttggctttgctttcctagcagtactcaaaggttgaggccatggaagggcttgggacaatcagcaaggctggctgggaagaagacacaaagagataggaccttgcaggagaggggccacctctgaggccacccctgcctccctgggcatacctggtggcatcaggcctgatcctctacaatgtctgtccctgcccttgcctgctacttccaggcctacctccagcccagacctgcccaggcctgcccaggccctgctctaccctgatgctctgtggctctgttcctgggactcttcctgggagacagaagggagatgagagctcaagaaccagcaccgagatgccaatctagccggcaccagctgcctgttctctgggcactcctccctcatctcacagccacccagcctgcctttccagagtgacaaaagagtgcctgggtgccccctgctcaccctgatccacacttggtgtccagagacttttccccacaccttccaaccagcgagtcctccctctagtgttgccccatgggcagcttgggaagtggggaaggggctgcatctgctcctggtaaaagtcatgtttacgccactaatcgctgctttccttctctccaggtaacaagaaatgcatgcatctacagcaagaaagatggatgctacagagagagagggggacttcctggtgatgagaggaggtggaaattatgctcagtgtcaggagggtggtgagcctcctgccacttctatggcccttctcagtcccctggccctgcaaagggcaggactcacccctggaagcgtcttctgttcgtgcagggcgctctgggccttcagggctgaatcccgggcacagtatgtcaggaaggcacatcctgaggaggggcaggggcagagaaacacggcggggggtgagtcctccatctcccctctctgaaaggctcccttccaaagactgacgactgggaagctttcccttcttgtcatcttctgcctgctggggtagagaggtgtctccaaggggtagactctctgccccagaagtggggcagacacctggaggcctaaatactggtggtgatgggagagggaggacacttgggctgtcaggagatgggctttgtgtagggagagaaggaccatgtgaccgccagacaagtaagagtagtgtggctttctctcctgctgagctgttctcctttcccctctctccctcacctccacctccctccatcttgatcaccatcatccctctcttctcccattttccctatttcctcatctctccccacctccaccataggcaggtggaggacggagagtgaaatagagaagggaagggaagaacagttagttagccggaagtgcctcttccctgtgccaggtggagggggagctggtgtggcccctgggatccccggtgtgtggagctctccaagtgctgaccctgaccgcccccacttagccgcacagcccttggataggcctgaggagcaccctcccttctcccccactctcttaactttctaagcctcccacactttccagatctttaccaatctccagccttcatgccctgcttcctagtccctctctttagtcctggagctgccctgcccagtccagctccacgctttccacattgaacacctgaccctgtgtcctgacccccatcccaatattatctgaggctgctcagattctcagtcttgctgcacacgcacacacacacacacccctacccagctgcttatctcccaaaccagctctcttgtccctccattctttcttgagttcatcccatgacatcaacacacccatatgtctgggatccacatctttgcagccgtcttgacaactcttcagccaaaagaggccctccttagtccttcaccggggtttcctgatcactctagctgagttctttttcagctcctccatccactttcctcaggcctgaactcttctccttccacatcagcccttcccagccgctccacccctccagcctggcttaacttcccccagcctcccagcccaccccgaagcctcttcagcctgcccgacccctcacccttgtgcagcccggtgtacttgtccttgatgacagtcagctcaaagatccgaccaaactgttcgaagatgggcttcaggtccttctcctccagatgcctcgggatctgccccacaaacagcttgatggcatccggctccttcattgaggcggcccaggaggaggggccgaggggagcagggagaggcccaaaggccaaggggagctgcccagcaaggagataagtggtggggcccgggggcccagctggggctggctttccctttggcccccaaccacgctgctaagcagaggggcggctcttcacacaaaggaggcccagggagttgagtgctaggggtcaggggtctaggcagacgctgtcatgccaccagggggcatcgcctaaacaaacgatctccctcccagagatctggcaaatgtcccaggatgggggtgagtatggccaagacctggagggttaggtggtagccgggggtgctagggcttagagggctgggaactgggagttgagatgagagctggaggcggggaaagggcctgaggagggtgatggggaggagactgaggggttaaggggcctgctatggttgccagcagcgtcagtaaggggggcccactcctgatgtggggcaggtgaatctctcgttggcttccctgggaggacacctcccctgtggcggatccttctgctgggtccgaagatccctgatgccagatgcttgatctctgatggcggcagggctccaggggtcccttttgccctgccgccccccttcaggtcctcccctcagcccccctcccacccccaccccagtccccgggcctgggctgctgccggctgctcccgccgctggggctgcctgctttcccggtcacctgggtcccggagctctgctctccggccgcgctctcctcaacaaaaacctcccccctcca

SEQ ID NO: 1851 - DNA, 16260 bp, Homo sapiens
gttacagtggttaaagtcaaacatttattaggtatctgctgttgggggtggggtggggagattgtttgagatactgcaacagacacaaaagcaaagaaagaaacatttctgccagcttacaggctcacagaagaatgagacacttacgcatggccatgatacacagcagtgaaaggtttaagtgccataaggactagaaaaggaaggagaaagacctgtggatgagggccgttaagattttcatgaagaaagtagtgtttaaggtgaactgttttagtgtgagaaggatttcaacaagaaggcattcaacaaacatttattgagccgttatgtgccagacactgtagtaactgggaatgaaaagacatgggagaaaagggaccaaacttgcctagagaacaatgaatagttctatttgggtatgtgtaggaatgaagtggaaagtaaggcttcgaagagccttgaatgccaggctgaggtgttctatgaaaaacaacaaaaaacagcagcagagaagttttgttttttattagctgcagtttagaaagattgatgcttcagaacatagacagaaggaccaattaggaaattgctatgattactcagttaataagtgtaggcagtgataattgaaaagagggaaatgatatgagaaagtttgtggaagtgaaatcttaaatgatttaataccattgagtttatgcgaaagtactaaaaactcttgaggttttctgtctatgtgactagaaaatagaaatatatgagtcaggactttatgggagaaagttttagcattggccctatgatgatgtagatatggatgggaagtccagtatagatgtccaacagtcatttcttatttactaagcaatgtctaatatttggggcactgtttagggtgaccaggatacagtgctggacaaagcagactgggtagtaaatgttggtgaattaacttttaaaagatgactcttggcttcttgggagaacaaattgtaggagagcaggaaaagaaacatggagacagatgagagcaatgtgacgtggacagtgttgatggctgtggagatgcagagacatgagtaagtaaatcagctgaatactttagaggtagacttggtagggctttgcagttggattggggaggagacatgagagaaagggtgtaatccaagttttggcttgagtaggtacctagtggtgctgcttactaatgatgaagacagagggtggggtagcagcctagaagcacatgttctatgaagtcaaagaagacacctgtgtgatcctgagcctgccctaaagcagctcacagagaagaatctaggaagtggagggacttagggcttatgcagtccaccctctacctgaaggactcactcctaagcctgcttgctacttcttgggatctttgcctcaggtcaaagaacaggtaagaagagaacatcatgggctttggaatctgacaaactgggttcaactcctacagccatgccttactggctttgtgactccagggaagttagttaaccttccaagcctccttttcccatctataaaattatatcctacctaggctgggcgtggtggctcatgcctgtaatctgagcacttcgggaggccaaggcaggaggtttgcttgagcccaggggttcgagaccagcctgggcaacatagcaagaccctgtctacaaaaaaaaacaccatttttaaaaatgagctgggcgtggtggtgcagccgcttatagtcctaactacttgggaggctgagacaggaggatcccctgaaccaggagttcaaggttgcagtgagctatgatctcaccatcacactccagcttgagtgacagagtgagaccctgtttcaaagtaaataagtaaaataaataaactatagcctgcctcacaaggttgttaggaggtaaaatgaggaaatgcacaataaggacttggaacagaatcacatatggagcagtggttagtaaatggtggtgtcacaactggctcccagtatccacactggcctctgtgcagaaatggaggtccagatgtgagactgcaagtcctcagccttcagagggacagagctggatacaggggagagcccccgacaggggagatctccttgtgccgaactctgcaggacattccagaattaagccccaaagaagggctgaaggacaggatcatgaagccatgaacaaggcctggatgctgctcaaaagcaagggcccggccttccctgatgggattttctctctcaaacctcattctctacctccctcccccttcccagtgtgggtagggaacaatcccctaccctcaaccttccaagactcttatttgatgcttttaaacttttttctttatttagacagaaaagaccaactctttaaaagtaaaatgcaataaataaataagttaagcatagagaactgtctgaaactgactccccggtctccccttaccacccccacccccaccccattttcttttccctaaaacctcttcctaaagaaaatgatcaggtaataaaccccttgacccctccccacacccctcctcccaatacccaattaccccccaaagcaaagggagaaattaagagagagaaaaaaatccaagggcaacattgtctaaactcccagaaagagagatggcagcgtccgggccaggccgggcgggctggataacgcacgggtggtagtggtatttacacagagggaaccagcagagactgtaaacatttttaggggttcaggggaaggtcttttcctcgtgaaaggaggagggtctctgtggctgactggcagagaggcagccctcagggctcccccacaccctccttagagggggcccttgggggaggcagtgagttttaaggctgggagcccaggaatcagggatatcctacctctagctgagggtggaggggagtgagagccagcttccaagaaacccctaatgtggggaagaggctggggtgagggtgagctgggagtgtgtggcaggcccctgcggctctcctggggcctgcacgggtagaacaggcccactgttgggggaggcaagtacaaacgctgggtacagaaggcctgtcacaggagcccagcagaaggcagataccccggagccttcgagcctgttcctcgctccctcacaaaggccaaaagggcatctaggaggaaatgggcccttggagccagggaagcatagccatggcccttcagagaggcaggggggtgggaggggccggtgtcttgtgcccccgggggccacgaagcagcgtttgccccagaacccagtcaaggcccagggcaggtgtgcggagagggccggggccagtcgtgggaagagggtgtgaggcgccccttcctctgggatctccagacctgtgaaggaagaaacatgggtgaagcatggggaagagacccccgatgcggatcacgggctctgggggaggggagggggctggggtgagtgacagcatctaggatggggctgcctgaggaaggcagatcatcaggcctcagtccaaacggacccatctgcccccacccccagccatgagagcagggatagaggagacaggagggagggggcaaaccatacaggaaaccaaacggtattaggaaggaaatagatagcccatgagaaaaataaagactggagggggagagaggcaaagagatgacaacagacaggcaggcagagaaatcgagagagagacagagaagggggtgcgtgtaagagacagacacctggaaaaagaaagggaacacccgcagagaaggccagggcagagcccaggtcacggctcagggatggagtctcatggggtgagaccacccccggcccccagttagtgctctcattcctttttggaaaggaacacagaaagcaagagaaatgcacagaacacagaccacagtcaccaaccactgtagaccaagcacgtcccgcgagctgcccccggccctgaccttgggcttgggggtgcttccctccgcggcccctccccaaagaacaaacaatcggctccaaagacaacacgctcgttccatgcaacttacaggggcccggagcaggggtccggggatgggggcttcggccgacaatggacacgggccctgggctgggggggcccccagggttgggggagttaagcagccaggattggggggaaaggggagaaacagaaaatgtgggtatttttcttgggttgtgttttctcaagggtttggtccaaaggagattaaacagtgcgaaagtaaccaaggctcacagctctgtggccatgaggttgaggtggtggccagcaatggggtggaggagacctaagtaaacttcacaggcggcgcgacatttcaacctcttccacctaaaccagagcaactcccaagaggcctgaaaatgggctcccccagtctgtcctgtgcactctgctgccccatgggtctgctgctacatgggaaaaatcacctgaagtccagggaaaccagggctgatgtcctcacttctcaggacaacagagattctaggagccaaggattctagggccctctggcaccctcagccaaccccttaatcctccagtcctgttcccctaattccactctaacccgaaggaaaaccagaaagagacacacacagacatggacactgaccagacaaacgagaccagatattgtggaaggtccagggagtggacacatatatacaaagacttggctctttctggggtcacggagggtgtgtgtgtgtgagagagagagagagagagagagtgactcagattattgaaaaacagctgagggagctgccccagccccctgcttcaagtgcccagggtcaagggtggggtgggcatccctgagggtggtggaggacaggggttgggggtgtagtccaatcgagggccctggctgcagtgtgtgaagctggggagggaggccacaacggagcgggacccacctgggggccctcagtagggccggttggcatccttaggccgctttagctggactttgaggcgcttcatgccgatctggaagccattcatggcctggatggcagcctgggcactggccggattgtcgaaactcacaaagcctggggtgagaggggcataaggcccggcccagccccacctcgctcttccgtgcttaggagacctctggcactaccctgtgtctcccaagtgtcccaaatgcctagaaagctgcctgccacatagcagcattccttaggaatttgttgattgatgggttgaatggatgaatccagtccagccactccaactaccacattcttcccagcattctgtgccagtgaccccttcctctgcctggatagctctgagcctgccctttgaaaacggccacttccagaccctaaatggcttctgaagcagagaagaacattccctttctcccctgaggaagactttcaaagatgtgaaggcagctaaaaccgactccccaagcccaccttttgcaaaccaaacatccccagaccataagcctatttcagacctcatgggacatgaatttggccagtttttaagagaaacgctgaaggaagaagagatgggccgaggcagcagctgggtgtggcatgttgggtgtgtcaaaatggctcttttgtactcttggataatcagtatttcaaatactgggtccactgtgaccataaatgccttcaaatatattagaccttgtcctgatttggagtatggcaaaaaatgtgccatatcatattcttaccaaaacatttgctttgattggtggctcggtcaacaaagactttggctgagatgacgtggccaaaggggacaaacatctggaggatctctgagtcagtgaactcctggggcaggtggtagatgaagatgttgcagccatcagggcctgggtggcgacagagacagaagaaagagctcagtgactgggaggcacacaccccagaagcaaatgtcccagggaaagcagatcctgggagtgccctccagtcccagtccttgacagtgtgggccaagtctccggccactccctccccacttgctttcatcctgacacgtgggcaagagctgggctcagcgcggggtgacagggagtccccaagcccataacgagggcattcctgtctcccaaggccccagccagcaccttctctttgctgctgctgctgttgctgctgctgctgctgctgctgctgttgaggtggtggtgggggctgctgggcgaccagggctggaggctgcgggaacgcaggtgcaaccaggctgtaggctgctgggtaggctgctggggtggggagaagagagaggctgatggggcttccctgacttcttgagccctcccagccaaccctgtctcccttcccctagcccaggccagtggcacctgcagggctgagaggtggtcagggaaggagctgcctcagacccctgggtgtgctgcccttaaagacccctccccacagttgggcttgtcagtaaagcctgaagagggtgattggcagggagccaagaagcccagacccagttactgggcctcttttcctcctgccacctctcccacctgagcaggggccctggctagggcgcctcacctgtgtagtgctgcatccccgcgtaggcctgctgcagggggtccacgggggccgcggggctctgggctggggagagcagcacagactatgagcgtggacctggcacacagtgggggccctcagtgcctctctgggcctctgggccgaggccaggcaggtggggagcagagcttctctgggcatggggtgtgaagtgagaaggcagaaatgcacaaagcagtgggaagaggggaaagagcccagcgttaggaagacttgggtctgactgtcttgcaaccctggacaggtcgcttcactgctctacacctcagcttcctggccgagcccaacaggaaggatcatccccgcccaggatggcagggcaggaggaagcacctgtacccccaaagctgggagggaaggtgtgtcctgcctccctaatgggagtggtggtttagatggttgctgggacggagtgggcaggcagagagtcccacctgggtaggggtgaaccccgttgggatacagagcatcaggggcaggctgcccagtgggctgggtgggcaccgggctgtagccgttgacgcccagggcagccggaatggcagagacaggcgtggcagcgatggcaggaggggtgctggttcctggggaggagaaagcgacagggagagagcagaggagcagacacacacacaggcagagaaccagtcagcaagtctgtgggcagaggggaggaagcaggcctctctgacccctgagtccctcccagaccccgaggcttccctgagcaatgccctgtgcccctccctacccctaccatgcttagctcccttgcccggccttgcccaggccatacctgaggatggggtgatgggggtggcgatgaggccattggcattgatggcagccatgtgctgcatctgcacggcagccatggtggccatggggctgaggtaggcactgtgagccgctaccagggccgcctgctgctgcatcagctggggggaggggagaggagagtggggcaggccccctgtgcccaagcctggctccctcccagcccggggccttggcatcgggagggtgggggcaagatacagggggtcaggagggctggcccggcatcaggggcagtgctcacggcctgggtgtaggcgctgtaggctccaaactggagggcgatggggctgaacatgcccaactgggtggccacctgctgcatgcggcggagacctcgctccttctcagtgtcagcaaacttcaccaccaggctggacgaggcaccctgggcacgggcccacacacaggtcagaggtgcagggtcagggtctctcctccccaaagccctcaggacctggtctccattccacccccatggcatggcttggcctctctgagagggcggccaccattttgcgtatgaaagatggggagatattaatcccactctctccctatgctaggatgtgcaagaggctagaagaaaaaatgaggaatgtgaaggcacatgcttggaaagtgaaaagcctactggaatgaaaagggcatcattggctactctgtgaggactctgaactggaaatcatccccaccctgggttgccacagcaaatgtttaatctcaggctagtcttcccttgtagctgccctgcgtgccttaccacgactcctgcccccacaccccagtcctcatggtgtgcctcaaatcttaatactagtctgagctgaataaaaaccaaattggagcatttgcaaggatgatggtagaatcctagaatctcaaagctggaaggggcatagggtcattggacacagttctctacccaatgctgtgtcccctccaccaaggccccgtgaaatgtctgcccagcctttgctggagagctgtgagttatgggaagtgcacagccttctgagtcagccagttccaatttagaggtgggctctagactggtcactgacctaacgctgctgtgcaggggcagggaagaggggtgcacgtggggcctctaagcaagtgtcctggcgccccagcaaatgagggtagggggatatgggaaggctggagaagagacgggggtgaagggagggctggggaatggagggagaaggagagggatgtgagggaatttggctgaaggtggatggggaataggggaggagtggggaggtggggaagtgccatttgaaatgtgagggtgtccctaagcagtttggttcttctgccaggacattcctttccaataaattcaaatagcccatcctgagtggactgcttctctgggccagggcctggcaggtgggcagggtgggaaggagaggcccgggggcaggggagtggggctcactggcagggtccggctgctgtgaagggtgttgatggccgcctgggcctcagcgtgggtctggaacttcacgaaggcgcagcctggagaggttgagatggaggaggagaggggtaagcacccatccctgcgggaccccgcggtggaacccgatgcctagggagtcttgggggtggaacaggaaggggaagggcccggtggggaagggggaagtgggtggactacctttgctggtgccatctggcccccggagcacagtgcactcgtcgatggtcccgaagggctcaaacatcttccggacgtcctcatctgtctgctgcttccctagcatccccacaaagagcttccggtcttctgggtggtagggcacaggaggagggcatgttcagggcctcctggctgccttcccagcccttcttccgcccttccctggagctcctaacactacttctgctacccttagggtccaatggctgtaggggctgatggttggggaatggggtatagttgcagagggtgctcatcccagctctgagggactcgcactccaccctgggcctcagttttgccatctgtacccgccccagatctcacccgctctggccacactgactcctatctcaccgcagctgggaactcttcagaatcatcaggctttctccctcaagaaaggctacccctcgacaactccaggccctgggcctgggggtgggaggagagggacagagtccaaaggcacagaacctacctcctcggctctcgctgtcggctggcttgacctggatcggcctgttcatctgaaggagagaagagaaggcagctgctggggacctcctctgaacacccaagagccctcccaggccaggccctgcagagagactagaggggcaagccccaggccctctaagtttctgatgggaaggaagggacagggcctaatactgttcaggatgaaggcctgaggggatcagaggcacagagagagaggatgtagagggagaggctcatgggcacagctccaggctcaggttgggctcctgatgacttggccagggatgggtgctgctgtcctgagtgggagaagggggcctgcacataggacccggggcctgagagagagcccgaccaaggagttatttaataagaattgcctcaattctacaaagtgggcgcaacagaggccactctgaagaagccccaaggaggactctagactgagggagaccccacaaaggcccagacttccttctgacctctagaggtgtgtctgcctctctttctgcccccctataccccttgaccccagggggaaggcactcgggcagcacaaagggagcagatgcccagtctccgtggcaacgggagaatgcgcaccatggcaaccgcccactcagcctgatttatccgtccccgtcgccctggcgaccgtggtgacgtcatcacttctgctgctccacacacccagagaaggagtggggtggggggtggttaacagggtatgctgggggtggaggatttggtgggggctgggaggtgggggaggggcccagaaaaccttcctgattctggagggaggcttgcagagcaggccctgcaggggccatcccatcccttctcctgcctccctcctccagagcaaatccttggtgcctggagggctctaaaggaggagttgctgtcccgtgctccttcgcaatttaccctgtgcacggaagtcctccagagctctaacctctccccgacccctgcagtatctccctttgttcagtcttcagtggaaatggagaaattcctagttccactctccatgttcttgtctggtgagaggacttggaaattactcctgcaggttgattttcttaaccagggtggggagtattataggaactggagaaagaggagaaggacttagtatttagtgtctgaaaatattttgctcttgaggactctgacagctggaaccacacctggttgccccactcatctgatggtggggcagtagttccagtgaccagaaaaattaaacctcaatttacattctgagggtgaggctagaggtaccctcaggaaaggtactggactgggagtcaggagacctggatttgaggactagccctgccctgccacttactagctgggcgaccttggacaagccactagtcccctctggacctcaacttccttatctgtaaaacaagggggtgggccaggcgatgtctaatcaggttccggtcagctccaggctccagcatgtggagatcctgtgtgtggcatcacttagcgccgagaagtgcagaagtcacagttgcccctgccccttctcaccctggatcctcacccaggtgtcgcatcatgccagtcagtctggccgactccaccagttaggtattcccggcctcggaccaaacctaagccccacctcaactgatactcctttcccagggccccacccccgccccccaaatctctggatctgagagcagctggtgaggagggagggtaacagtcatacaaatcctccagccaatctgcccccagctttatcacccgccaatctgggattatcccatcggaggctcaatctccttaggcatgtgtgtgcgggtgcgcatgcgcaagcaaagcgtgtcgtgggggcagatgctcagggtgcatgggctttcacctccttctctcctgtgctctagccaaagcactcaggaaattccctcacaggcacctccgcagccaggcacccacccctacacccacgccaaaagaagcagaatcagaaccagggttgggggattcttacgcttggcgctagcccccttcccagcaggcctggggatttgctgttctagatggagatgggaacctgggacccagagagaaaggatgcagttccctcctggcataggctcccaggcacaaaaatagcatctcgagaaatacccacggctgatgtggattcgcacaaagagacacacaagtgtacagaccacagcaaggaccgtgctgacggtaggctccccctacaccctcacagacaggacccttggcgctccagtgtccccttcccagcctccttcttcgtggcctggcacttcctgtggggagctcaggcttcgttagctcagctcagacacacctgccccctcccctgagtccagctgtgccctgtttacctggcaaccaggcgcagcacctttcctccctagttactacccaccaggtgacaagccctccctcgggcctcccaaagaaggagtggctatttataccccaacccagtatagccgagcccctccaccacggtcacttttaaggccttcatctttctcgccaatagcaaaaactccacttccaagaagacctcacagttctcacaaaatctaattcttttgagggtacagcctggggtcctgccactcctggctccacacttgttcccggcgtcccagaccactcacaggttctctccgtggggccagaatccaccttcctgactgcagaccgacagggaaggcccatgtcccccaagtgggattttggttcagggtgaagggggaagagctggacagagggcaacccccactccaccacctccatgatgccacaccctgctcagaggacaaattcagggacctgtggcagagccactcctgggaactcttaggggagagaaaaggaaatggggctcaacagctataggcccagcccccattctttctctttccctctgcagcccaaaatatcaccctagtatggtagcaccttctagatttttggggtgacagagatggggagcaaggagagggggctaaatgtctgatttttttaaaaaaacctgcagtaggaaggcatggagattaaacagtaggaagaacagttatgcaggagctgacacactgcacacacatgcgtgtgcatgcacacacactcatgcatgcacacacacactgcatgcacacacacgtgcaaacacacactgaggggagaatgcaggtagcaggagaagacttagggaagacaaagggtcacagacatctgctccccacaactgccctgggtctgttccttcaaaccccttggatgggggtccctcttggaggatggaaccctcatttcctactggaagctgtgtcaggtccctctggattctgtcccctgggacaagggctaaagtggagaattcagcgtcacctagaagctctggagaagggctagacaatcattaaccaggcgcccttcttcctcacccccaccctgggctggacttcctcaagaagggcaggtggtgcctctccacacccaggatggagctctgcctgagctgccaggcagctggaggggcacagacctagggtggacacctgcagctggtacacatgacctttggggctcatgcccatccccaggctgtctctcatccatgtctccactccagtcctctttatctaccttttcctctgaccccctctcatttctgcaggggctctgagatagggagacaacagaaaaagacaaacagcgatggagatgaaaactgttgatttgtgaggggcctccacagagaaaaacagggaaggcaagttgggactggatggggaccaagcttcccagggatacgtgtgcccaaaccccacacatctggcctgtcaagagctcacatgcctgtgtgcacaaacacacgctcgccttgggtcctgcagctcacacacgtgcatggcccttaactctggctgtgacaggcaatgcctattcttgacactgactgggataagatctttggtgggcgtgggggtttgggtggatttgccgcagttggctttgctttcctagcagtactcaaaggttgaggccatggaagggcttgggacaatcagcaaggctggctgggaagaagacacaaagagataggaccttgcaggagaggggccacctctgaggccacccctgcctccctgggcatacctggtggcatcaggcctgatcctctacaatgtctgtccctgcccttgcctgctacttccaggcctacctccagcccagacctgcccaggcctgcccaggccctgctctaccctgatgctctgtggctctgttcctgggactcttcctgggagacagaagggagatgagagctcaagaaccagcaccgagatgccaatctagccggcaccagctgcctgttctctgggcactcctccctcatctcacagccacccagcctgcctttccagagtgacaaaagagtgcctgggtgccccctgctcaccctgatccacacttggtgtccagagacttttccccacaccttccaaccagcgagtcctccctctagtgttgccccatgggcagcttgggaagtggggaaggggctgcatctgctcctggtaaaagtcatgtttacgccactaatcgctgctttccttctctccaggtaacaagaaatgcatgcatctacagcaagaaagatggatgctacagagagagagggggacttcctggtgatgagaggaggtggaaattatgctcagtgtcaggagggtggtgagcctcctgccacttctatggcccttctcagtcccctggccctgcaaagggcaggactcacccctggaagcgtcttctgttcgtgcagggcgctctgggccttcagggctgaatcccgggcacagtatgtcaggaaggcacatcctgaggaggggcaggggcagagaaacacggcggggggtgagtcctccatctcccctctctgaaaggctcccttccaaagactgacgactgggaagctttcccttcttgtcatcttctgcctgctggggtagagaggtgtctccaaggggtagactctctgccccagaagtggggcagacacctggaggcctaaatactggtggtgatgggagagggaggacacttgggctgtcaggagatgggctttgtgtagggagagaaggaccatgtgaccgccagacaagtaagagtagtgtggctttctctcctgctgagctgttctcctttcccctctctccctcacctccacctccctccatcttgatcaccatcatccctctcttctcccattttccctatttcctcatctctccccacctccaccataggcaggtggaggacggagagtgaaatagagaagggaagggaagaacagttagttagccggaagtgcctcttccctgtgccaggtggagggggagctggtgtggcccctgggatccccggtgtgtggagctctccaagtgctgaccctgaccgcccccacttagccgcacagcccttggataggcctgaggagcaccctcccttctcccccactctcttaactttctaagcctcccacactttccagatctttaccaatctccagccttcatgccctgcttcctagtccctctctttagtcctggagctgccctgcccagtccagctccacgctttccacattgaacacctgaccctgtgtcctgacccccatcccaatattatctgaggctgctcagattctcagtcttgctgcacacgcacacacacacacacccctacccagctgcttatctcccaaaccagctctcttgtccctccattctttcttgagttcatcccatgacatcaacacacccatatgtctgggatccacatctttgcagccgtcttgacaactcttcagccaaaagaggccctccttagtccttcaccggggtttcctgatcactctagctgagttctttttcagctcctccatccactttcctcaggcctgaactcttctccttccacatcagcccttcccagccgctccacccctccagcctggcttaacttcccccagcctcccagcccaccccgaagcctcttcagcctgcccgacccctcacccttgtgcagcccggtgtacttgtccttgatgacagtcagctcaaagatccgaccaaactgttcgaagatgggcttcaggtccttctcctccagatgcctcgggatctgccccacaaacagcttgatggcatccggctccttcattgaggcggcccaggaggaggggccgaggggagcagggagaggcccaaaggccaaggggagctgcccagcaaggagataagtggtggggcccgggggcccagctggggctggctttccctttggcccccaaccacgctgctaagcagaggggcggctcttcacacaaaggaggcccagggagttgagtgctaggggtcaggggtctaggcagacgctgtcatgccaccagggggcatcgcctaaacaaacgatctccctcccagagatctggcaaatgtcccaggatgggggtgagt

SEQ ID NO: 1852 - DNA, 4219 bp, Homo sapiens
ctatagcgcaaagctgcggtatggagaaaagcctagaacccacagccgccatgatgacgcaaacaaaattaaaagggtcaagaactcaaggcccactgtttcacctaagaagaaaaggaagaagatgaaggggagaagagaagctctgatttgggtcaatatggaaaggggaggctgacgcaggctgcccaagagccagcctttagcttagtgacggtgatgcggatccgccatcttgaagcgccgcccggcagaggactctcaagacgccacagccccaccacggccacttctcccaaggtacaggtgcgcccgcattcactgaggtcggcctggcccacccctaccccaagaagcgaatcgcccttcattcaaggcaatgaccagcaagactatcacaaagagaaccacggtgaaaaatcccaaagggctttctgggccctgggaagatgtctgtcatctgggactagtgggaagaactcaaaaagtgaccctatttgccaagctcatctaataacacatacagctgttattttcttttcagactctaaaatgcaagggttcccagagccctgctgagttacctggtgtcgctcccatcctgatgcccgggcggtggccgccttctctgtccagccctccctgaaaatgaccccaggctaaggatcagctcagagccccgagctgtttttgtagctttcatgttgacagaacatcctggccactctgctgagagctccatctcccggctcccgatacactgagtcatcttccaaagaggaaaaaaaacaacaaagcagccgtcaccagggtccccattgccgtcgactgacgactcactggctgtcgtcacactctgctccgcggcccccgaattggtaacgaggggcttcagggtgcccagctcccctcccgtgggactcagcagcgtcagggaagcaggcagccactgctgagattcagaaagaagggaaactaacctggcatcaaaaggctcccaggaaagctcactgaccctccctctgccgtcaccagcccccaccactcagatgccatggcatgttcctgatgcagaagtaaaggggtatttatggcaggtgggggacagtacaccttgcaggcttgaagggcgtaacgcctaggttacctcctctgcgcccctgctgtgataccacttagggcacaggagctcctgtctcccccatttcttctctagccccctgctatgctcccattttaagtccctgataaaccactgggtagggatgggaacctatttgctgccaatatattaggcatttctgtataacagttgtagtagctccatctcactgaaaacttaaatcatatgacttgtctaaagtcactcagctaagaagaaggatcacaatgaaaacctaggtctgttcaagtccagtgtctctgctccctgctctctaattctggagcttattctggctttgaagatgctgtatcccactccacctctccctcctcttgtacgaggaaggcaaccaggataactgagtcagttaatccatcaatttcagctacaagaaaaaagccatcatcttgagtgaacctgaccacaaaggaagaggagaaagttaatgacagtgtcaaggaacagctgagggacccagaccatggacacaagattgaccacccaaactccctcagagcattagggacttacaaaattccttaaatagacaaattttggggatctacttcataacagccatcttgtaaacaccagtaattcagagaggaaaaatgtaaaggctttggaagaccagggctctagtcatgaccaggccacttactagacatgggatgctccccacagggctgtggaaaggagtaaatgaagtaactgcagggaaagtgtataacatggtatctgtcaaacagaaggcaccaaataggtatttgttttccttctcctttctctagcctccctcctggagctcccaatctgataggtgacataagacttatacacaaataatcataacacaacaaaagtaccataaaaagggacagactgtatggaagtttggctgaaagggcaggggtggttatgagaactgcttcttgccaaggaaatcaggagaggtccacggagaaagtgagactgccacaggtggatgcagaggagaagaggcatggaaaacatcactggtgaaaacagataggaaaaggaagttgcctggttttgttggaacctatggtccaccaaaagaaactgagagaggtaagactgtacaggaaacctaaggccagttacggccagcattgagcatcacgctaaagggaaggaattttactctgggaattatgagaaaccattttaagtttctgagcaagaaagacaagatggccgctgcacgcagaagggcctggagagagggggaacgggcagcggggagcctcacaagaggactacagctggaaccatggcactggcagggggcatggaggagaaagagaagaaaaacagtaagcaggcaggaccatccgaacagatcctcaaagctgccatggacctcacttccctgtccccacagggaggctgctggagacagagcctatttggggaacacaaaccacgggtctgacacgtctgagatgagctgccgagcctctgcctccactctcattcagacactcagcttttccgaactactccaagcaccaggctgatgaggacatgggaaacccacgctctggcaaagccgggcccaggtgttgaacccctacccagacgccttccacctgaatccccacccaggactgtgtccaagggtgggactaggcggctctgcccctagagccaccttcattgcggcagccaccactgtgcctgcctctgctgtgcttttgcccccccttcccctcctccgtcatagcccccgccccccgcccactctgcggaactggcacagcaggacagaaaaaccaacgccaccatgtcggagaccagcagaaatggctccaaaatggcagctcatcagaggagtccagaaagatcataaacccacccagggaaaagaggggaagccagtgacaaggggagtaaactgtcaaaactacctcccaaccaagcccccgataatcatcacatcttttccttcagaaacatcctctcaaaaatcagatgggacatgagtgaaagaagggtgccaccccctccaccagagaggccctaggggccataggtggtatggggcactcagaaggatgttctgtagcctcttccccaagatgaggctagaaaaccaccacttttgtcctcaagcttggctcctgccagtaactagacaagagttagccctcccagggattgcagtccttcactgctacccagtcagaccctccccagctctatgggccctggggagcaagaaggtagggttgcaaggaagggccgagaaggcgcgtgccatgccctcagttatgtaataagaagggcggtgctcgtcctaggccagagacccagggcgcactgcgcttccagatgcgcagtcacgggtgggggccactgcgcatggcgcagggcttggtaaaccccctccccacaaacgtgagacctgcgacaaagacaggttagagagccgggaccctgatttttcgaggcctccctcccccaaccaaaggcggacagcctgctgccctagttttattctgattctcctcattccctagactgacaaacctttctaacccggggcctccaaacctcccgtctcccactgacttttctggaaatcccaccagatgcggagtttcgagcaatttcctggggtcagtcccccatcctcacctttccaagcaccacgtagtagtagcttccagaaggtagatctttcccatactgggctcagctcacaactggctcttgagggcctctggacagccccggacgtcaatgcaaatctgttgtccccagggagtagcccagagtcagcaggaagcccagggtggtggcagtatcagcagcagcagctctgccctaccttgcccatgcgtttccaggggagccaagaattattttgccgcaacactgaggtgtggctgattggaaaattcccttttccaacaccaaactacagaataaatattttcttccaatttggtcaaccctctgcatacccatctccctagcattcttccctctaaataaaaagttttgggagccctgagctcttcctcctta

SEQ ID NO: 1853 - DNA, 182565 bp, Homo sapiens
tgagatggagtctcactttgtcacccaggctggagtgcagtggtgtgatatcggctcactgcaacctccacctcccgggttcaagtgattctcctgcctcagcctccccagtagcctgcccccatgcccagctaatttttgtatttttagtagagatgggatttcaccatgttggccaggctgctctcaaattccttaccccaggtgatctgcctgcccaggcctcccgaaatgctggggttacagcgtgagccgctgtgcccggcccagccacttcttcttattggagtgtgagcactaggagcagggacctttccatggtgcttgctgtgttataccctgcacccagaacttagtaggcgttcaaacaaaatttttaaaaataaatggaagaacgaattaagaaaccttccgggtgagtcattatactgtccccaaacaggggacatcatcaattttattcctgccaagtagatctggactagaagaatatgtgcttgatctacaacaaaagctgccaggcaaatgcctgatactacgtccatctcacctgttctgctcccaccatgctaattggcttgcacttgaagaggtgggtgatgaatttgggaatgaaggagctgtggataaaaaagaagtgacaaattaggcttattctctcttgaggaaagaaatgcaaaaactttaaggttccacgtatctccatgaaaaaaccttttttaatgaagaatcgaagtggactccactgttgcccattatcttatttttcttctgagtgaagtcctggttttgtttagttacatgaggccctggcaggcccgggaaaaccggatcccatcctagactcccagtgaactctaactattctcagctcgtcagagcacagcattcctttggtgactgttgtttgtcctgagagggaatatgatcgaagctagcccaatcagactggatgtaagggctacaggcaccgcacctggctactttttaatttttttgtagaggcaggatttcgttatgctgcccaggctgggctcaaactcctggcttcaagcagtcctcctcccttgggctccggaagtgctgggattacaagcgtgagccactgggccaggcttccttgattcttcattctctgtctccagcctcatcctgctaagccctggcctccctatgcttcaacccaactgagccacttgcagatcccaggattctgggggctatttaatgcctacactgctccctcgcctggactgcctttcctagaaggggcttgtgggtcagtacacacgcacctctcagatcctgttcaacggcgtctctagaaagcctttcttctgctgccttcgccatactctacatggagtctgcaggcctccaccctcacatctaacctagttcattatgctcatttgcttacatgtctattttgcttcacctgactattaaggcaaacgaagatgggggccatgtttatcaggccaaaacatttaactctgggtctgagacataggagatgctcaagtgaatgcacattgagtaaatcataaacttttttttttttttgagacagagtctcgctctgtcacccaggctggagtacagtggcaccatcttggctcactgcaacctctgcctcctgggttcaagcaattctggtgcctcagcctcctgagtagctgggactacaggcacgcaccagcatacccagctaatttttgtatttttagtagagatagggtttcaccatgttggccaggctggtctcgaactcctggcctcaagtgatcctcttgcctcggccccacaaagcgctgggatgacaggcgtgagccaccgcgcccagccacctaccactttttgaatgtcagcttggtatcagcactttaccaggaagttaatatgtgacttctcattttatcttcccaaccactattatgagatttgtctcattatctccttgattgaagggaggaggatcagctcagtggatgagggaagttgcttgtggttcaactgcagtttcaaccaggctgtggattttgatgtctcaacaggaaaggctgctattgcttaagacagcaaacgaggtaaaaggaaacatctatggttttgcaggggtggggtagaaaggaagctgagggagaggaaactggagtccggagatcggatctggaggtggcttgtgatcaggaaggagagtaaacaaggggctatttggaaggaattcctcagtgctggaaaccagagccagacaagcaacatgaaactgaactcatgaccaatggcagctgtgcacacagcgctttgtaacctaagttgcttcacattagaacatgctccggactgggcatggcagctcatgcctataatcccagcactctgagaggcccaggcaggtggactgcttgagcccaggagtttgagaccagcctgggcaacatggcaaaatctcatctctacaaaaaatagaaaaatgagctaggccgggtggcgagcgcctgtaatcccagctattcaggaggctgaggtgggagaatcacctaagcccaggagatgggggctgcagtgagctgtggttgcaccactgcactccagcctgggtaacagagtgggaccctgtatcaaaaaaaaaaaaaaaaacctttggctgtgcccctgaactggctctctatactagtctacaggtggcgatggggggagtatgaggacctgacacacgtcctgtggggaaaaaaccaagcaatgtgctgggtaactgccaagggcttctctgggccatcagggcggtggtggctgctgcccttgaccagggaagggtctcctcacaagcccacctctgttaagcgggattttagcaggatgagaaggcaccatggatgaaaacagaaaaccacttcctagatcccaggctgaatgattacagatgtgagggggggcatccaattcccagcgcactcaacctgggcttagcaatgaaactcaagggctctgagagaatgtgaggctgatgctgggagatgctgggactggctaagtcaaccgactcctccttcactttaacgtaagctcaatcatatgactgagctgggagacgccgggactggctaagtcaacggactcctccttcgctttaatgtaagctcaatcatatgactgagcagggagacgccgggactggctaagtcaacagactcctccttcactttaatgtaagctcaatcatatgactgagctgggagacgctgggactggctaagtcaacggactcctccttcactttaacgtaagctcaatgagaccccggagcagccaccctggagattttgagtcacagtaaatttttacagagacactgcttctaccagcagttatggggagcgtcacgatgtgatttatcagcaacatttctaacacactaatgagcacccagagagtgagggaatttcacctcctggtccatctgccatctgcaaacattaatgcctccctggagagtccactctatcctttcttgacaaactagaaagtaaagctgacaccacaagccgctccataattgttagtcctgaggggttcatttgtgaggtacagggaaactgggagagattgggggaagacagaaacttggagtcctgaatcaccagctggggcctggatgggaacaacccaaatacagtagcttggcctgggctgaccctcctgaagcccttccctgagaagtctgccaaaatgcttgcttgataactggtcagaggagacactgaccctcaccaccacctggtatcacggaaaatggtgctaagccagatggtgatcggcaaagaactaaactatttcctcgcttcaaaactcagggcagaaatggccacacacaagacacagcaggaagacacacggctcagggtgcactcacctgccttggccagggagctccctggcttgtgcatcccaatttctagtgccttcctcggaccaagagtgtgtccaagtatgaatagataaattctagcagccatggtaaaaaataccagggggagggaggacaagaaggctcaaaagaaacagaaccgatggctcctacccttaagaggcatttattaagccagtcagagaaacaaaatgcatatatgaaatccctgaaaaagaattttaattatccaatcctgggcaaggagagcttatgcctgcacagttcaaaacaacagtaggccccattcatttttgtttgccttgacgtggctggcaattgtactgctgttactgttgcctatgactttaagtagcagatttagttttatgattatgcttcttttgtgtacaaattaaaatcagtactgcaggcaccagaacaaaccgcagctggatggtggggacactcaaattgtgaggatgctggtgggaagtatggttttaaaaacaacccagttgagtatgacactgaaatggcggccacacgtcactgtacatttgtccaaaccgagggaatgtccagcgcgacgtcagagtccgggtgataatgacgtgttgatgcaggttcatccactgtaacgaatgtgccactttgtgtgtggggaggtgtcggtaatgggaagactgtgcatgttgggggggtcaggtacacgggaaatctctgtgcttgctgcttaatttggctgtgaacctgaaactgttctaaaacataaagtctattaaaaagaacaagaacccagagatgagcacgccccaggacttactttgcaaatttaacgcagaactgagtgaagtacttgcgtgtggaagccaggttgtcacggatgatggggacgttctgcttgatgtgcagaatgacagaggtgacgtaggggctctggtcaccaacgtgctccacgttctgccactgcatctgaaagggagaaaggatgaggcgttgaatccctcgcaggagaacggtgtcgcctgttactggggaagggaggggctggagtggaagtcaggtcacagctttggtatcccaggaatcaggcccttttgtcctggggagtttcttattcgttctgtagggactgatactcaggacaaatgcgagtgtgcccagcggacccgacagtgaggtgtgacccagaccctttccttttcctgccttgtccccgacctgcctgaaacagccttcccttctcagctaagctacccactcgtaaaggatcctgttctcctgccgagtgccccacagcaggggactgcagcagaacggggagggacaccgactcccaagctgaccggcagcctgggagatgagagaggtggctggactaagtgacatgcaacctggaggggaattcacagacacctttctctccagtcaactgggaggagtttgggattctttaacacagaaaactagaaatgatatgacacgtggggatgttgcttcaaaataatatgaagttaccgggaagaggtgcagatgaaataagatcgtgaagctgagtgacaggtacatagaggctgaccacactgtttcctctacttttgaatatattcaaaaatttccataataaaacacttgaagaggtatgcgtgtagaatcttacactcctaaaacctttgggattatgtcaggatttcaataaggggaagggaaagagaatctctggcaaacactagggtggaccagagggtaagatggagacgtggggaacaggccaggagccaggcgcaggggagagaacattgctgagagcaccgaggtggtccctgaacaagctgtgaacaaaagtgacagacctgcttcaacctgagccctaacgacaggctctggaagacacctatagcaaactggcgggattcttggactacgtggcacttggcaacattgagtcctgggaacagaaggaggcaatgctgcagtgtgccatcccccaagggtgcatgcaggagatgggtgcagcaccagctcctagcctgccccgggctggcagggaagggcattctaatcccgaagagtgggaatggtctggagggttctgctgagtcagcctttcacagtggagctggacggtctggagggctctgctgagtcagcctctcacaatggagctggatggtctgttaaagagatcctaagccaaacacaaaccatataatatgttcatagaaggaagtcagtagttctgaggccctgatgtctctggcaagaaaacactatttttacagagctcttggggaaaggaaaaaatcaatactgagagagcttgtttaaaagaatcacatcgtacgtggatgattctccagctgtgggaagctcaaatgactcctaatgttttttcaaatcagcggatatttgtattctaaaagctttagggatgtgtacacacagaaccacagaaaagcaggaagggacctccatcttcatttcacagataagaaagccaaggcccagaaacatgaagagtcttatgcaaggtttcataaccaggctccacacaggaaaaagaactctaatttattactgggaaaaaacagaaacaaacaatgaagaaacagtagaaaggtctaatatgaagtgacttaacattctaatgctttggttatgtgaaatgttttcctcattatcttttatcttacgcaagaggcttctttttccatttgattttgaagatttgacccatccaaacaatgagcatcctgggtgattttaaatgagctcatagggtgaggccaaaattgacaggtgctgtcagcatttcctgggctctgcagcaggactcggagcagaatgttctgggtagacacagcgaactgggagggcttgatgcccccaaagccaatcatgtccatagcaatgactgttactttccaagctggcagctttgtatatttcaaaatctcaaaacggtttatcaacaataatctaaacatgacagccctccatgaaagaaggtggcgacgtgctctgtcaccagttacaaagcagctctgaagcaagaccaagcaggggcctgggatttcttcaacttcccactggttattccgcatgctcgtcaccgaactcctcttgatgatcactggccaagtcagtatgtgcccacatttggaatatatgtgaaaagagctgatttgctttaatactctggtcagtcatgactccattggtcaagctaaaagaagtattagcaaaggccaagtggattcatgattttaaacttaagtcagcttagtcaactaagaaagtgatttaaagtactagaaaacaataaaaggtgaccttacctttagtattttttaaaaatgtggcacacgcctatagtctcagctaccagggaggctgaggcaggagggtcactggagcccagaaggttggggctgcagggagctgtgattgtaccactgcactccagcctcagatggctgatgcttgccatcatcccccatgggtgactgaaggtttgggtcacaacctgaactgcccaggatagctacattaagaccgaacttcgcaggtccctttgcatggccctaaacatacgtcgtctcatttactattcatacatgatctcactaagttctcacaacaaccttatagatgaggaaattcaaaaagctcaaagagatttggtatcttgcacaaaatttcacagctgggacaaccacgtctatctaaagcccaaaccaggtctatctaaagcccaaaccaagtctatctaaagcccaaacccggtctatctaaagcccaaccaggtctatctaaagcccaaaccccacaacaaggtgcttgctagacaacttcccccccgacccgcccccgccaccctgcccaaaaaaagaataaaagcacttaactaggccttcgttaaaggtaaggcctgtttctcaaggagacgctaatgaaacatagtgatcaagcaaaggactctttatttttcatttttttttgagacagagtctctgctgcccaggctggagtgcagtggtacaatcatagttcactgcagccttgacttcctgggctccagcaatcctcccagctctgcctcccaagtagctgggaccacaggtgtacactaccatgctcagctaattaaaaaaatatatttttttcttttttactttttgtagagacaggggtctcaccgtgttgcccagactggtcttgaactcctgggttcaagcaatcctcctgcctcagcctcccaaagtgctgggattacaggtgtgagctaccacgcctggcccaaagaactctttcaaaaaaggaaacaaacagtaccttgcattggaagaacaaacatcatgaaaagccatcagtagaaatgagacctcaacttttccaggtaaacttttcatttgacatttagaagttacccctctacacttaaaattgtttcttgttgtgctttttgttttgggggcttgggtagagttgaatacagatggggttcaactggtactactatctaaatgagacacagtttgaagacagtaagaatgatgagtgcctccgggacctagtttaaccaccacaagaagagactgcagggcccagagtgtccccagagcccagcttctgcggcctgggcaggaagtatgtgctctgactgacgctccacagtggggctggggggtcagcactctttctagagagagtctactgtagcaggaactttgaccagagaacagcgctccacaactagcttcagtggatcttgttttttcctattgctataggaagcttggaaagaggtttcttgaaaatgtgaatacttaaattcctacttcttcactggattagagagacacagagcatagactcagacagctgggctctgggaacatttcaggcaactgaagtctcataactgaggctgccggggtgttggcctcaagctgtagactttactcaggcacacacgtacacgctcactctcactctgatgcctggtggggctttcactcccgcagcatctgctatatttataggtaccttcggcaagtgcagcagggcactgagcatcaggtggagaccaaagagatgaaggaatgtttatcaaccgcctgccacacactgaaggaatgtttgtcaagcatctaccatgcaccaggggctgaaggaatgtttatcaagcacctactacgcactgaaggaatgtttatcaagcacctaccatgcaccaggcactgaaggaacgtttatcaagcacctaccatgcaccaggggctgaaagaatgtttatcaagcacctactacgcactgaaggaatgtttatcaagcacctaccacgcactgaaggaatgtttatcaagcacctaccacgcaccaggtgctgaaggaacgtttatcaagcaccgactacgcactgaaggaatgtttatcaaggacctaccacgcaccgggcgctgaaggaatgtttatcaagcacctaccacgcaccaggggctgaaggaatgtttatcaagcaccgactacgcactgaaggaatgtttatcaaggacctaccacgcaccgggcgctgaaggaacgtttatcaagcacctaccacgcactgaaggaacgtttatcaaggacctaccacgcaccaggggctgaaggaatgtttatcaagcacgtactacgcactgaaggaatgtttatcaagcacctaccacgcactgaaggaacgtttatcaagcacctactacgcaccaggcgctgaaggaatgtttatcaagcacctaccatgcaccaggggctgaaggaacgtttatcaagcacctaccacgcaccaggggctgaaggaatgtttatcaagcacctaccacgcactgaaggaacgtttctcaagcacctactacgcactgggcgctgaaggaacgtttatcaagcacctaccacgtaacaggtgctgtgcctgacattttcacatgaccttgctgcctgatgaatgaatcatgtagtgaaagaggtattattactcctctttgtgagtaataataaatgaggatgaaacaggattgaggacagcgagtgacctgcctaaggaagcgtaactgctaagttagcaggaaaggtcattaagatggtacttaagatgctgaaattgagtcagccagtctgacttctgacactgtgcaaccttctaaaggggtgaccgggacaagtcatctaatttctctgagcctcagtattctcgtctataaaattgggatgatggtaacatctataatctattactgaaagataacgcatggaatgctcttaacacagtgtctcgcagcacgtataaattccacagtaaattttagctactgttataattttaagaatacttgcactatcactaaaaatcactaaatttcgataactgataattatcaattaattcagatatgtatcaattaattgaaattatggtgatttaagttttattctttttttcaaaaaaatctgaccgggcgcgatggcaacatgcctgtaatcccagcagtttgggaggccaaggcaggtggatcacttgaggccaggaattcgagaccagcctggccaacactgtgaaaccccgtctctaccaaaaatacaaaattagccgggtgtggtggcaggcacctgcaatcccagctacttgggaggctgaggcaggagaatcacttgaacctgggaggcggaggttgccataagcacaaatcacgccactgcactccagcctgccggatagagcgagactctgtcaaaaaaaaaaaaaaaaaatctgcatttttctaaaatggaagtgatttagttttgtcataatgggaaaaatcttttttatgaaaaagaaagctgtgtcttgattctaggtagaacttgacagtttcttagtcatggctttctgtgggccttctgaaacagatgtgcattttaatgactgaggaaaatgaaaatgagaacagacttgtcttgattcaacgtagaagtgaacttgaggatttcttagctgtggctttccatggtccttctgaaacagatctgcattttaatgactgaggaaaatgagaacagacttgagaactcttctacctgtttcaaagtgtctttgggggattataacgcagcctcctaaatgggtacatgttcacaatcctgaaacctaatataaattatgtgccagacggtaagaaaatttaatttattcagtttctgttttttcctaaaactaccattaataggcaaaacactaggtgtgtttgcttctgaacagagacttggatttatttacctgagtgatgtgagcagccctaggaaaaggcacggagagaggcggggaccatgagaccaacagcccctgctagggagcccacggctctctatcctacgtacaggggcataaccagacatactcatttctaaggatttgtaggatttaaatctaaaagatagaatcctttgtatttccaccaaaacactccaaataactactttttccagaatcaggagaactagttttacttctagcttcactattataagttatatggctttgggcataatatgaagaagagaaggaaggaaggaaggaaggaaggaaggaagggagggagggagggagggagggagggagggagggaaggagggaaggagggagggaaggaggggagtttggagggagggaagggagtctggagggaggggaggggacaggggaagggagggagagaggaaagaaggaaggaagggagagtgggaggaagggaggaacggagagagggaggaagggagggagggagggagtgaggaaggcagggagggagggagggaggaagggaggaaggaaggaaagaagataccagaaggaaagttcattagttttcagggaaaaatattcaacgcagattggaatatgtgggttggctgttcaacacatcttctccactgtagaaaagtcctggtgtcagatcaagaaaagctggagatgaatatacaccatgatgatggtgaatgcttgaagaactcataatcatatcagcatgaacactcgtgtggacccaccaggactgggcacatgctgacagaaatgtatcaactaattgaaattatggtgatttaaattttattccttttttcaaaaacatctggtcgggcacgatggcaacacgcttgcaatcccagcagtttaggaggccgaggctcttccacttttaggcaggttacttaagctgattttgcctcagttgccacatttgccaaaaagacttactcactctctctgtatggcatgccacaatcctgcataaagaggcactgtggtggcgtgatcacagctcactgcaacctctgcctctcaggctcaagtgaccttcccaccttagcctcccaagtagctaaaagatctggagcaggtgatttaatgtctctgtttcagcttctttatctgtgaaaaggggaaatagcatagccatctgatgaatttattgttagaatgaaattaattgggttccaattcctggtaagtgctcagtaaatagtaacttattatcaactcatacaggttatctaagaaaataagcaatatggaggccaggcacagtggctcacacctgtaattccagcattttgggaggccgaggtgggaggatcactagagctcaggagtttgagactggcctgggcaacatagcaagacctcatctctactaaaaatcaagaaaattagccaggtgtggtggtgtgcgccagtagtaccagctatttgggaggctagggtgagaggatcactggaacccaggaggtcaaggctgcagtaagctatgattatgccaccgcacccaagcctgggcaacagagtgaagaaatttttttatgaaagaaagaaaataacactatgggaaggaaacgtggtctagaagttaattttgctgtaactcatcagcaacactactggaatctcaaagtcagagtttcagagggaccacctgactttcatcacattttcctcccccttcttcggcctggcctgcagaaggctgcacctgcatgtgaatctagcaaactaccgctctgcatttccctctccttgtctagcagcaggactcagggccacacccccgcgggctcgtattccttcattcccacatctcttcaatcggctccaggatgccacctgctgaagtcagaagcccttctgctatcaggtgccattgaggagcatcactccatcctcaacagcaccagctatggacctaaaggtttcagggattctatgaccccaccgtctctcacaaagttgtccaagtttcctactctacatctaccagctccacctggctacctctgctcagtagagttatctatgtctcacttgtttaccaatctttggtcaaaagtgtgtttgtggtcctttggttctttctctcccactccctggctccctctttaccttcaaagtcattcagggaatactacagttaagcaagtactgtgccatgccacgggtttccaaaatgaataagacacagccctcaagttgttcaaagtttaatagggaagacaaagacataaaaatgattacataacaaagcagaaaggtagtctaggtactatggtgtcttgaaagagaaataaatatgctctggctgaggcaagaaatgctgacattgtaagggacctagaagagccaaaacagtgttgaaaaagaacaaagttggaagactcatacttcttgatttcaaagattactacaaagctattatagccaaacagtgtggtactggcctgagggtggacatacagatagatggaatagaactgagagtccagaaataatcccacacatctatggttaactgattttttacgagggtatcaagatcatccaatgtgaaaagaatagtcgtttcaacaaatagtgctgggaaagctgagtatcctttcagcaaaagaatgctgctgaatctttgcctcacaccatatgcaaaaattaactcgaaatggattgaagacctacatttttttcctttttttcttttttgtgaagacctaaatttcttagaagaaaccacagagtaaatctttatgattctggatcaggcaatggtatcttagatatctcacacacacacacacacacacacacacacacacacacacacacacacgatataccaacttcagaaaatcaaggacattatcaagaaagtgaaaaggcaacccacccacagaatgggagagaatatttacaaatttcatatctgataaggggtctagtatccagatataaaaagaacttttacaattcaacaacagaaagacaacccaattttaaaatgggcaaaacatttaattctcatttcttcaaagagaatatacaaatcgccagtagcatctgagaaggtgatcaacatattagtcatgcaaggaatgcaaactgtaatcacaatgagataccacttcacacccacgaaaatggctataattaaaaaaggaaaacaagtgtgggagaagatgtggagaaactggattccttacactttgctgtggaaaggtacaacggcacagtcacttcagaaaacagtgtggcactttctcaaaatgttaaacataaattgaccatacggctctttcagttccattccttaggtcccttagatccttttttttttttttttttttttgagacagagtctccctctgtcacccaggctggagtgcagtggtgcaatcttggctcactgcaatctccacctcccaggttcaagccattctcctgtctcagcctcccaagtagctgggattacaggcacgcacgctaccacacccggctaatttttgtatttttattagagacagggtttcgccatgttggccaggctggtcttgaactcctgacctcaggtgatctgcccacctcggcctcccaacgtgctgggattacgggcatgagccaccacgcctggcctttaggtacatattgaagagaactgaaaacatgttcacacgaaaaattgtacatgaatgttcacagcattattcaaaattagaaagtagaaataactcaaacgtccaatagacgaatgaataaacaaaatgtggtctatccatatgatggaatgttactcagccacaaaaaggaatggagtgctgacacatgccccaccatgcacatgccctgaaaacactacgctaagtgaagaaagccaagcacaagatgtcccacatgccatatgattctaggtatgcaaaatgtcaggaggggcaaatctatagagacagaaagtaggctaatggttgtcaggggaatgtagaatgactgctgagaggtacggggtttctttttggggtaatgaagatgttctggaattagatggtggtggtggtttcatgacattgtggatatactaaaaacaactaaattgtacactttatttatttatttataaaatagagtctcactctgtcacccaggctggagtgcagtgctgcaatcttggctcactacaacctcggcctcccaggttcaagagattctcctacctcagcctcctgagtagctgggactataggtgtgtgccatcatgtccagcaaattttttgtgtttttaatagagacagggtcccaccatgctggcctcgaactcctaacctcagatgatttgcactcctcagcctcccaaaggagtgagccactgctcctggccaactgtatactttaaaagggtgaattctgtggtatatgaattatacctcaggtttttaaatggggacagacatttgaacttgatcttaaaggacgtgctccttgggcagacgatagcaggaagaaaattctgggcagaaagaataaaatgagaaaaggcatggaagccgcaaaagagcaatatgcattcagggaagtaaacatggctgcgactggagaacagggcacatactccggagtgagcggcagaaactgacctagcagtggagtaaagagatagataatgaaagctctatatgccaaccaaggaagaggccatgggatgccttccatgagaatgaggtctcccaggaaaatgacttaaccaagttgccaggctcaatccctcttgtcaaggaagtctccttccgtcaactcagaatcatccaatgactacactccactttggccagccaacagtccttctggaatcatccaatgactacactccactttggccagccaacagtccttctggaaatatccaacgactacactccactttggccagccaacagtccttctggaatcatccaacaactacactccactttggccagccaacagtccttctggaatcatccaacgactacactccactttggccagccaacagtccttctggaaatatccaacgactacactccactttggccagccaacagtccttctgacatttataagatacacttatttacagtattggttgttctcagttttcttcccagcagggtatagactccttgaggacagtctcgtttccaatcttaactctgtcagtccaagtacaggagtagcctgaggagcccctgggatgttgaatgagattggcagtttgaaccaagctctttagcttccctaacctctctttactcatgttttcaccctgtttgaactgccctactaatcacaaactcattcagaatttcgccctcatctgtttcaaacaccacttccttacgagggccttctttgcctccccacctggatatgaactcctccctctttaaaaagggtgtattttgtacttttcttatggcactgatttcctcatctcttatattaaagttactgggtattgctgtcatcttacacatctcttgccctcagctactggaatctaaacaccttagccaagggtttatgcctttctgagccttgcagctcccagcactgtgctgggcagggtctgaactgaactgtttaaccagcagcaaaaatgatagaatcagagacagaaataaccattatcacaaaagtttttttaaatcctagaagaaactacacaaaacaggatgcaggcatcaagaacacagaatgtgtgttgaatcaatttgtgaccacttggcttgtttatttccatcacatggattttattttgctagaactccagaagactcagacaaaaagtaatggcctcccagctgctgcgttcccaagtctgtggttttcctatgatataaacaaaggactctggaggcacggtctctgttcgtatttgctggtgtgggcacggggcagaagtggagggtgggacggggcagggtttgagggaaatccaccgaacgaaccgacagttcgtataagcaacacttgcagtgttaaaccccttccaaccgtgattttattgaaaaaaaaaaatcccactcttcctttggtgaatgtgaaaattctttcggcagctgcattccgatctgaagtgtgtggcagttcaggagagatggcagctggcacagatcccactcaggatgtagagaatgcttaccagcagcgaggggatcatgagagctggcaaaacgaatcctctaagcagatggactggcctcactttgcctgctcagagtgttctcctgtgaatgctgagaatactggaagtacccatcagcaccggactgctgaaaagatcagctttttgaataaaactgtgacatcagctattttaggacttgccacttcagttcataaaaccctaaagcctacattttggttttaatcttatttttgttaaatatttacaatctactgcaaaaccaaattcagaccaaatgtctgcttacacaaccttgtgacatggtcattcctcctgacaagagggagagggaactaacatttaatgagcatttactatgtgcctggcactagacccgcccgttccatgtttcatcctcacagcaatgctgggaggcagagatccacagttcacttggggtatgtgggcccagatgatgtcacgttggcccagacaggtgaatcatttgctcaacaccccaaaggaaaccctggaggagttaggtctgtctgactctaaagttagtgttcctcccactgccctctggtactggccagtataacctagataaattgtttctccagaatttgctacaagagcctatgactctagagcagacattggcaaactttttctgtaaagggccagacagtaaatatttaatttttttagctttgtgggctagtctctgttgcaatggctcaattctaccactatattgcaaaaaggcagccatagataatacataaataaaggaacatggctgtattccaataaaactttattttcaaatacaagcagtgggccagatctggttcccaggctctagtttgccaacccctgctctacaaagttctagagttgcagctgcatgttacttgggtttagcataacaaaggcccatttccaacttaattaacaaaaatgaatctcccatattcaagactacaagagagataaaagagggggtgaaagacatggtctgtgcacttacggaattgacattcatttgggaaaaaaaggcataggcacataaaagtcaaaaataggaagatgaggtagcgctcagtaagtgccaaaggaggagacttgagggccaagggctgactgatgggccaccacgatattagaaaaccagagttcacaacctgatcaaatactcttacattggcaccagagctcagaaggagttggaaaaacctctcagtgggcaagaatgaagaatgagtcagaagttactactttaagcactaatgaaaacacccattctggtgagaccacaccaaggtttttagcatgtgtcagatactaatcaaagataatacgtaaataaaggacatggctgattggtttttaattaacaaaaatgaatctcccatattcaagactacatgagagataaaagaggggtgaaagacatggtctgtgcacttacggaattgacattcatttgggaaaaaaaggcataggcacataaaagccaaaaataggaacatgagaggaacatgaggtagcgctcagtaattaaaaatgatccatctcagctgggcactgtggctcatgcctgtaatcccagcacttggggaggactcggtgggaagactgcttgacgccaggagttcaggaccagcctgggcaacatagcaagactcttagctctacaaaaaatttaaaaagtagttggacacagtggcatgcacctgtggtctcagctacttgggaggctgaggcaggaggactgatgagcccagagggtcaaggctgcagggagtcatggtggcaccactgcactccagcctgagtgacagagagagaccctgtctctaaaaaaatataaataaaccacagacaacatctcctttagactcatcaaacacatttacttcgtctcttttttttttgccatcctccaatactgtgatgctctgtctcattctaaaaggacaagcaactgaactgacgcaggtgcgacactaactgagtgctttcaggaactccggggcctctccattctcctcagctgatcctttacgctccgatgagcctggagaagctacagacaagggccagtagaagccaccttgggctgctctcgttagtttgtaggatgccatttcccaagaccttaccttgctcatggcagtcagggcaggatcacaggcagcatccagatcctgaaccagcagctgaatactgctggagatgacgctgcaaatcaaacaaatcactgtggtcaccctttcaaacaacggccgtctgaatgactgacactcaggcccctgtgtaaaaatcagattcatcatttcactggcaaagtttgagctttaattaatgacagcggaggaacagcttggctctttcttcatgtcctggttttatctgggtgtgtcctcacccagtcaggatatagaatcccacggtcagtctccctaatcaccaccccagtatccctgttcacatcttcctcccaaagaacctgcttcccaaaaatgtttaagtcagaactgaagaaaataaaaagctaagaaaagtggaggaaataaactaagaagagaattttgattcttcgtcaataagtggttgatgtgaaagctgagaattttgattcttcgtcaataagtggttgatgtgaaagctgagaattttgattcttcgtcaataagtggttgatgtgaaagctgaggcctggcccatgcctgtctcatttaatggcagtggaacagaaactgaccacaacaaaaataccacaaggtcctaacagggaaagaagactttactgttagaacttcctggacggacctcccctgccactcccacactcttattccctcggtggctaaatttaagccatttatactttatactttaaaacactgaaggtaggcctggccttctgtgggtttaggtgggggcagatcagcaatggccaagggagaatgtcttctctgtggttattcttcacagtgagacaatgaagaccccataagctaaaagagcaactgcatctgaggaggtacaatggcagcccagttctgaagcttcttcttagtggccagtagggactcattctgacccaacagaaacctcttaggttctgtagtgactaaagccaacagcctgaggcacgctgctgtgtagtggagaaagggcaggcagcgagcaagtgtgtacaaggtatatacgtgccgcacgctgctgtgtagtggagaaagggcaggcagtgagcaagcgtgtacaaggtatatacgtgccgcacgctgctgtgtagtggagaaagggcaggcagtgagcaagcgtgtacaaggtatatacgtgccacatgctgctgtgtagtggagaaagggcaggcagcgagcaagtgtgtacaaggtatatacgtgccacatgctgctgtgtagtggagaaagggcaggcagtgagcaagcgtgtacaaggtatatacgtgccgcacgctgctgtgtagtggagaaagggcaggcagtgagcaagcgtgtacaaggtatatacgtgccacatgctgctgtgtagtggagaaagggcaggcagcgagcaagcgtgtgcagggtacatacgtgctgcacgctgctgtgtagtggagaaagggcaggcagccagtaagtgtgtgcagggtacatacgtgctgaacgtgtccatctctccagtcagattgattcgttcaatcagacttacatccactttttctttgagtttttcttctagctgttgaaaaacagaagaaatggatgcacggttaatgattatccaaagaagtaccatcacaataatagttaacatttactgcgtttgatgattcaggcataattccatacactttttttttttttttttttgagactcgctcttgttgcctaggctggagtgcagtggtgcgacctcggctcactgcatcctctgcctcctgggttcaagcaattctcctgcctcagcctcccgagtagctgggactacaggcgtgcgctaccacacccggctaattttatatttttagtagagatggggtttcaccatgttggtcaggccggtctcaaactcccaacctcaggtgacctgcctgccttggcctcccaaagtgctgagattacaagtgtgagccactgtgcctggccaatcttacaaccttatgaggaagattctattattatcatcgtcattttacagatcagaaaaatagagggggggcctacccaagatagaagtggtagggccaggaatcaaacttcctccagagcctgtgccctttagcactgtgcagtacttgtttcttaccacacatcaataattcacatcaactcattctgaaaagacgctgattttaagatactccctgccccatgaactacagacttgcccacccacaatggaaacctttggtgttgagtagcagtaaaaccagctaaaatagtcagtgaatgctactacgggccaagcacctcattaaggcattggggatacagtggtaaacaaaagaaatgtggtccctgccatcatcagccgacagccggggacagaaacactcaacacgctcctggcgctcaaagaaaaataacgggaccaagacttgtaaatacttggagatatccctgggagttgattaatctagcactgtaaacctattacacaaactctaagaatagctaatgttttggcctttttttttgagacggagtttcactcttgttgcccaggctggagtgcaatggtacgatcttggctcactgcaacctctgcctccagggtttaagtgattctcctgcctcagcctcccgagtagctgggactacaggcgtgcatcaccatgtccggctaatttcgtatttttagtagagacggggtttcaccatatcagccaggatggtcttgaactcctgacctcaggtgatccacccacctccgtgtcccaaagcactgagtagctgggactacagctgggattacaggtgtgagccaccgtgccaggacagaataaccaatgttttgtcttaaatttgaaaatgctgttggggtgcataaattagcataaactttttggaaggcaatttattcaaaaagcaaaactttaaatacacatattgcctaaaccagcaatttcacaactagaaatgcatttcaatgaaataaggagaataacatacaaagatatgcaagtattttttgcagcattcattaattcaaccaatatttaatgagagcccgctttgttcaggctgtgtaacagaataagagagttatttagtgaacaaaacagatcaatactgttctcataaagctggaaacaatctacatgtgtatttacaaaggataaaacaaattatggcacaggcttatcatgcttaaactcttcagcagcctcttcctatgacaccgaaaataaaatccaaattcctaaccatgaattgggtcctgcccagctttctggccccgtcttgccactttccaccttgcctgctaggcttcagttacactggccttttaaatttctgggagacaccagggtccttcgccctcaggaccttcatacttcacacttccttattcctctccctgaaacatggcctgctcagccctgctgacccactgccttgctttgccgcacccccactttctaagccctccaggctcctcactttttggccacatgttggccatgctggtctcaaactcctgacctcgtgatctacccgcctcagcctcccaaagtgctgggattacagacgtgagccaccacgcccggccctaatttttgtatttttagtagagacgggggttttactatgttggccaggctggtctcgaactcctgacctcaggtgatccacccacctcggcctcccaaagtgctgggattacaggcgtgagcccctgcactcggccagagtatcattctttatacctcctaatggaataatggatctgggctttgagcatcagaggctgctgacatcacacaaagagcaaccaaacattatgtatcttgatgacagacgtacaaaacatcattatgatgtagttttctgtaaaaaagaatctgaatcagctcaggcttctacatctaactaccaatttatgggaaatacgagacaaagtaaaatgtccattaatactcgtgggtgcaatcaggaaaatccaaaacttgggaaaatctacagggcaaacaacacagtttctttaagaaaagattgcagagggggcaaagggaaatggaagaagaaaccagagacttaataatctgagcaggctggacccagtggctcacccggtaatcccaactctttgggggctgaggcaagaagatcacttgagcccaggagctcaagaccagcctgagcaacacagtgagaccctatctctacaaaaaataaaaaaatactggccaggcatggtggcaggtgcctgaagtcccagtgtagtcccagccacttgggaggctgagggtaggatcgctttcgttccaggtttcagtgagctgtgatcaaaccaccgcactccagcctgggcaacagattgagaccccatattaaacaaaaagaatctgagcaacaaggaattggaaaataaaatttaaaagcaacaccaataatacatcattattggttcattaattgtaacaaatatttcatatcaatgttaataatatgggaaactgggtaagtggtatatgggaaccatacaaacgatctttgcaatttttctgtaaatgtaaaagtatccttaaaagtgtagtttatgttttttaaaaactatttacaatagcaattcataacatcgttctgtggtttgattgtgttctccaaagtttatgggttataagcttaatccctgaagccacagtgttgagaggtatgaggtcatgagggctctggcatcatcatgggttaatgccattatctcaggagtgggctcttttattccttcaagagatctttattaagcacttattacgtaccaggcattgtatttggtgctaatgaacagaggtgaacaaagtagactttctggcatgtaacttaaaactaatgggggcgccagataataaggaagtaagccagccgagacgtaacttcggttttgtggtgttaggaaataaatttggcagtgctggaataagggagctacctactgaaggggggtggccaggagggcctctctgctgaaggggggtggccaggaggggctctctgaggaggtgatactgaagcggggacctgaggcttggggaatgagactgccaagtgagaagccaccacacccggctaatttttgtattcttttagtagagacggggttttgccatgttgacgagactggtcttaaactcctgacctcaagtgatccaccctcctcagcctcccaaagtgctgggattataggcatgagccaccgcgcccccactcttctggaagctctgaggaaaaaactatttacacctctcttctagctttgggtgtttgctggcaatccttgatgttccttggctcatagaagtctgactccagcctctgcctccttctcacggccttcttccctgtatctctgtgtgttcaatctctctctcctttctaaggacaacagtcattagataaggccccccaccaatcctaaatccaggaccatctcatcttgagatacttaattacatttaccaagataaagtcacatttacatgtcccaaggcctaggacttggacatattttggggttggggggacacttcaacccactatatctccctgggtcctcttgagatgacactaatagtctttgatatttttcttgctttttgtgtaacatgatgttctgattcatcttgtagatttcctgcccttgacctggaattagtcatttctccaggaatctctggtttcttttagtggaaaattgtatttagagatcacaataaaggtgctaagaatgtattacttttgtaatcaataaaaacaattttcactaaataaaaaataattggccacttgtatcatcagtcatcaaaatggtcttcaacttatttctagaacttctaagagtctgttctagaaaactaatgcaaaacatttaagatgctatattcagaaagacattctttgtaaggattatctttttttttttttttttttttagagacagggtctcactctgtcacccaggctggagtgcagtggtgtgatcatagctcactgcagctttgacctcccaggctcaagcgatcctccaacctcagcttcccaagtagctgagaccacaggcatgtaccaccacactcaactaacttttaaattttttgtaaagaccaggtctcactatgttacccaggctggtcttggactattggcctcaagcgatccttccaccttggcttcccaatatgctaggattacaggcgtgagccactgtaccctgccaggattatctataaaagcaaaattttggctgggcatggtggctcacgcctataatcccagcactttggaaggccaaggtgagtggatcacgaggtcaggagattgagaccatcctggctaacacagtgaaaccccgtctctactaaaaatacaaaaaattagctgtgtgtggtagcgggtgcctgtagtcccagctactcacagtggctcacgtctgtaatcccagcactttgggaggccaagacgggcagatcacaagatcaggagatcgagactatcctggctaacacagtgaaacccggcctctactaaaaataaaaaaaaattagccaggcgtggtgatgggaacccgtagtcccagctactcgcgaggctgaggcaggagaatggcgagaacccggcagggggagcttgcagtgagccgagatcgtgccactgcactccagcctgggtgacagagagagactctgtttcaaaaaaaaagcaaaatttgaagcactataaacaacgatcagggatgcttgctaaataagttatggtacaaggccgggcacaggggctcacacctgtaatcccagcactttgggaggccaaggcaggtggatcacaaggtcaagagttggagatcagcctggccaagatggtgaaaccccatctctactaaaaaaaaaaaaaaaatacaaaaattagccggggatggtgatgggcatctataatcccagctactcaggaggctgaggcagaagaattgcttgaacctgggaggtggaggctgcaatgagccaagatcatggccactgcactccagcctggaagacagagcaagactctgtctcaaaataaataaataaataaataatttatggtatagtcccttaaagagaaatattatgtggccataaacaatgatagtaataatgaccctgtaatgatagttatgattattactatcattataatgacaggagaaatgctaatgctatgtatgacactaacaataaaaggatataacagtgaattaagattgtaacattcaaaactatgtctatgaataacaattgaaaaaataccccaaattgctaatatgattatttgaggatgatgggattaaaagggatctttatttttttaaatactacggttattttacctttaaaatagcatatttacatgtatcgtatttctttctgtgcacacccaaaatagttaaacagtgtttcttcatgaaagaactctggaacccctgccttggaggtccttacagatagtgccatcttacctggggagtggcctggggctaaacggactgctctgtggctccaaggccaaaccctggaaggtcatgaccttcgcaactcaacatgaccaggtccccaggcagagtgtgctgctgcctctgcctctggctggcttatgtgccactgaggggccttggtagacacacttcctatttgacctgctatattgctgccctggcacacaggagctccaagctgggctgtctgaactatcatttatgactgtcttcttgtggtctaggcatctgtaaattataaatacaaagtgggtagaagagcagaacctttccaaattactttctttctcttggcctcaggggaatcccagaccaagtgtgaaaaggacttctaattccatgtttaaggctgaatcaaaggttattctgggtcttccttctgctccatcagttgctgaactatggccatgtgggggcctccagcagaggcatcaccctttcctgtcccccagttcctaaacgtcagcatcccaaacaatggctatttgttgaggcagattgaaaatgccatgtaaatttcagaagacacataaaagcccaaaggattctgcttaacttagtaacacttctgagcatggaataactggctgtgactcatcatcaccaaaggctgggtcctagcacagacaagcttgttactgcttttctcatatgggttggagtgctactgacctacttttaacaggtcatgccctttgaggagcttacacaactccagggaggtgaccagtcatactttcttgcccagtcttcttttaacaaggcctttctgtaagacagctgcctgggcagccttatggctggacactgagctttcctctgtggcaggccaactggtctgacccaaggttgtctgtggccatgttaggacgtatattcttactcgccgagcgacgcagcccagagggttcaggaaaaggaggtggtgagtgggcagccaggatggctcacctgctgggtggtggccagacagtactctgccgtgctcaggatgttacagatgaggcagagctcctccagagtgaacttggctacttctgagccctccttttccttgaggaggctgctgatagtcagtcctccactgctggttgtggttctgaagaaaaggaacaggaacaagtcagcatggaatttctaatttgcttcctgaactggaaactacattattttaagatacagaaaagggggaagtaaaggctggacatggcccaaatcaattcacatacaatgagtccttttcctactgaccttaccttgacaccgtcagaaataggaagagatgattcctattttagttaatctgaatcatcagcaggccattagtcacattaactaggatggtctaatatccaaagggaaggctgctgagctgtcctctctttagcttggaatctcctgatgtgcagaactcatttaggaccgtgtggagcacgaaagatggttacctaccctgtttctttcagttaagaaaagtctgcactgggactcatgtgtgctggtggaggaggacataagcgcatgttaagagaagtctgcactggaactcatgtgtgtttgtggaggaggacataagtgaatgttaagaaaagtctgcactgggactcgtgtgtgctggtggaggaggatataagcgaatgttaagagaagtctgcaaggggactcatgtgtgcttgtggaggaggacataagcgaatgttaagacatgcttcctgcccaaggccctaagtgtctcaagaggccaacacccatcacacatcctcctgtgactacaggttttggggcagccccagctactgagtgagttctatggtagtaaccactacccactcatatctggatgctttggaatcctctgttggctcctttcaccttgcccccacttctgtgaacagtctctctactgacataatcccagctgagtatgccatttttttctgctgagatgctgactaatacacgtgggaaaatgctcccacgatgaagttaaacggtagctgcagggaataaagctataagcagtatagccccaattccgtgacacaaacaaacaaaagcacacagatcacacacattaggtatctatcaagaacggaaaaatatatacaaaaagttacgttctctttgggtagtgggattatacataatttatttatttatttatttattttttagggcggagtctccctgcaatgcccaggctggagtgcaatggcacaatctcggctcagcgcaacctccgcctcccgggttcaagtgattctcctgcctcagcctcccgagcagccgggactacaggcatgcaccaccacacccagctgatttttgtatttttagtagagatggggtttcaccatattagccaggctggtctcaaactcctgacctcaagtgatcctcctgcctcggctgcccccaatcctaccgcatcttcaaacattaggctatgtccagttctaatgcctcaggataacacaatagtccccataattaggagctatgcagtagctgacccccaatcctaccgcatctgaaacattaggctctgtccagcatggcaggaagtgtgcaccacaagagggacttggaacctactgggaatgaggaaaaagcagattcattcctccaacccatcactccggggcatcatctcaccaaaagaggcttgggtgaaactgcttaagctatttatcagttatttccaccacaacctcactttttttgtatgtgccaagtatctatagctgaatccatgaaaattaaataggcatacaatgggattggttctcgagtccaccgtggtaagatttgcccacgtgggcagtcagtgtggacatttcctctgatggtcttgatcagctgtggaatgtcagagaggaaatagcttcaggccctcgggaactcaggaagcgtgctttcctccttgatactcttggtggtttagtaaacaacttcagagtggatttccttaagattcccatatttaggtctatttgccaccactcagactatgaagaacaggactcacttgggcaggttgccagagaggattttccaggcgtattctcggaggtacttctggaaaatggtggtcagggcgatcatgggctccccagtactgagctgagagcattgcaccatgcacttcttgtagtagacaaagaggtcggcgcagctggggagcacggcacccccttcatcagtgttgggcttaggtggcccctgggctttgaaatcagccacaaaccgatctatcagctctccgaggttcctaggaggaaaaaaaaaaaccaaaaatgttattttacttcaagaaaagtaaagcaaatgtgctcgtttgcaatgtacataaactactgccacaagtaatcattcctactgcatttaaaacttaaaatcggatcgattttaatcaatatcatcattcactaccaccaccactcctacaacagcagtaataaaatctgacatatgagattctaatctctaagtcgattgacatttgtgctttatacttttcaaggcatttcattatcatattggactccaaacccctgtaagcaagatagggtattactggtcccgctaaaagatgagaaaattaagtcctagaaagtttctcacaaagtctgtggcagagctgagcctagactccaatactaaagtaagaaactaatccttctatcatattagtactgtttacccctccaaaaaggaaaaccctaaatcatgatagtgatcgttttctgaacacttgagatgcaccaggtattatgtccatgctttatacccatctcactgaacttcatttcctttttttttttttttttttttttttgagacagagtcttgctctgttggcccaggctggagtgcagcggcatgatcttggcccactgcaacctccatcttcagggttcaagcaattctcctgcgtcagcctcccatgtagctgggactacaggcacacgccaccatgcccagctaacttttattttcagtagagacagggtttcaccatgttgcccaggctggtctcgacatcctgacctcaggtgatccacccaccttggcctcccaaagtgctgggattacaggtgtgagccactcactgcgcccagctcatttactttttacaataaacttacatagtatgtattattactatcctcattttcaaagagttaagtacagaaaagttgagtaccttgtccagagtaatacagcaagaaaacaggagagccacgattaaaaactaagcagcctggctctaagcttcaagcctttaagcactctacttcctaaaaacaaaaaggttatgatgtcagcacatatttagacatcacgaacctaaatgtgcccaagagacagatgcctaaacaaagagaaactgtgaaatgtgttataatggtttctttctcctccgatttagttttttcttagaacttccagaatcaaaggtttaaaaaaatcttaggaaaagagagggtacgggcagagtgtggtggctcaagcctgtaatcccagcactgtgggaggccgaggcgggcagatcacttgaggacaggagttcgagaccagcctggccaacatggcaaaaccccgtctctactaaaaatacaaaaattagccgggtgtgggccgggtgcggtggctcatgcctgtaatcccaacactttgggaggcccaggcggcggatcacttgaggccaggagttcgagaccagcctggccaacatggcaaaaccccgtctctactaaaaatacaaaaattagcgtggtgtgggccaggcacagtggctcatgcctgtaatcccagcactttgggaggccaaggcaggcggatcacaaggtcaggagatcaagaccatcctaacacgttgaaaccccgtctctactaaaaatacaaaaaaaaaattagccgggcatgatggcgggtgcccgtagtcccagctacttcagaggctgaggcaggagaatggcatgaacccgggaggcggagcttgcagtgagctgagactgcaccactgccctccagcctgggcaacaaagtgagactctgtctcagaaaaaaaaaaaaaaaaaaaattagctgggggtggtggcgcatgcctgtaatcccagctacttggaaggctgagacctgaggcagagaatcacttgaactcaggaggcggaggttgctgtgagcccagctcacaccactgcattccagcctgggcaacagagcaagacttgatatctggaaaaaaaaaacaaaaaccaaaacagggtatgagcagctccagacttgcctcaggccacagtggggatgagagttgcaatttttctccgatttcccattcaaacatccctgtaattgttccgttgaattgtgtcatcacctgtgaggatccagcagagctgcagtaactgctgcctgcacagctgtgctgtgtgaagaatgggaagggttcccaccactcctgacatgttgcatctttttaggttgccgtttaaggctataggaatccagctgtgttttaaaaatgtatttatataatggtaaggaagaaaaagacaagaaccacacataccaccaattagcaggaataggagaaaattgacattttactcaaaggcttttgttattgaaagtctattataggcccaacgtgggggctcacacctgtaatcccagcactttgggaagccggggcgggtggatcacctgtggtcgggagtttgagaccagcctgaccaacatagagaaaccccgtcttcactaaaaacacaaaaaattagccaggcgtggtggcgggtgcctgtaatcccagctactcgggaggctgaggtaggagaatcacttgaacctgggaggcggaagttgcagtgagccgagatcgtaccattgcactacagcctgggcaacaagagcgaaaccccatctcaaaaaaaaaaaaaaaaaaaaaaagaaagaaaagaaaaagaaagtctattatatccagatacaaccactctgccctcaaagagcttctggcctaggctaagtctctgtctgtggtgatagtgagaaagcagggaaggatctcgttggttgacctcggaaagcttcatggccaccactcttgttcctcataacctctcttgcctcactttcccactgaatctcccacctctcctccacagctgacccaacactccagccagaggttcctcgcaacagctcccctgctggcctactcccggtcagtgggcctcgcaacggctcccctgctggcctactcccggtcactgggcctgtgtgacgtcctggccaaaacgctctcccaccacctgtccactcccctttcaagctcatccaggtctcacccgcagcagctgcaacttctgtcatctgccacccaccaacactttatttaacactttattagacagtgcgaggatgccatatattcaagaaataaccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccaggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaagaaagaaataacctatcttctcccatcctgggccacggtaggcaatgctaatcaacaaggagccctttcttcactgatctctcttgtgattccagaatccttcttgagacagcactccagccagtcacctctatcaactgaagttggtacaaaaggcgaaggaggtagaatcatctgtttcgtgcctgttaacacaagctccctgagaggaggaatgacgtttatgctggttctgctgcccccggcccgcccgtcatgccaatgagtggagtgaagcttcatgctagtgctcgatacatacttacctgatcaacctccacactttgttcctaggggatgggaatggagggtgggaaggtggaaacgggatggaggccggtgcagtggaggagaacatggaacagaaggcaaaagattcccctggggtcttcttatgagattctaatctctaaattgatagtgccaaccaaatcagggaccagagctctgacatgggtgttttttttgtttttttttgtttttgttttttgctttttttggagacggagtctcactcagttgtccaggctggagtgcagtggtttgatctcagctcactgcaacctctgcctcccgggttcaagtgattctactgcctcagcttcctgagtagctgggactaccggcacacaccaccacaaccggctaatttttgcttttttttttagtagagatggggtttcaccatcttggccaggctggtcttgaactcctgacctagtgatcgcccgcctcagcctcccaaagtgctgggattacaggcgtgagccactgcgcccagccgactctgatgtgcttccaggcgtgagccaacgcgccagccaactctgatgtgattctattttcatcactcacctgttcccctagaagatggatacttacttacttgcttcctatttcagagccaccccaatgagtaagattataaactaattatgatcatacagcataaagaaaatgttcacttcaaaaagctctaaagatctatactttgtagaatgtctacaggatgtctactcggttacttctgacattgttctttcaagtggatgagaaataaaccagttggggaaaccttcccctgccttccatctttcaccctgcatcagcatgctttgatgccacatgagacattagaaaatcagtagccagtatttcacagaacagaagaatgtaagttaccccaatgggaatgcgtaaggctcattagttttgaatacatgatccaatctgatcacatttcttttttttttttttgagacagagtattgctttgtcacccaggacaaagtgcagtggcatgatcatggctcactgcagcctcaacctcccaggctcaagcaattctcctgcctcagcctcccaagtagctgggactacaggcgtccatcaccatgcatggctaggaggaggccaggagtttgagaatagtgtgggcaacaaagtaagatccctatctctaaaaaaaaataaacaaattagttaggcatggtggtgtgtgcttgtagttacagttacttgggaggctgagggaggacgatcatttgagcccaggagtttgaggttacagtgagctataatgccaccactgcactccagcctggacaacagagcaagacattgtcgaaggggaggggaggggaggggaggggaagggagaaggaaggaaatacctccttcccgaaatactgctgggagttccactgataaattacatgccctaggaatgaagacagttgcagagtggtatcagtagagggaaaaactaaagtgaggagaaaaaatatgccattgcagactgggtttatccatggatggccaaggccatttctctggtgggcctgcagtcagcattcacagaaacaatattctaattggaatgtcaagcagtgaggcacagggagagaaagacagtagccagaagatggcaacgcaggtgagcaaggtcaaggcagctgaagatccccattaagttagataacttatttatttatttttttatttttttgagacagggtcacccaggctggagtgcagtggcatgaccacagcttactgcaacttctgcctcccaggctccagcaatcctcccaccccagcctcctgagtagctgggactacaggtgcacaccaccacacctggttaatttttgtgggcttttttttgtagagacagggttttgtcatgtcacccaggctggtctcgaactcctgagctcaagccatccacctgcctcagcctcccagggtgctgggattacaggcacgagcaaccatgcccgaccctagagcttcttaattcaagggtactcccactaatttgcatcccttcctcttcctttttgctggggctgaggatgttgctctggtgtggccagtggggctggggagccaaggtgtggcttgagcacagctgggagatgggttacatacaggcaaactgagcaaataggtaaatatactgagcatgctaggacccaaatttctcactgttgtagaaggcagttgccaacgttgaatgggagaggctaaaataaaccctgtggtgtgagattagaattgaaggcatcagcatcaaatgcacaggttctaatatagaagcaggtgcacacacagctatagaggcatatatgtagaagcaggtgcacacacagctatagagacatatacacgtatgtttatacacacatacatttcttagctctctcagccaaggcaatctggaagcaatgacaccgagcagcaatgagcatacttggtttctaaatgtcatcctccaccaaaggaacaagaaatgcctggggaaatggacgactccagggctgggatacaaaagtacaggataagcctagtatattttattgtgccagagaggaaggaggtgctcaaaaaatgatagtggcatgtaaaaaggatgaagagccagctttaagaggctcccactggccaagtcagggacaatttgagtactaaaataacaacgacaaatcctggaaggaaaaacagacactaatggaaaaactggtgaagttcaaacacggtgtgcaggttattaaatagtaatgtaccaatgttaacttgccagttttgacaactctgctgtggttatataagatgtcaacatcaggggaagttgggtgaaggggaacataagaaatctgtactatttgtgaaattttcctataggtatacatttattccaaaatacagtaaaaataaaagagatagtgatgcctacaacctactgaataaaatataaaaatccatgagtccatgctgacatagacataagggggagaagtgacagcttttcttaaagtagaatgccaactgataaacgcagaagaaatgatgtagctagaaaaatcaccatttgactgggcgcggcagctcatgcctgtaatctcaacatctagggaggccgaggtgggcagatcacttgaggtcaggagttccaaaccagcctggccaacatggtgaaaccccgtctctactaaaaatacaaaaaaattagctgggcatggtggcgagcatctataatcccagctacttgggaggctgaggcaggagaatcacttgaacccaggagccgagattatgtcactgcactccagcctgggcgacagagcaagactctgcctcaaaaaaaaaaaaaagaagaaaaatcatcattgtcaatcatcttagtaataaattacatgataagtgaaagatgaggaaaaggatattgataaagtttcaaggtttctcccaacacttattaataaatagagatacccagtagagacaacatctacaccaagtaataaaaacgaacatcataggctggccgtggtagctcacgcctgtaatctcagcactttgggaggccaaggcgggtggatcacctgaagtcaggagttcaagaccatcctgaccaacatggcaaaaccctgtctctactaaaaaaaagacaaaaattagctgggtgcagtggcgggtacctgtaatcccagctactcaggaggctgaggcaggagaattgcttgagcccaggaggtggaggttgcagtgagtggagatcgcaccactgcactccagcctggggaatagagtgaaacgactctgtctcaaaaaaaaaaaaaaaaaaaaaaagaacatcacatcacaagttttgggataaactggcattctgtgcctcctgatatgaattcctaggaacacaggaccacttctgcataaatcataaataatgaggaaacatcagacaaacccaaactgagggaaattccagaaagtaattggccaatcctcttcaaaaatgtcaaggtcatgaaagacaaagaaagactcaattagtcttctgggttgaaggagaccaaagagacatgacaactaaatgcaacctgtgatcctagagctatttaaacaaacaaacaacctgcgatctgagagctattcaaacaaataaactaacaacctgtgatcctagggctattcaaacaggccaacaaacaagcagattgggacaactgctgaaatgtgaggaggagagcatggatgaagcagtaatactgtatcactgtgaattccctgatgttgatagctgtactgtggttatgtgaggggtctgggattaagcagtaatgttgtatcaacgttaatttcctgatgtggacagttgtactgtggttatgtagaaaccttgtttctaagaaatatatattgaagtattaaggagtagtggcgaatcttgtctgcaacttgagaattcaaaggttcaggaaaaaagtacaggttgggcacagtggttcacgtctgtaatctcaacactttgggaggccagcagatcacttgagcccaggagtttgagaccagcccgagcaacatggtgagaccctgtctctacaaaaaaacaaaaattagactgatgtgatggcctgtgcctgtagtctcagttactctagaggctgaagtaggaggaggggaagggagaggaagggaggggaggggtggggaggggagggagaagagaaagggaaagagagaaaaagaaaaagaaggaagagaaaaaagaaaaggaaaatgcatgcagtgtctgtgcattacgtgtgtgggggagataactattaatgaggaatctggatgaaggctatacaagggctctttgtataattcttataattcttctgtaagcttgaaattaattcaaaataaacaacaatgggctctccctctccctctccttctccctctccctctccctacagtctccctctccctctccctacggtctccctctccccacggtctccctctccctctctttccacggtctccctctgatgccgagccgaagctggactgtgctgctgccatcttggctcactgcaacctccctgcctgattctcctgcctcagcctgccgagtgcctgcgattgcaggcgcgcgctgccatgcctgactggttttcgtatttttttggtggagacggggtttcgctgtgttggccgggctggtctccagctcctaaccgcgagtgatccgccagcctcggcctcccgaggtgccgggattgcagacggtgtctggttcactcagtgctcaatggtgcccaggctggagtgcaggggcgtgatctcggctcgctacaacctccacctcccagccgcctgccttggcctcccaaagtgcccagagtgcagcctctgcccggccgccaccccgtctaggaagtgaggagcgtctctgcctggccgcccatcgtctgggatgtgaggagcccctctgcctggctgcccagtccggaaagtgaggagcgtctctgcccggcccccatcccatctaggaagtgaggagcgcctcttcccggccgccatcccatctaggaagtgaggagcgtctctgcccggccgcccatcgtctgagatgtggggagcgcctttgccccgccgccccgtctgggatgtgaggagcgcctctgcccggccgcgaccccgtctgggaggtgaggagcgtctctgcccagccgccccatctgagaagggaggagaccctctgcccggcaaccgccccgtctgagaagtgaggagcccctccgcccggcagccgccccgtctgagaagtgaggagcgtctccgccgggcagccaccccgtccgggagggaggtgggggggtcagccccccgcccggccagccgccccatccgggaggtgaggggcgcctctgcccggccgcccctactgggaagtgaggagcccctctgcccagcgcgtctgggacgtgtgcccaagagcttattgagaacgggccatgatgacaatggcggttttgtggaatagaaaggcgggaaaggtggggaaaagattgagaaatcggatggttgccgtgtctgtgtggaaagaagtagacatgggaaacttttcattttgttctgtaccaagaaaaattcttctgccttgggatcctgttgatctgtgaccttacccccaaccctgtgctctctgaagcatgtgctgtgaccactcagggttaaatggattaagggcagtgcaagatgtgctttgttaaacagatgcttgaaggcagcatgctcgttaagagtcatcaccactccctaatctcaagtacccagggacacaaacactgcggaaggcctcagggtcctctgcctaggaaaaccagagacctttgttcacttgtttatctgctgaccttccctccactattgtcctatgaccctgccaaatccccctctgtgagaaacacccaagaatgatcaataaaaataaaaataaaaataaaataaaataatcaacaatggtaattagtttacagacagatgctaggctctagaaaagcatgagttctagtctaacaaaagttattagagggaactcaggagaatgggcagatatggagtcaccagtaacttccctgatggagaacgccatagaatggggtaaagaaagtgcctatgtagaaatttcttttgcaagagtcagccagaggaaatcactaaatgccaagggtagaagacagactaacctcctctttgaacataaataaaaattgagaaagccatttaaaggatgtaaggacggcttagcccaacctgctagtggccatccccacttcctgcctcctccctgagtactggctctgcagtcctcctactgctacttggcttttggctggggcagatgctgccggaactttcccttggcaggtgggaggctggggagatgagaaggtggaccccatgccaggctcaagagaaatctggccacactgacaaggccacccacccacataggagtcctgaaaaagatgagagggatggcagggcaggcactgttcctgagcaccatttactgtgtgctgaaggtgaaaatgccacctcttctcctcctcgccacaaagtccatgaggtcggccttatgatcctcacagtgtagaggggctagctaggagcatgctcaaggtcccagcctagcaagcgcgaagcctcacatctaggtatgtctgggatcaggcccacgctctttccaccacactgtgttgcgtctctgtcatctgggaagttatgaatggtctcatgctttctgagttagagctacagcaaaagtagtaatgtgcacaaaaccagtccccacctgagttccttctccagcctcaggattctttgaagggaagaagcagttcctagaactccttgaaattacactcaaaatagtgtgtgcatgatatggatttttttgacaagagcgtcgatgctttccattgggttcttaaaaaggatctatgactttaaaatggttaataacgagtgcgttgggcattattttgtctgactatctctcttgacagataaggaaatggagttctttgaactctattttctactttgagttacagtgtttattctgcaggaacagcagcacagcctgcgcagtatctgctccttccttagtgctgcggaaacttcctagtgaggccaaacagcagggtaagtggccagcacttcatttttcacaggaaaatggagagtccccaaggaagggaggcctggctccttgcccaaagtatcatgaacaatgagtatactttgtataaatcaaggccatgtgaaaagagtggatgccagaattacaataactcagaaaaatgaccctttaaaccaggtaggttttgggaaaggatgtggctacctcagacatgtgctttaaaccctgggccttggctgggcgcggtggctcatgcctgtaatcccagcactttgggaggtggaggtgggctgacctcttaagcccaggagttcgagaccagcctgggcaacatggcaaaactgcgtctctacaaaaaatacaaaaattagccaggtgtggtggtgtgtgcctgtagtctcagctacttgagaggctgagtaggaaagactgctgaaacccaggaggttgaggctacagtgagtcctgatcacgcctctgtactccatcttagctgacactgagaccccgtctcaaaaataaataaataaaaataaaccctggacccagtaacttttaagccttttaaaacgaaaaatttgggttaagagaagatggggctttggctgaaaagagtcatccaggggggttcctcaaagacctgtgactctaataggcaaataaccaatcctttttcctgcccctcaggggtgtcttagtaacttcctggaggcaaactgtgaatgtagaagacagggtgctctcaaggacaaagaggcagaagtccccactgtacctcggtgtgcctgctgggcacgtgcccactgggcaagagcaagggcactactgggtctttgcaaggcaaatgacggcaaggcaacttgcctttggtggtgggctgatggggagacttccatttgatgatggagaagctactgggcaagttcattttctgagattttaatatgaagtactttgtaatcgggcatgaaaagcatagaagcagtccataaaatcacgtgagtgaataatacagttccatgtgaagtttctaattgaaacattgtcttactgttacggtttaagaaacatgtttgaaactaagaatgtgctcacccatgatagaagcattaaaaacaaggggaggggtgaagtgcaatcagacctaaatgcgtaaatgcaaccccagagagcctccctaaaaacctaatacgttcccagagaacttccctcagaacctaacgcgttcccagagaacttccctcagaacctcaatgcgttcccagagaatgtccctcagaacctaatgtgttcccagagaatctccctcagaacctaatgcgttcccagagaaccttcctcagaacctcaatgcattcccagagaacttccctcagaacctaatgcattcccagagaaattccctcaggatctaatgtgttccagggaacctccctcagaacctcaatgcgttcccagagaacctcccccagaatctaatgctttcccagagaacctccctcaggacctagtgcgtcccagagaccttccctcagaacctaatgcggtcccagaagacttccctcaggacctaatgcgttcctagaaaactctcagaacctaatgcgttcccagagaacttccctcagaacctaatgcattcgcagcgaacctccctgagaccctaatgcgttcccagagaaattcccttaggacctaaatgtgttcccagagaacttcactcagaacctaatgcattcgcagagaacctccctcagaacctaatgcgttcccagaaaacctccctcacaacctaacgcgttctcagagaacttcactcaggaccaaatgagttccgaaaaaccaccccagaacctcaatgtgttcccagagaacctccctcagaacctaatgagtttccaaagaacctccctcagaacctaatgtgttcacagagaacctccctcaaacctaaatggttcccagagaacctctctcagaacctaatgtgttcccagacaatctgcctcataacctaatgcgttctcagataacttccctgagaacctcaatgcattcccaaagaacttccctcagaacctaacgctttcccagacaacctccctcaggacctaatgcattcccagagaatctccctcagaacctaatgcattgccagagaacctccctcagaacctcaatgcattcccagaaaacatacctcagaacctaatgcattcccagagaatctccctcagcacctaatgtgttcccagagaacctccctcaggagctaatgcattcccacagaacctcctccagcacctaatgcgttcccagagaacctcccacagacctcaatgcattcccagagaacttcccacagaacctaatgtggtcccaaagatcctccctcagaatctaatgcgttcccagaaaaatttcttcagaacctaatgcattcccagagaacctccctcaggacctccatgcgttcccacagaacctccctcagaacccaatacgtgcccagagaacctccctcagaacctcagtgcatttccagagaacctccctcagaacccaatatgtgcccagagaacctccctcagaacctcagtgcattcccagagaacctccctcagaacctaaagcgttcacagagaacctccctcagaacctaatgcgttcccagaaaacctccctcagaacctcaatgctttcctagagaacctccctcagaacctcaatgacttagcagagaacctccctcaggacctcaatgcattcccagaaacctcgctcaggatctagtgcgttcccagagaacctctcagagaacctaaagcattcccagagaacctccctcagaacctaatgtgttcccaaagaacttccctcagacctaatgctttcccagaaaacctccttcagaacctaatgcatttccagagaacttccctcaggacgtcaatgcgttcccagagaacctccctcagaacctaatctttcccagagaacctctgtcagaactcagtgagttcccagagaacctccctcagaaccacaatgcattcctagagaatctcccacagaacctcaatgagttaccacagaacctccctcaggacctcaatgcgttcccagagaacatccctccaaacctaatgcgttaccacagagcctccctcagaacctaatgcgttcccagagaacccccaacagaatctcagtgcattaccagaaaacctccgtcaggacctaatgcggtcccagagaacatccctcagaacctaatgcgttcccagagatcctccctcagaatctaatacgttcgcagagaaactccctcagaacctaatgcattcccaaagaacttcctttaggacctcaatgcgttcccagagaatctccctcacaaagtaatgcatttcgaggcaacctccctcagaacctcagtgcattaccagagaaccttcctaagcacgtaattcattcccagagaacttcccccagaacctaatgcgttcccagagatcctccctcagaatttaatgcgttcccagagaaattccctcagaacctaatgcattcccagagaacctccctcagaatctcagtgcattaccagagaaccaccctcaggacctaatgtggtcccagagaacatccctcagaacctaatgcgttcccaaagatcctccctcaggacctaatgcgttcccaaagatcctccttcagaatctaacacactcacagagaaattccctcagaacataatgcgttcccaaagaacttcccttaggacctcaatgcgttttcagagaacctccctcagaacctaatgcgttcccaggcaacctccctcagaacctcactgcattaccagaaaaccttcctaagcaggtaattctttcccagagaaattccctcagaacctaatgcgttcccaaagaatctccctcagaatctaatgcattcctagagaacatccctcagaacctgatgcgttcccagagatcctccctcagaatttaatgcgttcccagagaaattctctcagaacctaatgcgttcccagagatgctccctcagaatttaatgcgttcccagagaaattctctcagaacctaatgcgttcctagagaacctccctcagaacctcagtgcgtttccagagaagctccctcagaacgtaatgcattcccagacaacttccctcagaacctaattccttcccagagaacctctctcagaacctaatgcattcctagagaacttccctcagaacctaatgcgttcccagagatcctccctcagaatttaatgcgttcccagagaaattccctcagaacctcagtgcgttcccagagaacctccctcagaacctcagtgcgtttccagagaagctccctcagaagccaatgcattcccagacaacttccctgagaacctaattccttcccagagaacctccctcagaacctcagtcaattaccagagaacctccctcagaacctaatgcgatcccagagaacatccctcagaacctaatgcgttcctagagaacccccaacagaatctcagtgcattaccagaaaacctcccgcaggacctaatgcggtcccagagaacatccctcagaacctaatgcgttcccagagaacctccctcagaatggaatgcgtttgtagagaacttccttcagaacctaaggcgttcccaaagatcctccctcagaacctaatgcgttcccagagaacccccaacagaatctcagtgggttaccagaaaacctccctcaggacctaatgcggtcccagagaacctccctcagaacctcagtgcattaccagagaaccttcctcaggacctaatgcggtcccagagaacatccctcagaacctaatgcgttcccagagaacctccctcagaacctaatgcgttcccagagaatctccctcagaacctaatgcgttcccagagaacctccctcagaacctaatgcgttcccagagaacctccctcagaacctaatgtattcctagagaacttccctcagaacctaatgcgttcccagagatcctccctcagaatttaatgcgttcccagagaaattccctcagaacctaatgccttcccagagaacctccctcagaatctcagtgcattaccggagaaccaccctcaggacctaatgtggtcccagagaacatccctcagaacctaatgcgttcccacagaacttccctcagaacctcagtgcgtttccagagaacctccctcacaatctcagtgcattcccagagaacttccctcaggacctcaatgtgttctcagagatcctccctcatgacctaatgtgttcccagagaacctccctcagaacctaatgcattccgagagaacttccctcagaacctaattccttcccagagaacctccctcagaacctcagtgcattaccagagaaccaccctcaggacctaatgcgttctcagagaacctccctcagaacctaattccttcccagagaacctccgtcagaacctgagtgcattaacagagaaccaccctcaggacctaatgcgttcccagggaacctccctcataacctaattccttgccagagaacctccctcagaacctcagtgcattaccagagaaccaccgtcaggacctaatgtggtcccagagaacatccctcagaatctaatgcattcccagagaacccccaacagaatctcagtgggttaccagaaaacctccctcaggacctaatgcggtcccagagaacctccctcagaacctcagtgcattaccagaaaacctccctcaggacctaatgcggtcccagagaacatccctcagaacctaatgcgttcccagagaacctccctcagaacctaatgtgttcccagagaacctccctcagaacctaattccttcccagagaagctccctcaaaacctaatgcattcccagacaacttccctcagaaactaatgcgttcccagagatcctccctcagaatttaatgcgttcccagagaaattccctcagaacctaatgcgttcccagagaacctccctcagaacctcagtgcgtttccagagaacctccctcacaatctcagtgaattcccagagaacttccctcaggacctcaatctgttcccagagatcctccctcaggacctaaggtgttcccagagatcctccctcagaacctaatgcgttcccagagaacctccctcagaacctaatgcattcccagagaacttccctcagaacctaattccttcccagagaacctccctcagaacctcagtgcattgccagagaacctccctcaggacctaatgtgttcccagggaacctccctcagaacctaatgtgttcccagagaacctccctcaggacagaatgcgttcctagagaacttccctcagaacctaatgcgttcccagagatcctccctcagaatctaatgcgttcgcagagaaattccctcagaacctgatgcattaccagagaacttcccttaggacctcaatgcgttcccagagaacctccctcagaacctaatgcattccaagagaacctccctcagaacctaatgcattccaagagaacctccctcagaacctcaacgcattcgcagagatcaagacctctacgcgttcccagagaccctccctcaagacctaatgggtacccagagaacctcccacagaacctaatgcgttcccagataacctccctcagaacttaatgcattcccagagaccttccctcacaacctaatgcgttcccacaggacttcactcaagacctaatgtgttcccagagaacttccctcaggacctaatgcattcccagagaacctccctcaggacctaatgcgtttccagagaacctcccttaaaagctagtgcgttcgcagagaacctccctcagaacctaatgcattcccacagatcttcactcaggacctgatgcgttcccagagaacttccctcaggatctcaattcgtttccagagaacctccctcaggacctcaatgcgttcccagagaacccctctcagaacctaatgggttcccagagaacttccctaagaacctaattcgttcccagagaacctccctgagaaccctgaggtcacagaggaccttcctcagaacctaatgcattcccagagaacttccctcaaaacctaatgcattccctgagaatctccctcagaacataatgcgttcccaaagaagctcccacacaacctactgcgttcccagagaacctccctcagaacctgaatgcattcccagagaacttccctcagaacctaaggcattcccagagaacttccctcagaacctaatgcgttcccagagaacctccctaaggacgtaatgcattcacagaggacttccctcagaacctaatgcatccccggaaaaccttcctcagaacctaatgcgttcctagagaactttcctcagaacttaaatgcgttcccagagatcctccctcagaatctaatgcgttcccacagaaattccctcagaacctactgcgttcccagagaacttcccttaggacctcaatgcgttcccagagaacctccctcagaacctcagtacattcgcagacaacctcccttggaacctcagtgcattcccagataacctccctgaggacctcaatgtgttcccagagaccctccctcagaacctaatgtgttcccagagaacctccttcagaacctaatgcgttcccagagaacctccctcagaatctaatgcattcccagagaacctccctcagaacctcagtgcaatcccagagaacctgccttcaaacctaatgcgttcccagaaaacatccctcaggaactaatgagttccaggagaacttccctcagaacctaatgtgttcccagagaacctccctcagaacctaatgcatcccagagaacatcactcagaacctaatgtgttcccagagaacctccctcagaacctcagtgcattctgagaacctccctcaaaacctcagtgtgttcccagagaacctccctgaggacctaatgcattcccagagaacctccctcagaacccaatgtgtccccagagaacctccctcacaacccagtgcgttcccagagaacctccctcaggacctcaatgcgttcccacagaacttccctcatcatctaatgcattcccaaagaacctccctcagaacctagtgcattcccagagaacatcactcaggacccaatgtgttcccagagaacctccacagaagctcaatgcgttcccagagaacctccttcagacgctaatgtgttcccagggaacttccctcagaacctcaacgcagtcccagagaaactccctcagaccctaacgtgttcccagagaacctcccttagaacccaatgcgttcccagagaacctccctcagaacctaatgcgttccgagataacctccctcagaatctcaatgcgttcccagagaacttctcttagaacctaatgcgtttccagagaacctccctcagaatctccatgcattctcagaggacttccctcagaacctaatgtgttcccagagaacttccctcaggacctaatgcgttcccagagaacttccctcaggacctaatgcgttcccagagaacctccctcaggacctaatgtgtttccagagaacctcccttagaacctaatgcgttcctagagaacttccctcagaatctaaagtgttcccagagaacctccctcagaacctcagtgcattagcagagaacctccctcagaacctaatgcgttcccacagaacttccctcacaacctaatgcgttcccaaagaacttccctcaggacctcaatgcgttcccagagaatctccctcagaacctaatgcgttcccaaagaacttccctcagaacctaatatgttcccagagaacctccctcagaacctcagtgagttcccagagaacctccttcggaacctcagtgcattcccagagaacctccctcagaacctcagtgtgttcccagagaacctccctgaggacataatgcattcccacagaacctccctcagaacctcaatgcgttcccagagaccttccctcacgacctaatgcgttcccagagaacttcccccaggacctaatgcattcccagagacctctctcagaacctcaatgcgttcccagagaaccttcctcaggacctaatgcgttcccagagaacctccctcagaacttcaatacattcccagagaactttcctcagaacctaatgcgttcccagggaacttccatcagaacctaatgcattcccagataacctccctcagaacctgaatgcgttcccaaagaacctccctcagaacctaatgtgttcccggagaacctcactcaggacctcaatgcgttcccagagaactcccttctgaaccaaatgcgttcccagagaatctccctcagaacctaatgggttcccatagaacctccctcagaatctaatgtgttcccagagaacttccctcaggacctcaatgcattcccagagaacctccttcagaacctcaatgcgttcccagagaacttccctcagaacctcaatgcgttcccagagaacctccatcaggacctcatgcgttcccagggaacctccctcagaacctcaatgcattcccagagaacttccctcagtacctaatgcgttcccagggaacctccctcaggacctaatatgttcccagataacttccctcagtacctaatgcattccccaagaagctccctcagaacccaatgtgtttccagagatcttccctcagaacctcagtgtgttcctgaagaacttccctcaggactttcctgcagccgctgttgctctccccatgggagccaccttctggtcccttccgagtgcgttctttagactgtgaggcttcctctgggagcccaggccagtctgtctccagtcatctcgttacaatcatcttgacctttccaaaacctgccttccaacgtggaagggcttggctgcggacaaggacgcagggatgaggaggagtcttcctccttttctaatgccccctcacgcacacaacggacactggagcacgaacacagtcttcggctgttagtttggaagtctttgggatttttttaaaaacagggtgggagggaagaaacctggccgcagtgagatgctttataaaaatatttggaggctacaagtttgtgaaaagcatatagtatattttgtttgcttttcttttctttttttcttttgagacgaagtctctgtcaccaagctgggtggcatagtgacggctaattgcagcctctgcctcctgggctccagtgattttcccacctcagcctctcgagtagctgggactacaggtgtgcatcaccacacctgactagtttttttaaaaaaattatttataaagatgaggtttcagcatgttgcccaggctggtcttgaatcctgggctcaagagctcctcctaccttggcctcccaaagtgctgggattacaggtgtgacccactgtacctggccacgtgaaaagcatatactgtattatatagatgatccataaaataaaatcagaatccatgagttcatactgatatataaacaaataggggagagggaaaattcttccatatagtagaactccaattagtaaatgtagaagaaatgatgaaaatagacaatcgacatttggcaaatgccacagaaacaacgcttccgtcaggaatcaatcaagggatgcgaaatgagtgggcaaaagtttgatgagagcaggatatttacaaagtatcatcccataagatacttattaattaccaggagaaaaatagtaacttcacattgaagacagttggcaggtaccacctaaagcaagtaatcgaagtccccaataatgggacaaatcaatgtgatgtgcctcttgacacaatgcactggggatacaatgccacttttatggtgttcttgcccaaaattgatttcatcaagaaaaaacaaacaaaaactgaggacattgtacaaaatacctggccagtacacactgaggtcgtgaaagacaaagaaaacttgaggaatggctgggcaaggtggctcatgcctgtaattccagcactttgggaggctcaagtgggtggatcatttgagcccaggagttccagaccagcctgggcaacacagggagacagaatctctactaaaaatagagggtggcatgtgcctgtggtcccagctacttgggagactgcagtgggaggattgcttgagcccaggagatggaggatgcagtaagtcataatctcaccactgcaccccagcctgggggacagcgtgagactctgtctcaaaaaaggaggggaggggagggaataaaaagatgaggaactactcaagattaaaggagaccaagatcaaagagatctgacaacgaaatgcatgattattgggtcctggaccagaaaaaggggcattaatgggacagtattaccttctcgattttggtaactctggttgttatgtaagatgttaacattctctgaggagggcatgtgaaaattttttgtcctatttttgtaacttttttataagtctaaattatttcaaaataaaaggataaattatacttgaaaacatatatattagagactaggctttcttccaatacccagtgcctgacactgtaaagctttgtgggctgatatatgtcagggctcaacacccacataggaagggatcccaatgtagggatccactggggaccttattaggggcaaactcaggctctgagatttatagacacaattaatgataacattcaaaagatgtaaaaatacccctaatgggtttctagggagggtcacaggcatgccacaaccatctttcagccccggaaggagctgtgcgctcctaagacccagtcatgaccagagcggcgagaaatgcaggcagaaaacagcgaatgttcctcactcacttgtcttgggattcgatatacacgtagagatgaggctcaaaacacttggaaacaatgccatgaaatggattgtctggggctttaggcttctttggctgtaaaaacaaagaaaaataaaccccatacttgagtgatctttgcaaatgttcaagaatttttttaaaaacatcatttcaaagttcattcctaagtcacagataagagagtactcaatgtaacccaatacgatggtttcaccattcaccctggcaggtgaagaaaaaccagctttgttagcataactcacttgctctggacgatgaaagacatactgctacctggataacatatgtgttttgaatctggaagcaagtcatcatctatctgactggtgttttccagaatttaaatcccagctaataatagcaccttgtatttacacagtgctttagaatttaaaaagtgctttcacacaatccaatttttgatagcactttgataccaactaatatgtcacctgctcctcacaataatccttcatgtaggtatgactactactattttacacctcaagaaatgaggactcagaggttctctaacctgccccaacacatatgtagacgtctgcttttcttaaactagaactctttctgttataccattattttcctgcaatggttcccagaattttttgaattccatcagtaagaaaatgtaagaaaaagaagaatggacaaccaatagaggattgttaactttattttgctactttctattcttaccacgagttcctaaaaaaaaaacaaataaagggtttttttgtttgctttttgagacagagtctccctctgtcacccaggctaaagtgcagtggcgccatctcagctcactgcaacctgcaccttctggactcaagtgattcttgtgtctcagcctcctaagtagctgggactataggcacacgccaccacaccgagctaatttttgtattttaagtagaggtggggttttgccatgttggccaggctagtctcgaactcttggcctcaagtgatccacccacctctacctcccaaagtgctgggcttataggcatgaggcatggcgcccagccagaaaattgtattttatacccccaaattttataagaataaaatagcagcatataggcagtactttctaagaaaggacagttggtaaccttacatcagatagatagagagagagacaggcaggcaggcaggcagactatattgtctttattttttgctttaggccactgcaacactagatgagcgctggttcccaggctgttacttggaagccactgataaagaagtcatatgacaggcaagtattttaaaacaatatttgccacttaattcctttccaaacatctaaaaaataagcaaagattttcctatgtattacttctattcctaacaaatgtgaattctgtctattgccaaatgtctacaaaatgaccctgagccaaacacaccatgctggggttgatactaaatcataatttgcatgtaaattggcacccacaacatacttgttaaattgaactactcatatcttattttttaaaaacccactttattgaggtatgattgacattttaaaagccctacataattaatgtatacatcttgatgcgtttgaggataagtacacacccacaaagccctcaccaccatcaaggcagtaagtgtatccaccacctccccaagcctcctcccacccctgttgttacgattattattacttgtggtaagaatgcttgctgggcacggtggctcacgcctgtaatcccagcactttgggaggccaaggtgggcggatcacaaggtcaggagttcaagaccagcatggccaatatggtgaaaccctgtctctactaaaaaaatacaaaaattagcaggttgtggtggtgtgcgcctgtagtcccagctacttgagaggctgaggtagaaaaattgcttgaacccaggaggtggagatggcagtgagccgagattgcaccactgtactccagcctggcgacagagtgagactccatttcaaaaacaaacaaacaaacaaacaaaaaagaatacttaacataagatctaccctcttgaactgcttatatattttaataaatactggaagagataagccctaatgacagaaatgataactacctatttctggcctttaaaaaaatttttttttaaataacacgttgcaatggttaaaaacatctgtaaaaactgatttgtaaaaaatgatcactaaaaattaaatgtcaactttagacacatctactcaatcttgtacttaaccctcttccctttttacctttcaggagttccatgtctttcattttttggcaaggtttctagaaactttggtccttcctaagaataaatacaatctgcactgtttttactcttatcatctggaagtcactgccaaagccaggccttggactgagcccacaaccacacaagcctggctgattgagcttgaatctgccggatctagaattccacttgagtgcacagatgtcctgggagtttttctgcatttccattagtttaagatgaaggatctatgatggaggatgaggattgtgaggggtgtcctcacccacttgtcctgtttattccaagtcagtatcttttattattgattcaataagatgacttaagtgaatagaaaaatgtgatttaatttgtctaactctataggactagatatcatggattcagatttggaaaacatggctactacaaacagatatctttttattaattaaataataatgataagtattatagctattctttttatttaatttttttcttcttttgaagaaaatattcacactctgcaggataacttctggtaattatacatgtgaatttacataatacagaatgttaacatttaaaaaaatcaacgtgtatattttgctttttttttaaattttgaacatgtatattttgtattcagctttactgacttactaatttatgtgtactttcccaactactgacaatattttatcactttaaaatggctacattatgaaaatctttaaaagcctatatattatagattactgtatggatgttaaattttctgattttgatctatggtaatagaattgaatgccctttttcttaagaaatatatactaaaatatttaggggtaaaggacattatgtctacaacttacaaattgttctaaaggtcgggggggagtggggaggaaataataaagttatatagcaaaatgttaacaattgctgaatccagaagaaagatatttaggagctccttgtaacttttctcttagtttgacattattttaaaaagaaaaaaagtaaaggataacgtcagaaaacttggaaaatgggtacagtggcctggtggaaaattccagagacctcaatggagccatcttaagaatggcatattgtcccattgatctatatctcttgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattggtagcttgatggggatggcattgaatctgtaaattaccttgggcagtatggccattttcacgatattgattcttcctactcatgagaatggaatgttctcccatttgtttgtatcctcttttatttcactgagcagtggttcgtagttctccttgaagaggaccttcacatcccttgtaagttggattcctaggtattttattctctttgaagcaattgtgaatgggagttcactcatgatttggctctctgtttgtctgttgttggtgtataagaatgctcgtgatttttgtacattgattttgtatcctgagactttgctgaagttgcttatcagcttaaggagattttgggctgagataatggggttttctagatatacaatcatgtcgtctgcaaacagggacaatttgacttcctcttctcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagcgcttatgattttgagatacgtcccatcaatacctaatttattgagagtttttagcatgaagagttgttgaattttgtcaaaggccttttctgcatctattgagataatcatgtggtttttgtctttggttctgtttatgtgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtatcaggatgatgctggcctcataaaatgagttagagaggattccctctttttctattgattggaatagtttcagaaggaatggtaccagttcctccttgtacctctggtagaatttggctgtgaatccatctggtcctggactctttttcgttggtaagctattgattattgccacaatttcagctcctgttattggtctattcagagattcaacttcttcctggtttagttttgggagagtgtatgtgtcgaggaatttatccatttcttctagattttctggtttatttgcatagaggtgtttgtagtattctctgatggtagtttgtatttctgtgggatcggtggtgatatcccctttgtcattttttattgcatctatttgattcttctctctttttttctttattagtcttgctagcagtctatcaattttgttgatcctttcaaaaaaccagctcctggatttgttaattttttgaagggttttttgtgtctctatttccttcagttctgctctgattttcgttatttcttgccttctgctagcttttgaatgtgtttgctcttgcttttctagttcttttaattgtgatgttagggtgtcaattttggatctttcctgctttctcttgtgggcatttagtgctacaaatttccctctacacactgctttgaatgtgtcccagagattctggtatgttgcgtctttgttctcgttggtttcaaagaacatctttatttctgccttcatttcgttatgtacccagtagtcattcaggagcaggttgttcagtttccatgtagttgagcggttttgagtgagattcttaatccagagttctagtttgattgcactgtggtctgagagatagtttgttataatttcttttacatttgctgaggagagctttacttccaactatgtggtcaattttggaatagatgtggtgtggtgctgaaaaaaatgtatattctgttgatttggggtggagagttgatttggggtggagagttctgtagatgtctattaggtccgcttggtgcagagctgagttccattcctgagtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttgttgaattgatccctttaccattaagtaatggccttctttgtctcttttgatctttgttggtttaaagtctgttttatgagagactaggattgcaacccctgcctttttttgttttccatttgcttggtagatcttcctccatcctttcattttgagcctatgtggtgtctctgcccgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcgtagtcttgatggtctttacattttggcatgattttgcagtggctggtaccggttgttcctttccatgtttagcgcttccttcaggagctcttttagggcaggtctggtggtgacaaaatctctcagcagttgcctgtctgtgaagtattttatttctccttcacttatgaagcttagtttggctggatatcaaattctgggttgaaaattcttttaagaatgttgaatattggccaccactctcttctggcttgtagagtttctgccgagagatctgctgttagtctgatgggcttccctttgaggataacccgacctttctctctggctgcccctgacattttttccttcatttcaaccttggtgaatctgacaattatgtgtcttggtgttgctcttctcgaggagtatctttgtggcgttctctgtatttcctgaatctgaatgttggcctgccttgctagattggggaagttctcctggatagatcaatggaacagaacagagccctcagaaataatgccgcatatctacaactatctgatctttgacaaacctgagaaaaacaagaaatggggaaaggattccctatttaataaatggtgctgggaaaactggctagccatatgtagaaagctgaaactggatcccttccttacactttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgaccaatgggatctaattaaactaaagagcttctgcacagcaaaagaaactaccatcagagtgaacaggcaactacaaaatgggagaaaattttcgcaacctactcatctgacaaagggctaatatccagaatctacaatgaactcaaacaaatttacaagaaaaaaacaaacagccccatcaaaaagtgggcaaaggacatgaacagacacttctcaaaagaagacatttatgcagccaaaaaacacatgaaaaaatgctcaccatcactggccatcagagaaatgcaaatcaaaaccacgatgagataccatttcacaccagttagaatggcgatcattaaaaagtcaggaaacaaccggtgctggagaggatgtggagaaacaggaacacttttacactgttggtgggactgtaaactagttcaaccattgtggaagtcagtgtggcgattcctcagggatctagaactagaaataccatttgacccagcaatcccattactgggtatatacccaaaggactataaatcatgctgctataaagacacatgcacacgtatgtttattgcagcattattcacgatagcaaagacttggaaccaacccaaatgtccaacaatgatagactggattaagaaaatgtggcacatatacaccatggaatactacacagccataaaaaatgatgagttcgcgtcctttgtagggacatggatgaaattggaaatcatcattctcagtaaactatcgcaagaacaaaaaaccaaacaccgcatattctcactcacaggtgggaattgaacaatgagaacacaaggacacaggaaggggaacatcacactctggggactgttgtggggtgggaggaggggggagggatagcactgggagatatacctaatgccctaatgctagctgacgagtttgtgggtgcagcgcaccagcatggcacatgtatacatatgtaactaacctgcacattgtgcacatgtaccctaaaacttaaagtataataataaataaataaataaagaatggcacattgtcaacaccgcatgggctggagggcaacactgtgtgggaggcaaaggcactcctgcctcagcgaaataggggtgtggatcaatttcctggtttgatgatgcactctagtgccccccctggaggaagctgggagatgggaaggggtctggatcaatttcctggtttaatgatgcactctagtgtcccccctggaggaagctgggagatgggaaggggtctggatcaatttcctcgtttgatgatgcactctagtgccccgccctggaggaagctgggagatgggaaggggtctggatcaatttcctgatttgatgatgcactctagtgtccccctggaggaagctgggagatgggaaggggtctggatcaatttcctggtttgatgatgcactctagtgtcccccctggaggaagctgggagatgggaaggggtctggatcaatttcctggtttgatgatgcactctagtgccctgccctcgaggaagctgggagatgggaaggggtctggatcaatttcctgatttgatgatgcactctagtgtccccctggaggaagctgggagatgggaaggggtctggatcaatttcctggtttgatgatgcactctagtgccccaccctggaggaagctgggagatgggaaggggtctggatcaatttcctggtttgatgatgcactctagtgtccccctggaggaagctgggagatgggaaggggtctggatcaatttcctcgtttgatgatgcactctagtgtccccctggaggaagctgggagatgggaaggggtctggaccaatttcctcgtttgatgatgcactctagtgtccccctggaggaagctgggagatgggaaggggtctggatcaatttcctcgtttgatgatgcactctagtgccctgccctggaggaagctgggagatgggaaggggtctggatcaatttcctgatttgatgatgcactctagtgtccccctggaggaagctgggagatgggaaggggtctggatcaatttcctggtttgatgatgcactctagtgtcccccctggaggaagctgggagatgggaaggggtctggatcaatttcctggtttgatgatgcactctagtgccctgccctcgaggaagctgggagatgggaaggggtctggatcaatttcctgatttgatgatgcactctagtgcccccccggaggaagctgggagatgggaaggggtctggatcaatttcctggtttgatgatgcactctagtgtcccccctggaggaagctgggagatgggaaggggtctggatcaatttcctggtttgatgatgcactctagtgccccccctggaggaagctgggagatgggaaggggtctggatcaatttcctggtttgatgatgcactctagtgtccccctggaggaagctgggagatgggaaggggtctggatcaatttcctgatttgatgatgcactctagtgtccccctggaggaagctgggagatgggaaggggtctggatcaatttcctcgtttgatgatgcactctagtgtccccctggaggaagctgggagatgggaaggggtctggatcaatttcctcgtttgatgatgcactctagtgtccccctggaggaagctgggagatgggaaggggtctggatcaatttcctggtttgatgatggactctactatgttagctgtcccctggaggacgctgggagatcagtacactgtacctcgctgtactaggtttataatttatgagcccataattatttcaaaatataaagttttttaaaaagtggttcagaagatgtggacctgcatgtgaagaagttttagaaatatctttatttattttgcctatagtttcctttttatgtatgcacaaaagtgatatatgatttgaaagaaactatgttggagtaagtgtgaagagctcatctcttaggtataaaatacagattccaagtgagtaaagaaaatggctacataattccaacgaactcatcttgttcagtctgccacaggccctgcccttgatgacgtcccacaggtcctgcccttgatgaggccccacaggacactcagaaagctgcatgaccaggcagtgccagggttccacctctatctgcagatgacgctgccctgccctgccctccccaccaacagcactcttctgcagtgaggagggacccttgaccctgccaccacagcacccgggtcctcttgcagcacttctagtgagctgaagcaagagaggaataatgggagagactgcctgaagtttccttttttcttacttttttcctgcagggctgcctcctgcctatggctacgttatgaacgtgctcagtttagatagtaggtgctggaattttggctaactggcatttccctttgcaccaagcaactgcccaaagggttgattctcagcttaaacactacactaagtcatttagcagtaatgtttgggccgggttctgagtgtgtgaattctgtccaaaagctgaagatgtttaagctatttcctcctggagtttggtggaataataaaaggttactgttgtcacagtgaggaggtctgcagctggtcccacttcctttcattactacccaatgtaaacagattaaatcgaaccgctcggatcaccagaagggacattccttatttctgctcctttctgttatgctttcagtgtccctcaggctcctttcagatgtcagtttttatcattgggaatatcttggcaactgattgctcaggccctcttgtaaacgaaataccttctttcaggttccctctctcttctcagcagcgaggcgtaaactgcagtagtgagcagggtgtgacccttaccttgagggccacatggctactgactgcagccatgaaatgggttaggtcacccacagagccggcagagaccttccctccaaccacctctggctgatttcaccactaacacctggtggggtccctcccccaccccaagaggtctgcttttgttgtgcaccccactctgggaagagggagatcctggggcgcccacctaatcagccaccagcaaggccagggctggtgacgcagcaggaggtaagggatggcgtgggtggaggcattagtcactggcatgtaagtgttattactaatcagtaatagcccatgaaatggtgggtggatcagctagattagggggtttagttgtttcttttgagatggagtctcactctgtcacccaggctatagtgcaatggcgtgatctcggctcactgtaacctccgcctcccaagttcacacgattctcctgcctcagcctcctgagtagctgggattacaggcatgcaccaccacgcccggctaattttgtatttttagtatggtttcaccatgttgtttagtatggtttcaacatagtttcaccatgttggtcaggctggttttgaactcctgacctcaggtgatcggcctgcctcagcctcccaaagtgctgggattacaggcatgagccaccattcccggccattttttttttaaattacataaaacctctggttcaaaaaaaaatttcatctgaaagcccacaatacaaaatgacttgcagctctccctctccctctccctctccccacggtctccctctccctctctttccacggtctccctctcatgctgagccgaagctggactgtactgctgccatctcggctcactgcaacctccctgcctgattctcctgactcagcctgccgagtgcctgcgattgcaggctcgcgccgccacacctgactggttttggtggagacggggtttcgctgggttggccaggccggtctccagcccctaaccgcaagtgatccgccagcctcggcctcccgaggtgccgggattgcagacggagtctcgttcactcagtgctcaatggtgcccaggctggagtgcaggggcgtgatctcagctcgctacaacctccacctcccagccgcctgccttggcctcccaaagtgccgagattgcagcctctgcccggccaccaccccgtctgggaagtgagaagcgtctctgcctggccgcccatcatctgggatgtgaggagcccctctgcctggctgcccagtctggaaagtgaggagcgtctccgcccggccgccatcccacctaggaagtgaggagcacctcttcccggccgccatcacatctaggaagtgaggagcgtctctgcccggctgcccattgtctgagatgtggggagcgcctctgccctgccgccccgtctgggatgtgaggagcacctctgcccggccgcgacccggtctgggaggtgaggagcatttctgcccggccgccccgtctgagaagtgaggagaccctctgcccggcaaccgccccgtctgagaagtgaggagcccctccgcccggcagccgccccgtctgagaagtgaggagcctctctgcccggcagccaccccgtctgggaagtgaggagcgtctccgcccggcagccaccccgtccgggagggaggtgggggggtcagccccatgcccggccagccgccccgtccgggaggtgaggggcgcctctgcccagccgcccctactgggaagtgaggagcccctctgccaggccagccgccccgtccgggagggaggtgggggggggggtcagcccccaacccggccagccgccccatccgggaggtgaggggcgcctctgcccagccacccctactgggaagtgaggagcccctctgccaggccagccgccccgtccgggagggaggtgggggggtcagccccccgcccggccagccgccccgcccgggaggtgaggggcgcctctgcccggccgcccctactgggaagtgaggagcccctctgcccggccaccaccctgtctgggaggtgtacccaacagctcattgagaacgggccatgatgacaatggcggctttgtggaatagaaagtggggaaaggtggggaaaagattgagaaatcggatggttgccgtgtctgtgtagagagaagtagacatgggagacttttcattttgttctgtactaagaaaacttcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggcctcagggtcctctgcctaggaaaaccagagacctttgttcacttgtttatctgctgaccttccctccactattgtcctatgaccctgccaaatccccctctgtgagaaacacccaagaattatcaataaaaaataaataaattaaaaaaaaaaacaaaaacaaaatgacttgcgataaaactgctctgatcgcagggatctaggtctctggcctcctcctaacttccacagtgacatctgatggggcaccaaggaatacagtttgaaaaccattagctctcactaaagacaagctagggaagtctaaagagagaataacctactgaaggtcacatggtcagtcggttaatggccgacaagagtccagcattttcccagcacctgactctgctttaccccatgtactggtcagatgtcagtgttctgtgttcttagaatgagcaggtcttggtccttacaacagtaacttcaagctttcataggaggaaaaagttccaagaaaaaggaaaattacattttacctggcaaaactgattttgtaggtaatggggcctatcttaatccaatttaataacatccagagatgactagcgaaaagaataacttttcctggcaacactgcaagcatctgagtgtttaactgcacaatttcggacatgaccatggcagctactagcattcgtgagacatcagggctctgcaaatggctctcctgcgcaaagcatgctcacagggcagaggtggccctgtgtgggtggaggacatgccagaagcatgggctctacacccagagccttctttccaccctagtccctgctcccaaaatgcaattgagaactgcatttaattagttacaagaaactgtttgttttcttccatgccagtcaatactatgacggctttaaatcaactgcatctaatcctataaatacatctccgggatggagcctcctcaagatgtcccatcagttttgttcatttacttctattcctgagattcagttctatgtcctctactcttcaatgagacatgagtccatcaacaaaatagcactgggaaaggaattctagtttctgacattgagacctggcttccagtttaagctcctccacttccaagctgtgcaaccctgggccaaccacttaacctctctgagctgcagtttcatcacctataaagcaagaggcaggaattgtgacgataacataaagcatgtaaaagaatttaaaagtgcaaaggactataaaagtgtgagtatccattctattacaatcatttaatcaagggaccagacacatttgattgcatcatttcagaactgctcctggaagctctgctctcttggctcctgcccttgtggtgctgggaaagaatgaatgcagggctagctgcaaagtacatggttacaggtttctcagagctggtcctcccagccagcctcccttttggtggtgtctggagcaaaacaataccgtaaaataatcctccagcagccaagtgtagacaattaaaaacagggatcactaatctagaagggaaacgttctgatttattgctctaacctcccttgtcataacatggcagttaaccaaaaacaccattctgtaggatgaagggagaggaaatttagacttggacagaaaaatccaaaggaaattaaagtgttagtgtgctctgaaaagtaactcttcaaatatgccactggccaccttgacatttccaggcctccccaatggcttccagacctaaagtgatcagcttacactgcatggaggcctctcctagccgagggtgctgctggcttcccggggattgttcagcctctctcatcatcactgtaccagatgacagtcaaaccaaaaactcagctgacaagctcaggagatgctgaatgaggcagagcagaactctcctggccccaccacagtggctaatgaagcttgtgtgtgtcctggaggcggggctcttcaggagcagagatgtgggcagggaagtctgccctttcatggagttttctacatgcactttcagataaaggccttctgtaaagaccacaacagctgtcatctctgaacgtggccaagagccaaaggatcgtatctggagcaagcagaccgattttcagaaacgcacattgggtaggttacccgtggtgacgcaaaccagacttacttgatctaaatctcctttctccgttgccagttcctccatctctggtgttggctcatcttccaggaagggattggtagatgggggtggagactcaagctttttctgttaggtagatatgagaaagagaagtgttttctgagcatattcaatagctttccccattgatctgctttttctaggtgtctccaacaaggaagtcatgcacgctatctgataaagaagaactgaggcaacccagaccacattcttgcctccgggccttcacagtgctttccctcttcctgcaacctccccgaccaccccgccccaactcgaatctggctaaaacgctcacgcatcctcagtcctcaaaccggaactccgttctgctgggaagcctttcccatctgtcaggtttgggtcagatgtccctgacacgtgttcccaaaccaagctacatgtctcctacccaggcatttattaaaatatagcaattgcccattatttgtcttttcccttctggcctccatgatggcagagattgtgtctgtcttgttccccatcctatctcagtgcctagcatgtagcaggtcctcagtaaatagaaatgaatcaaagtgccagatggatttcaacgcaagaacaaactacaaaactaatctcatgtgttctagattaacagatgtctcttcccaagtaagccccattacaacaaccacaacagaaatctccttgagaaaatcgacttctcagcttccaaatatgaccactatttcaaaatacatcacggagtggaaacatgggccagtgggaaggctgcaggcaggaggcatggtagctgtagctccaaccgtgcggcactggccctatcacccagcttctctgagcctcagtaacttcatctgctgaatgaggatgtagtcacaggactatctggaggatcaaatgtgaaaccctagaagcagcacatgatacacacaagggtcactgatgacgttaattccagtacaactacagaatcaaggcagctctctggaattcctttacagttttcacctagagatgttgtttatgcctgggagctgaaggctttagcagaaaggaggccaactggacaaacagaaaagagggactgcttggtgctggggacgagggaagggggcaaggcatggctctctggagacgagaagttaatggagagggagtttctaaatgtacttggtattttagccaataccagtgggtcaatctgaattaatctctaagccaaaagggacagcagatggactatagcgtgaataactttgccaagtgccaggacaccatctgaagctattacaaacaaaaataaaaccaaaacttacacaaaggccgggtgcagtggctcacacctggaatcccagcactttgggaggctgaggcggcggatcacttgaggtcaggagttcaagaccagcctgaacaacatggtgaaagcctgtctctactaaaaataccaaaattagcagcgtggtggtaggcgcctgtaatcccagctacttgggaggctgaggcacaagaattgcttgaatccaggaagtggaggttgcagtgagccaagatggcaccactgcactccagcctgggtgacaaagcgagactccgtctcaaaaataaaatacaataaaataaatacattgcacaaaagcactacacctgcgtctggtttttggtttaagacaatactgctaacagtcatttaataactgcttattttttggccaaaacacttggatgcaagtgatgtggacagatacagcctcggtgcatgacaaagccttgtggtgatggcattagctcgaggtaatcagtagtaagatgatggtttttgtggtatcctggtgataaacaatatggtctaacacccaagcaagtatttcacatttgcacactccaaactttggcttctttacctaacatgagagaaaaaaaatccttaaaaatgtacagctcttgttagaaagcagtatttctaagcttgagttgtcttcttaagggctgctgatattttagagagagaggaatagtaataaagggaatctaccaagcttaatcttcaacaaccataaaaaaattaaattaggtaatagcattagactcctgattccactggcttaacagtgggctctgggattatgctgttgagctgagtcactatgattctaagtcttttggtcctttgtagatatgaaaagcaagtcagctaactgaagttaaaagctttgatcaaaatcattcagtgacagacacagaatttgagtttttgaactaaatgcccctcatctattgctaagtctattgggttgataacagcacctcacaattacataaagatgggcctcgtttttaaaacataatgtgttattggaaatcatggcaaacagcagatgtcagtgacgtggactgagaacgttcccgggctctgctctcgctggcataaagcatcaagaaaacgcagagggtaggaagaagtcaaacctactctcactggcgtaaagcatcaagaaaacgcagagggtaggaagaagtcgagcctactctcgctggcgtaaagcatcaagaaaacgcagagggtaggaagaagttgaacctactctcgccggtgtaaagcatcaagaaaacggagaggggaggaagaagtcgaacctaacgggcagccctgaagaagcaggcaccatctgaggcaggtgagcacaggccactcgctcagtgtcaccatctgggatagagtgagcatgggccaacctcagcctcctgagtagctgggactacaggtgcacatcaccacacccaagtaatttttgtattttttgtagagatgggattttgccatgttgcctgggctggtctgaaactcctgacctgaagcaatccatctgtctcagcctcccaaagtgctagaattacaggcgtgagccaccatgcccgtcctctattaacatgaggggagttgtggacatcaaggagctcctagctcactcatttgtggcacatgcattccacatgtggaccaagttagtacaggaaaagtgattcattccttccctcatccactcaacaaagggatatgcttggccctaggagtagagcagtgagaaagacaggccagcctccgccctcatggagattagagtctgctgggggagacagccttcaatccaacagtcacacaaacagtgagaagggccaggaaggaaaagcagtcgtcatggaaacgtgcaacagagggccgcagccgtccctaaagaaaagatgtctgagccagagctgaaggatgcctcagagtgaaatatatgaggggtggagggcggagggaacagcacgtgtctgccgctcactcaacaatgatgtactgggcatccactctgctccaggcactcttgggtgcaccagggatgcaagtgaggaagatggattagagaggcggcactgtagtggtgagaagaaaactcagggagtgggatgagctggggatgagggtgggaaagtgcttctacacacagggtcatcagaaaaggtctctgaggagatgacggctgagctgagtaagaaggaactgctcaggcaaaacccaaggaagggtgttctcagcagggagacccggtggagacgctggaaagcatatggtgagtctgagggacagaaaggaagatgggggcctggggtaagaggggtggcgggagtcccatcatattggtgaatcagggatggaaaggaagatgggggcctggggtaagaggggtggcgggagtcccatcatattggtgagtcagggacggaaacaaagatgggggcctggggtaagaggggtggcgagagtcccatcatattggtgagtcagggacagaaaggaagatgggggcctggggtaagaggggtggcgggagtcccatcatattggtgagtcagggacggaaacgaagatgggggcctggggtaagaggggtggcaagagtcgcatcatattggtgagtcagggacagaaaggaagatgggggcctggggtaagaggggtggcgggagccccatcacgcagccttttgtgggccatggtaagggtcggttttcttctcactgcaattgggcagtcgctggtagttttcaacagcgaagtgatgtgatctaatttggattttaaaaatattccactgctgtaggggaatggattataatgacagcaggcaaaccagtttaagaggctgctacagtgctccaggaaagggctgatgggaaccggactaagccagtgttccaggaaagggctgatggggaactggactaagctggtgatggacgatagaaaaaagtgtccatcggatttggggcacagttaggaggcagagccaggaggctttgctgagagagtgagaacgagggtgagggaatgaaaggagtgaagggacagtcactttctggtctgagcaactgcacggctgatgttgcccttaactgagatggggcaccctcgtgtagtggcaagggcacaggctccgtatctgacagacccgggttcgagtccaggttccaccatggggtatgctgtttaacttctagcctcagttctcctacctgcaatgtgaagggataggaatacctacctcgtatggctgccatgaggatgggatgaggcatgcgtgtcaggcgtgagctacacagttacgtgctgccatgaggatgggatgatgcgtgcgtgtcaggcgtgagctacacagtcatgcaccacatcaccatgtttccatccatgacgggccacggtacaaggcggttccactagattataatggagccatacaatagagtaggccaggggtccccaacccctgggccacagtccatggcctgttagcaaccaggctgcatatcacgaggtgagcagcagtgagtgagcatgactgcctgggctccgcctcctgtcaggtctcataggcaaaccctgttgtgagctgctcatatgagaggtctaggttgcacactccttctgagaatccaatgcctgatgatctgaggtagaacagtttcatctcgaaaccatcccctacccccatcccctgcactcccacccccacccccacctctggaaaaactgtcttccacaaaaccagtccctggtgccaaaaaggttggggacagctggagtaggttctagcaggcacactctatgaggtttgcacagtgatgaaactaatgatgcatttctcagaacatattcctgctgttaagcaatgcatgactgaatatatacagcagcttaacatgctgtctggcacagagggcaaggctcagcaaggggaagctttgagcagtaattaatagggtgagctacgaaacaaggcaaaactgttgtgcttctcttaataaagcagctcacagaaaacgtgggcatgcaggcttaaaagtcttgtcaaaagaatttctattaaccataagtggagcctcgtcccaactactttgtctctttgggatctctctaagaaataaaagcaaagggcccatcaactttgcactttctaagtggaaaggcacacggagctgctcctttcttccccagtctacaacaacgcacataccaccctcctccctgttgataaaagtcctaaaaccctaaggtgtggatatgcattcccgctagttagagggctacattactgctcagactgacttgctaagatgaaagaacaagtccttgtggggagcgatcactggcataacgcagccttctgtgctaagagccacacagatcacgcttctcaggcttgctttgcagctgtcacaggccacagagaattacaactttggggttagattgtcagtaactcaaaggacatatttcatgaactctgaggctgctaaataaagccaaaaatttccaagaagtgaatgacttccaattttgaaagaattcattctttttgctatgatgacagttgatttcaagccgatataggaaagcaaaattcttcatatagcaagttaatccctactgattaaatcacaggggattcccagcaccttcaaaacagttcagaccacaggacagtcaggctgtctaattcactgtcaagaagggaaagtctggcttcagtcagcagtacatccgtatctcgtctgcctacacaaatccctgtgtgaggccctagctggacacatcgaattatcaaagaaggaactctgaaatttaagactcttcctttccctagaggggaaagctttcgcttgtgagatgaaagttcctcagtttctgcatttctcactccataaatgctttactccagcccaattcctaattggtccttaaagagatggctgcggggctttagctgacagtcaggactgcaagcccaggggttcacacacttggtgtccaccatttctggggctactctcttgctaccgccatgtccacttcttctattgcaacagttatgtacagacttctttctcctactagaccctaagtgccttcccgatccaatttctcatcttttccaaagccctgaacaaagagggaagcttgaaaaatataagtgggtaaatgctgatcagatgaaaggccctcaataaaatcctcttcagaaacatgggcaacactttctattttctgtaaacaaaacaaaaagcctgcgtatatgtgtgcaagcgtgcttgcagaagcgtcaaaaatataccccaaagaattaaacagtgtggatacctccagggggagggatatacagtagttaagaagagatgtttatttaaaatttttttttctatttgagtttttaataggcatatatagctatttctgcttttttcttttcttttcttttctttttttttttgaaacagagcctcactcttccacccaggatgaagtgcagtggtgcaatcacagctcactgcagtcttgaactcctggacttaggtgacccttgcacctcagcctcctgagtagctaagaatgcaagtgcacactaccacgccctgctcattttaaaatttttttttagagacagggtcttcgtggcccaggctggtctcaaactcctggctgtaagagacctgcccacctcggcctcccaaagcgctgggattttaggcatgagccattatgcccggcccactgctcatttttttttttgacagaatatttatctgaagagtaaagatgatttataactaaactcatacactatcttctaaagcctttaattctaaattgtgatgtaattcatgtcacataaaactcaacattttaaagtgatttactattcagtggttttcggacattcacaaggttgtgcagccatcaccaccaattccagaacatttttcacccccaaaagcaacccctacctgttactgggaagctgttacttcccagtcttccccttcccaaccccatcggcctctatggatttgcctcttttgggtatttcctatagatggaatcatataatgtgtgacatctgtgtctggcttctttcactcggcatggtgtgtccaaggttcacccaggtcagggcacgtatcagcacttcattccttttacgtgaataatattccactgtacggacagaccacgttttggttattccttgtctactgatgtttctactttttggctattgtgaatagtgttgctatgaacatttgtgtaagacatacgaacatatgtttttaattcccttgggcatatacttagaagtagaaatgtgtaattaaaaaaaaagaattcagattgctttgctttttctatttggcagagttaccccttcacattaggcatggcacattaacactgtgagatgcactgaaacaagcagggactacttttaaatcttaactgcatttggaagaacagaaaggaagaggaacagaaagatgtttaaagcagaggctgaaattgaaagtgctcacaacttgagccgataattccactagtgtcgtaagaaaatcatctcactgctttgggtaagagacagcgaagaggagagaagagagaagagaagagaggaaaaaaacaatctcaaatgcatataaaattagtagacaaggccgggtgcggtggctcacgcctgtaatcccagcactttgggaggccgaggtgggcggatcacgaggtcaggagatcgagaccctcctggctaacatggtgaaaccgtctctactaaaaatataaaaaaaaaaattagccaggcgtggtggcgggcgcctgtagtcccagctacgcggaggctgaggcaggagaatggcgtgaacccaggaggcagagcttgcagtgagccgagatcgcgccactgcactcgagcctgggcgacagagtgagactccgtcacacacacacacacacacacacacacacacacacacacacacacacacacaaattagtagacaaaaatattcatatagccctatttataaaagtgagaaaaaactaagggtcctacgagaaaagaataattaggggaatcactgagtatctatagaataaaatctttctgtagtagttgagaaacaacttaagctgtgacatatgaagcatattttcatatgtgtgtgtgagttaatatggaaattaactcaaaatggatcaaagatataaatgtagcagctgaaactataaaactcttaggaggaaacctaggtaagtctctgtagccttggattacgtaacagtttcttggatatgacactaaacacaagcaagaacaaaaaaccttcattaaaacggaaatcctgtgaaatgactatcaagagagtgaaaacccacagatgggagaaaacattggcaaatcatatgtctgatacatgataaaatatctaaagaagttataaagcctgggcatggtggctcacgcctataatcccagcactatgagaggtcgaggcgggtggatcacttgaggccaggagttcaagaccagcctggccaacacggcaaaaccccgcctctactaaaaaaaaaaaaaaaaaatacaaaaaatacaaaaattagcctggcatggtgctgcgctcctgtggtcccagctacccaggagactgaggtccgagaattgcttgaacccaggaggcagaggttgcagtgagccgagatctcaccactgaactccagcctgggcaacagagtgagactctgtctcaagaaaaaaaaaaaaaagttatagaatatatctagaatgtgtaaacaactcttacaactcaacaataaaaacaatccaactaaaaaatgggcaaaaaatgtgaatagacatttccttttttttgagacatgagtggcgcaatctcagctcactgaaacctccacctcctgggttcaagcgattctcctgcctcagcctcccgagtagctgggattataggcacccgccaccacgcctggctaagttttgtatttttagtacagacggggtttcaccatgttggccaggctggtcttgaactcctgacctgaggtgatgctcccacctcggcctcccacagtgctgggattacaggcgtgagccaccacacccagctgaatagacatttctttaaagaagctgtgcaatgtcactagtcaatgggaaaaagcaaatgaaaaccacaaggagatactactctacacccatgagaatggctataattaggggaacaaaggagacacgcgtcagcaaggatatggggaaactggaccctcctacattgtgggtagaaatgtaaaaccgtgtggctgcttcgaaaacagtttgcagttcctcaaaaagttaagcctagggttaccatgtgacccagcaattccactcaggtatattctcacaagaataggaaacacgctgacacgaaaacctgtacaaatattcacagcagtattcatacagtgaaaacctgtaccgatattcacagcagtattcacatagtgagttcacacagtgaaaacctgtacaaatattcacatagtgagttcacatagtgaaaacctgtacaaatattcacatagtgagttcacacagtgaaaacctgcacagatattcacagcagtattcaaatagtgaattcacacagtgaaaacctgtacaaatattcacatagtgagttcatacagtgaaaacctgtactgatattcacagcagtattcacatagtgagttcacacagtgaaaacctgtacagatattcacatagttcacacagtgaaaacctgtacagatattcacagcagtattcaaatagtgaattcacacagtgaaaacctgtacaaatattcacagtgagttcacacagtgaaaacctgtaaaaatattcacatagtgagttcacacagtgaaaacctgtacagatactcacagcagtattcaaatagtgaattcacacagtgaaaacctgtacaaatattcatagtgagttcacacagtgaaaacctgtacagatattcacagcagtattcaaatagtgaattcacacagtgaaaacctgtacaaatattcacatagtgagttcacacagtgaaaacctgtacagatattcacagcagtattcaaatagtgaattcacacagtgaaaacctgtacaaatattcacatagtgagttcacacagtgaaaacctgtacagatattcacagcagtattcaaatagtgaattcacacagtgaaaacctgtacaaatattcacatagttcacacagcgaaaacctgtacagatattcacagcagtattcaaatagtgaattcacacagtgaaaacctgtacaaatattcacatagtgagttcacacagtgaaaacctgtacagatactcacagcagtaatcaaatagtgaattcacacagtgaaaacctgtacaaatattcatatagtgagttcacacagcgaaaacctgtacagatattcacagcagtattcaaatagtgaattcacacagtgaaaacctgtacaaatattcacatagttcacacagcgaaaacctgtacagatattcacagcagtattcaaatagtgaattcacacagtgaaaacctgtacaaatattcacatagtgagttcacacagtgaaaacctgtacagatactcacagcagtattcaaatagtgaattcacacagtgaaaacctgtacaaatattcacatagttcacacagtgaaaacctgcacagatattcacagcagtattcaaatagtgaattcacacagtgaaaacctgtacaaatattcacatagtgagttcacacagtgaaaacctgtacagatattcacagcagtattcaaatagtgaattcacacagtgaaaacctgtacaaatattcacatagtgagttcacacagtgaaaacctgtacagatattcacagcagtattcacacagtgaaaacctgtacagatattcacagcagtattcaaatagtgaattcacacagtgaaaacctgtacaaatattcacatagtgagttcacacagtgaaaacctgcacagatattcacagcagtattcacacagtgaaaacctgtacagatattcacagcagtattcaaatagtgaattcacacagtgaaaacctgtacaaatattcacatagtgagttcacacagtgaaaacctgcacagatattcacagcagtaatcaaatagtgaattcacacagtgaaaacctgcacagatattcacagcagtattcaaatagtgaattcacacagtgaaaacctgtacaaatattcacatagtgagttcacacagtgaaaacctgtacaaatattcacatagtgagttcacacagtgaaaacctgtacagatattcacagcagtattcaaatagtgaattcacacagtgaaaacctgtacaaatattcacatagtgagttcacacagtgaaaacctgtacagatattcacagcagtattcaaatagtgaattcacacagtgaaaacctgtacaaatattcacatagtgagttcacacagtgaaaacctgtacagatattcatagcagtattcaaatagtgaattcacacagtgaaaacctgtacaaatattcacagtgagttcacacagtgaaaacctgtacagatactcacagcagtattcacacagtgaaaaagtggaaaccacccgaatgtccacagctgatggaagagacaacaatatgtgcatcacccacacaacggtgcactattcagccatcaaaatgatgcactgacacacacctcatcatgggtaaggctcgcagacactgtccagagggagggaaggcagacacaaaaaccacacatcgtagcatccgtttatgtgaagtgtccacaacaggcatccgtaaagacaaaagtcaattcgtaactgcccaggactggggaaagagaacttgaaagtcctgcctgctaaggagggatttcttctggggtaacagaaatgtcctggagttgcacagctgggatcgtggcatcatcttatgaatatatgaaaaccaactgaactgtatactttaaacgataaatttcatgtgacatttcgtgacatgagttatatctcaattttaaaaactaggcagagaaaactgtatttaaaaaaatacaatttcaaccatgtaaaatatatagaaagaatatacccaaatcctcatctctgatttggatgacttttttcctgcttctctattctcgccataatttccaaattttctatcctgaccctgtattattctcttctcagaaacagaagttaatcgtcccttgcaatattattcaaatggaagaatacatttctttagcaccagtaaagcatccataaaatattttccaacgctgaagggagtgcatgaggcgggggaatctgtcactgtcggagacagatgtcctcaagctgtggcagagctggaaaacctgcccctgttccttacacagtctccctcatgcaggtgccggaagaccagggtgtagagtgagacatgctgggtggtctttcatgagtcgtgagccttttgcaaacgctcttacactcaaattccatggctgacaattgtacccatatagcttctatctttagaatgtaattctaaaaactggggaagtaaaggcccctataagccaaaggacaagtctgtttcaaaaggcaacttatgcagtggtcaagaggaagggaaatccagctgcataaaaggggaacatttttaattttattactacaaaaaaaacaaaaaacaaaacaaaaacctcccagtgaggcagttataaaaagctaatccgatctagtctgcttttctgctttcagcagaaggctgaatgtcatttgctcaccttgaatctaatcatcaagtcactaataatgcatatggatccagttacatcacatccagacattctcttttaatttcaaggcattttaatttatagactctcttgaattcctcctaaagggtcagaagttgaggcaactgggaaaagcacaggcagctcacctcctcaagtaacagttacagcacaggacatcgtgaaactggttaagcaacaagcctgtccctgaggctctttcagtctaaagttctatcaaatgttgaagtcacagctcttgaaaaagagccaaggatgatgcatcccactgaagtcaggagtgatgggtcaggaggagctgagctgtggcaggtcttgtcttccgggcgagctggccacactctcaagctcatcctcactgtttcactgccagtcaccaaggactggagaggtttggaatgatacagtgaaggcggcagtgggggtagggtggggatgacgtacagcctagggaggggcagcaagggagagtctctggccgttttggctccttggctgacatcttacctgttttgtggcacctttctgaggaattcagtaactttctataaaatctggcatatatcaaagggtatcaagatataccttggttcgtttcacaatttattctggtattttgaaacaaaatggtagccaaaaaggagtttccaaagagtgtatcctgaaaggaaggtagcatggggaaggggtcaggggccagggagcagcatatctccaggcagggtacccagcagctagactgggggtcaggacagctggaactcctggccttgcccaggcagccccttcccggtgctttgcgttgggagcatggtcggtagccatgatgaattcaccaaggtccctgccactgagggtcgcagaataaaggtgaagaaggtcgtgcacggcccacaatgagatgatggtggggaccaggctcagtgtgaacatcagctagagtgacagccttcacgtctcctcacagcagagctgcagtgaaccgattcctcaaggcccgtcccacctgggtaaagtggccatagggcttctgttgccttcctagaaacttatctttaagggaaaacccttgaaggatatcagacagccattttcaggatttggaatgcagaataactgccaggtcgtgatacctggcacaaagaatagggtaggaggacgaagttgaattaaagaagctgaaggatttagagaagtctgtggagaggagagctgactaaatagagagggaaagaaagaactcatggtgttcatcaggcttttctggctaaggatttagaacctgaaactctgcaaacttgagaggagaggagagcaacaactgaacaatgaagaggggatgatttaaagaccagttctgccaaaacatttcaaatatgaaaaccaaaaaggaaggagctggggaaaaaggctcaagtgttcctagctgacccctgaccaccaccacagagcaccacctcggccaggagacactgggctccaggccaggagcttggccctggccgagtgagttcaggcagaaaggggctgtgctgccctgagaaaccagtacccccagcccagtcctcccgggacagaaggtgtctgacagttggccaactgccattctgacagtcctgtacctgtgttttacaataaagcattgtctttgcaaacttgagtaagctcctgtcagtttttcatggtctctacgtggttaccctgttcagctgcctcagcttgtccagaagggccttccctgccctcgttcccttaccacttttggcctttgggggatttttccttggagaggtcctgggacagacccaggttcacaggctaccctggtcctcagatgcaacagggccatttgttcctctgtggtcctatagctccctaaatgtaaaagacaaatcaccaggaagtagggcccagccagagagggtgaagaatggctcaaaacaagtgcttggcaagaatgtcattcaagcatccttcactgggacctatttcccgtccggttatctggattaccagctcacagagcctgtcctgatgctctccggaccctgcccagccagaggccgtgggagctcagggggctactcccagggtggggcctgtgctcaatgctgaaccctcatgcttgtcgccgggcagatctccgtagggctgaatccagtgccacatatatctacgcttgaaaccaggcaggagcatggcttgggaaggtccgagaggagagccagcaagaggaatcagggggctgctaaagccaacctcatacttctcaggagaaactcaggattccttcagtgggatctctgttcctatttcctttccttttctgtttttttgagacagtctcactttgtcacccagactggagtgcagtggtgcaatctcagttcattgcaacctctgccttctgggctaaagtgatcctcctgtctcagcctctcaggtagctgggactacaggcgtgcgccaccacgccccactaatatttcccgggtagctgggactacaggcgtgcgccatcaggccccgctattatttcccaggtagctgggactacaggcatgcaccaccacgccccactaatatttcccgggtagctgggactacaggcatgcgccatcaggccccgctattatttcccaggtagctgggactacaggcatgcgccaccacgccccactaatatttcccgggtagctgggactacaggcgtgcgccaccacgccccactaatatttcccgggtagctgggactacaggcgtgcgccaccacgccccactaatatttcccgggtagctgggactacaggcgtgcaccaccacgccccactaatgtttcccgggtagctgggactacaggcgtgcgccaccacgccccactaatatttcccgggtagctgggactacaggcgtgcgccaccacgccccactaatatttcccgggtagctgggactacaggcgtgcgccaccacgccccactaatatttcccgggtagctgggactacaggcgtgcgccaccacgccccactaatatttcccgggtagctgggactacaggcgtgcgccaccacgccccactaatgtttcccgggtagctgggactacaggcgtgcgccaccacgccccactaatatttcccgggtagctgggactacaggcgtgcaccaccacgcctgctaatatttcccgggtagctgggactacaggcgtgcgccaccacgccccactaatatttcctgggtagctgggactacaggggtgcaccaccacgccccactaatatttcccgggtagctgggactacaggcgtgcaccaccacgccccactaatatttcccgggtagctgggacgacaggcgtgcgccactacgccccactaatatttcccgggtagctgggactacaggcatgcgccaccacaccccactaatatttcctgggtagctgggactacaggcatgcgccatcaggccccgctattatttcccaggtagctgggactacaggcatgcaccaccatgcccagctaatatttcccgggtagctgggactacaggtgcccacgacacctgctaatatttcttgggtagctgggactacaggcatgcaccaccatgcctgttaatatttcctgggtagctgggactacaggcgtgcaccaccatgccccgctaatatttcccgggtaactgtgactacaggcgcccaccaggcctgctaatatttcctgggtagcagggactacacgtgtgcaccaccacacctgctaatatttcccgggtagctgggactacaggcgcccaccacgcctgctaatattttctgggtagctgggactacaggcgcccaccacgcctgctaatatttcctgggtagctgggactacacgtgtgcaccaccacgcctgctaatatttcccgggtagctgggactacaggcgcacaccaccacgccccgctaatatttcccgggtagctgggactacaggcgtgcaccaccacgcccagctaatatttcccgggtagctgggactacaggtgtgcaccaccacgcctgctaatatttcccaggtagctgggactacaggtgcccacgacgcctgctaatatttcccgggtagctgggactacaggtgcccacgacgcctgctaatatttcctgggtagctaggactacacgtgtgcaccaccacacctgctaatattttccgggtagctgggactacaggcgcgcaccaccacgccccgctaatatttcccgggtagctgggactacaggcgcgcaccaccatgccccgctaatatttcccgggtagctgggactacaggcgtgcaccaccacaccccactaatattttccgggtagctgggactacaggcgtgcaccaccacgcctgcttatatttcccggatagctgggactacaggcgtgcaccaccacaccccgctaatatttcccgggtagctgggactacaggcatgcaccaccacaccccgctaatatttcccgggtagctgggactacaggcgtgcaccaccacaccccgctaatatttcccgggtagctgggactacaggcgtgcaccaccacaccccgctaatatttcccgggtagctgggactacaggcgtgtaccaccacaccccgctaatatttcccgggtagctgggactacaggcgtgcaccaccacgccccgctaatatttcccgggtagctgggactacaggcgtgcaccaccacgccccgctaatatttcccgggtagctgggactacaggcgtgcaccaccacgccccgctaatatttcccgggtagatgggactacaggcgtgcgccaccacgccccgctagtatttcccgggtagctgggactacaggcgtgcgccaccacgccccgctagtatttccttttctgacctgcattttctttaaggctattttcacctgttttgtgacccatttttttcccttgttactaaaaagaaatcaatattgaacattagttagcaagcagagaagtatacatatttttgatgtgctaagtaggaaaagagtgctttgtggtttcagctgcattttattctaataaagtcgtgagtgagcccaagtaggcaggaccttgtggtctggcctcaaaattgggctgctgccaccaccgctctgcagtccattgcctgaaaggccagcccgattcacctgctccaccctgtctaaagaccagcccgattcacccgcttcacctgctctgaggctggtctcatgggacaaagagggaattgcactgaagtctcagggttttaggaccagaagggtaggagctagagaaggtggcagaggtgaaggttgaacaagtgagtgggactccaggtacaagtcccagcctgcccccggcttcaaccacagtagctcagtttcacggtcttacacattagctccgtggcctggagtaagtttcaaatgagcacagcgcctacttcctatggctgatgaagcacagtgactgactgcaggtaaacgcacctaatatagcgtgggtcaccaagtggatgttcaaagcatgacagctatgggtgtttcagattctacattctattttttttttttttttgagatggagtctcactctgtcgcccaggctggagtgcagtggcgcaaccttggcagcacccaccaccacgcctgactaattttttgtatttttagtcgtgatggggttttgtcacggtagccaggctgctctcaaactcctgaccttaagtgatcatcccacctcagcctctcaaagtgctgggattataggcatgagccaccgcacccggcctctacattagattttgttacaagaaaggatttggaaatcactgatttggcccatctctctcattttaaaacaattgaaaaataactttgttaaagtacacacaaagtatgtaaatgcatttgtataagaaaatttccaaaaaaactataccagagtaaatggaaaaaaatatttccttgcttctctacctactctcactccaacttccttcccaagagacatccactgttaccatttccagacctctttcttatacatttacacacataaacatgctttttactttttccataaaagacattatacctcccaaagtgctgggatgacaggcgtgagctgctgcgtccggcccccgttctaccacttttaaactgctgtgtagcatctcacagtatggatgcactgtaatttatttaaccatcttcaataataaacattacagacacagccaagccttttgcttttaaggctgcagttcacctctttctttgtgcatcttcctctacatgtatggatttttttttagacttctggtttagatgtaaaattgttgcttgacaggacatgcatatttacatttctgaaagttctgataatgacaatttatgcaccaaaaaggttgtatcaagctgtatactagccctaaaatcctgtactgttagtcttgtaatttttttctgtttgcaaacctgatgtaggaaaaatatcctgttttcttttttttcatgtttattagccaactgaatttcttcagtcaatcgtctgtctgactctgtactcatttttctaacgggttactcgtattttccttatggatttttaggagttctttacatgtgctagatattaatcgtttgtgtcatgcagcttcaactgttttttaatcccttgattatgtttctggtctctttttccaaaagaacgttgttctctttatgttgttaaaccttttagtacttttcttcatggcttttgggttttatgtcttatttagtctccctaatattctgttattaaaggataggtgggcatggtggctcacacctggaatcccagcactttgggaggccgaggcgggcagatcacctgaggtcaggagtttgagaccagcctggtcaacatggtgaaaccccgtctctactaaaaatacaaaaattagccaggcttagtggtgtgcacctgtaatcccagctacccaggaggctgaggcaggagaattgcttgaacctgggaggcagaggttgcagtgggccgatatcgccccactgcactccagcctgctgacagagcaagactctgtctaaaaaacaaaatgaaaaaacaaaaaaataaaaaaataaaggatagtcttttcttctcatttaacagggaaggcagttcactacattacagcagaatcgggattagaccacaagtcttgactgctggtccaaggattttgctactaaatcactttgcttctctattgttacccgcagtttaaaaaaaaaaaacaaatctagctctaaagaaaattcaaaggtatgattctctcaacttggatttcttcttccctccctcctttcttctttccccttccattcctgcctgcatgggttctgtgtacactctgcacgactcgaggagacggatgagtcagctacaattcctgtattcaaggagctcaatgtctacgcatatgtaatgatgcaaacagaaattaccatagaacagagtcacttggtttcccagtggacaggaaatctgaagagagcaccttgatgtgttagcagggagcctgggcctccaaagagaagaggtttactcctttctctttcttttctttttttttagagatagggtgtcactctgtcactcatcatagctcactgcagcctcaactcctgggctgaagtgatcctcctgcctcagcctcccaagtgattgggactaaggggtgcacccgactaatttttttttttttgtagggatgaggtctcactatgttgcccaggctggtctcgaactcctggtctcaagcaatcctgccttggcctcccaaagtgctgggattatacaggtgtgagccactgcatcagaccaaaaagaagaggtttccggagtgaaaatttggacctggtctttgactacacagagacaaacgtttaaccggcagtactatgttccacctttccaatggaggcacgtagtccccaggcctgtatacctggctttggggtttacagagactcattgacctagtttgttcaccagagatgttaaaaggtaaaccctaaagtaaaaacatatcctaattgtaaccaaatctgataactgataaagaaataaggtatttgtgactgagtaaggcctctgactcacaaaattactagtctgtaaaatgggatcaatacttaagaaaaatgatgacagggcattctagaaacatgatgtactgcgtaagagacaaacaataaatccacacagagtgttctgtatcatcactttcccagcagctcagtgaaatcactgcaatgaggggttaagcaccgaagccaatggatagagtcaccatacagtgaaaccctgaatcccaaccacccaacccactgatttcacgtggcagctccctagggaaggtcttaccagggtcccatcggtcagggtgcagccggagaagcgttttgcaagaaacccctcaaagttagttgttctttgaatagcaaaaagaagcaatttcacttcaatttccttcgctctggtacgcataatcttggcaagttctgcccttcaaaacaaagagataagaatactatcaaacaagctgatcattcattcagtagagataaggtaaatggccttagcttatattcagaaaaaaaaaatgtatgtggtcatttcaaaccctgaggtctgttaccaccttagtctaaaacctggggaatagaaatacatattctaaacaagatttttaaggtgaaattatccaccaggcaaaaaaatcaggggtcatggatgatatatatatacttatatttatttgtttgtttatttatttatttatttatttgagatggagtctccctctgtcgcccaggctggaacctccacctcctgggttcaaatgattcttttttttttttgtatttttagtagagatagtgtttcaccatgttggccaggctggtctcaaactcctgacctcaagagatccgcccacctcggcctcccaaagtgctgggattataggtgtgagccaccagtaatttggttacatagttactacgttgcctgtatctttgaacagtttaataattggataataatacatatggagcacctaattttttattagtgtatatagcctatataatttcacaagtcattaattactgaattataaagccctccctcttcctgagggcccaataatcatctcttcaactagagagcaggagtcctggaaacacacgcaagggacaggatccctgcgggaaaagtggcaagcacgcttagctggtccctgcccgagaagctcctgtgcagctctcactcaaacgttccatctcagaagctcagttgctggtgaacagggacatgtgagttcttagtaaggactaagctaccatcttctcacacaaataaatgacaaaatgaaacaaagagtctctgagtttatttgagaatgatgtatctgtaggattttagccaaaattctaacaatagaagcttggcagcaacactgccattagccgagacaacaatggcaggtactggcgctcacaagaaacgtgctggctctagcatacgtccagcctctcccaggctccatttctcactgagctggtttgcaagtctgctgaactgtaggctaaaaagaattagctaacagtttctcaaggaattcactctttattttgttaattgggatttagaaggtgacaatctcaactcatcttaaaccaatgctaaaaggttctctaaatctacaggagtcaatgtgtttctttttttttcttcctctttctttctttttcccttccactcgccctccctccctccctccctcccttcctcacttccttccttctctgtctttctctctcttctttttttttttttgagacagggtctcactctgtcacccagggctggagtgcaatggcatgataatggcctactgcaaccttgacctgggctcaagcaatcctcccacctcagcctctctagtagctgggattacaggtgcttgccaccatgaccagctaatttttgcattttttgtagagatggggttttgccatgttgcccaggcttgtctcaaactcctaggctcatatgatccacctgccttggcctcctgaaatgctaggattataggcataaaccaccaagcctggcccaatgtgtttcttagaataacagccacacagaatggagctcagtgcacctgtagttgcagctacttgggtggctgaagcaggagggctgcctgagcccgggagttcaaggctggggtacgctattaccatgcctgtgaatagccattgtactccagcctgggcaacactgcgagacccccatctcttaaaaaaaaaaaaaaaagccacacagaatgtatgtgaacaccaagcgtgaacactaccatgaactatggaccatcactctgggtaatgatgatgtgtccgtgtagtttcatgagctgtgataaatgcatcgctctggcggaaggtgccgaccatggggaagactatgcacgtggggccgggagcacctgggaactctctgtgtcttctgctcaattctgctgtgaacctaaaactgctctaaaaggtaaaatctattttaagaaaagccaatatcccttaaaacacttttgccccacaatgtgtttgaaacatgcaatttgactttactttccatgattttaataaaaaagacggccatggattatgggaaaaggtggttgagttatgctagatatgggcttttttttctctttttcacccagcattagatctaactgtgtactactgggaggaaatatataactaataagaaccagttaccaacactgttgtagtctagccgcaaataaagaataaaaggagttcaagaccagcccgaacaacacagcaaaactcttgtctctacaaaaaatacacacacaaaaattagccggtgtggtggcacacacctgtcatctcagctactcaggaggctgaggtgggagaatcacttgagcctaggaggtcaaggctgctgtgagccatgatcacaccactgcactccagtctgggtgacaaagtgagaccccgtctcaaaaaaaaaaaaaagtctgactctggctttagctttgtcatagatatactgatttaaccttcctgggctttgggtttttttaatataaagagactatctgtccttgggctacactcatggataacgtagagaggatgaacaaaagacggtctttaaaatgcttggaaagctcagacgcaggccaggtgcagtggctcatgcctgtaatcccggcacttcgggaggctaaaatgggcgggcagatcacctgaggtcgggacttcaagaccagcctggccaacgtggtgaaaccccatctctactaaaaatacaaaaatgagccaggtgtggttacacacacctgtaatccttgctacctgggagactgaggcatgagaatcacttgaatgcagtaaatggaggtggcagtgagctgggattgtatcactgcagcactccagcctgggtgacagagtgattctgtcttgaaataaaagctctgaactatccagaggctatacacactgtattgggagtgggaaattcattcaacaaatgtttcctctgtgtctgctatatcattaaggtagatactaccctgtctctatggaactatctatctagcaagtcagaaaataaaaatgatgatgggatatatacacagcacactgatacatgcgataccgactaggggaaaacgtggggtagaggaatcactgtaggtcaatctggtgtataagccttgagttggtggagaaggtagagatggcttgaggcaagaactacaccacggaaagtcccagagcaaagatgggggcagagggagcagctggtggggccactgtggggtacgaggatgatattagtcatctggtggggtctggaagtggcatcaaatccacaggacaacatggaaccattagagactggggaaccgatggtgaaaatttgattaaccacagaaccagtagagaactggcatctaccttgtcacatggcaaaattccaccgcaatcctctcagccatgcaccactcacgtggaaacatgcggccgtatttctcctcatagtccacaagctggcgttttatccaggcatagcgtctgtcgattttgtccagccaggcaacctggtgaaggtggagatcaaaagccaccccagtggttagaagtagaaatggcagttcaaggaaacaagcaaaaacacagagccaagcaaaagggaaccaacctctgtatttctcatggttttaaagaatctaggctacctttttaacttgattttttacttaaaaattcagaggtttttggctgggcgcagtggctcatgcctataatcccagcactttgggaggccgaggtcagcagatcacctgaggtcagttcgagaccagcctgaccaacatggagaaaccccgtccctactaaaaaatacaaaaattagcctggtgtggtgacaggcgcctgtaatcccagctacttgggagggggaggcaggagaattgcttgaacccgggaggcaaggttgcagtaaactgagatcgcaccactgcgttccagcctgggcaacaagagcgaaactccgtctcacacacacacacacacacacacaaaatccagaggtttttaacctggggtccatgattggccttcaggggtctatacatttccagaaactatatgcagaattttatgcacaggtgcatgtttctgaatttctccaaagggtcagtgacctcaaaatggttaagaactataaactcagcccctaggactcacagctcaacaaccaacactgtcagacagtcatgtaatacgaggtctaaattagtaggcttgacagcactcatgtttcaataaaattcaaatgttacatctgatcttatttggtcaatactcacatcttggttttcttgaaaaagtaccagatactctgacagatgctgtttaataaactttttgatgatttcctgtttgatcctgggatctagaatattagcaaccagacatgcatctcgtagaacattgctgggtcctcctggtctctagtaaaacaaacatgtaccaggtgaaaagccagaaacaacctttaaacctcatggcttctcacagccactacttgttatctctacgcattgtcagtcttactcctgctccttcacactcattctttctgctgtggctggatctgtcagttacctgctgctcctcgaggatggaatccttacactcgttttacagcaagcgacagaaaaactaccctgtgaatctgcaatgagatattttgggaaatgggcagtaatgatcacgggaaatttgactttctgcaaaccaaaactgaaagagatctaaaagtcagaatgccactggtctctgatgtcgcaagatgctgctgaagaggcctaagagtgggaatgccaccagcctctctcctaagagttggaatgccaccagcctcactccacatgtgccactcttccctgactccaacctctgggattcctgttcttaaagtgctatgtttttgccaaatagtgtggtctcccttaacacataaaaccaggttccaagccacgacatgtgtttcacaatagtgaactacctagaaaggcagccaaagagaaaatgctgtgatactggcctcctgacctgagcgaacactggaaagataccaggcgctgtactgacgcatcacgacgggaaggtctttgttaccaaaagcaattcaatgaccaaagttttgctgagactttctttacagtacgtcactgagtgaacatgactggctaagtggactacagtaaaaagaacacttggaatctactcctggcttggctaaaaagccatgcatgtagctttggagcacttgctcacctcatatgaaaaataatagactttaggtgataagtaaggttcttctaaatctttattttttgtcaactctttccaattccacccatctcaactgaagttccacgcttctaaagtgttatataagctgcctgagacctgagtttttaaaatgttgacttactccatgctgagtggtttttatgtcatctgctgaacaccctaacttctcaattctcacttcaggatgaaagtgacctgatagagaagtcatagatgccaaaacctatgggttcacgggttcagattttttcatttacaaagagtttactaggttgtgccttggaaaaatttttaaaaatcttaattcccacttgtgaaatggaaatagtaacacaaggcctttaagaaaagcccatagtctttaaaaagaaaactaggctgggagcggtggctcacgcctgtaatcccagcactttgggaggccaaggcaggcagatcatgaggtcaggagatcgagatccatcatggctaacatggtgaaaccccatctctactaaaaaaaaatacaaaaaaattagccaggcgtggtggcgggtgcctgtagtcctagctactcaggaggctgaggcaagagaatggcatgaactcggaaggtggagcttgcagtgagccgagatcgcaccacgacactccagcctgggcaacggagcaagactccatctcaaaaaaaagaaaagaaaagaaaactaaaaacaaaacaaaaaaaaaaccacacacacacacacacacacacacacacacacacacgaagtcactatgccagagaaaagggaggcatgttgttaaagagaaccattttaatttcatctgcccggtggaatctgggaaaaaaaatataaagcaggcctcttctaaacaataaagatgggcttcatccacatcttcctgaaacttctagaaactgaaatgagtggctgggcatggtggctcatgcctgtaatcccagcactttgggaggccgaggcgggcggatcacctgaggttgggagttcgaaaccatcctggccaacatggagaaaccccgtctctactaaaaatacaaaaattagccaggtgtggtggcaggtgcctgtaatcccagctatttgggaggctgaggcaggaatcacttgaacccagggggcggaggttgcagtgggctgagatcacaccattgcactctagcctgggccaaagagtgaaactccgtcaaaaaaaaaacaaacaaacaaacaaaaaaaaaaacctgaaacgggcagctgagtacacgtgaggctaaccttgtcctaagaagagcccagtgcttctcatgagcgaatatccccacaatcccttttcacttctttgaccttcattttcctcatgtaataaataggactaatggctttccaatatctactccctccctgcagttatatcagatgactaaggaatatgaggttctccaaggaaagtgctttacaaataagcatctgattactagcagacagccacaaaatgtgaagacattaaaatcaggagcgggcttcctatagaaagtgatgggcaaaagctggggccgctactcccacttacttcctacatttcttttatggaacacaaagaaaaaataattaagatatttccagttattgaattacagagcagatgcaggaaatgttccttggatcagtaaatgaatgtatgtccccatctctacccaccgagtagggtgaggctccttgcccctaagtgcttcagtatatttctgccttgaacaattctttctcttgaaatagctcaaacaatagagaaaaagtctcgtatgggttctttcctgtccgacacatgctaggcgctaagatggcatctgctacagttggaagggtggagctaaaagcagttccccaagcaggatggcagcttgttacatgagaagtgcaaccaacagctcccaagtgaaatgctgtgggctttgcagacacaacacaaacagctctgctaccagagagagctcaagggcatgaattccgaagagcaggcttatggtcagtaacagtgaggctcctcactatatcactctgagagttacataagatggtggatgctccacccagttgtcttttcaccaaaccaaaaccagtaagttatgtaacaatcctaaaaacaccgcggcatgaagatttcttttaaatacagccatgagaaaaaaggaattgacagggcatacaagatagacggtttgagacctacatcaaattaagcccaaacaaatcctctctttctgaggctggaaggaaacagaggaggaactgccaccacctagggacatttaaaatccagggtggtctcattaccctgaacctgcagcagaaggatttgcagctgccagcgagcatgactggaatgataaccacatggtgactggggtgagcgtgagctcggcaaggatggtgatcatctctaaagactggggaaacgcaaagcagtaccttggtgccctgggaaggaaacgcttcttcaaaatctgccaggatttgctgtcctaactcagtctgtgcagccttcactctgtgaggaagagagaacatatcatcacctggcatcatatccttatgtaactacacaccgatccacagggtcggaagggctgaagtctttcgagaaaggccaggaagggtacagagacgtccatgaggtgagaggtcacatactagttaagtgacaggttgatgagcaggacccaggcatccaagatattctcagggtgaatcttctatatccccaaaattcttctaggccaaccctttacctgaggtcatatgtattaatctttatacagttccactgggggatagtcatgctgtgggaaaatgttatagaatcacatccacatcaaatataaatctagctgggcgcagtggttcacgcctggaatcccagcatgtgggaagctgacgtgagagggtcgcttgagaccaggatttcaaaaccagcctgggcaacattagagagatccagtctccacgaaaaacaaactaaaataaaaagtacccaggtgcgggggcacacacctgtactcgggaggctgcggcgggaggatctcttgagcccaggacttttgaagatacactgagctatgatcacaccacagcactccagcctgggtgacagagggagaccttggctctaaaacaaaacactaacaaacaacaacaaataaatccactttggattactggtgtaactgctgtcctactccttggagtacagaatggcaagagggctccataatgttttagggtgttttgtaaaaaattattatgggtatataatcattatatatatatttatggggtacctgtgaagtcttgatacaggcatacgatgtataatgatcaaatcagggtaactgggttatcaatcaccccaagttatttgttacttctccgtgttaggaacattccaattccaatcttttagttatttttaaataaacaataaattattaaccgtagtcaccctattgttctaccaaatactagatcgtatcattctaactgtatttttgtgcccagtagccatcccagttactccccgcctccctgctatgcctcccagcctctgggacccagcgttctactcgctatctccatgagtttactttgaaaatgtttagcacccacatgagtgagaacatgaggaatctgtcttcccgtgtctggcttatttcatttcacatcacgtccagttcaatccatgcagctgcagtgttttgggtttcctgttaacccagaaaccaacaagctcgttaagtttttaaacaaataaatgaaaagaatgttttctaaggtaaaaacaaaaagagccaagtgacaaaatgaactgctaaatgatcactagtgagggccactgagtgaccatttaagttcagaagtttgtgaatatgaaaacggaactgcaaggaaaaccagctagaaaggggaggccagtactcaacagtggccgtgagtgtactaggagctcaagaactgtgcgtgtacttgaatgcaagggcagaaaggagaagcggctaggatggaaagcggctatggatcataccccacgatcaatcacgccccgcaatggatcaggccccgcaatcacgtcccgcaatcgatcacgccccacaatcgatcgcatgctgtgcatcccccacgagctgcctgatgttggtggccaccgtgcaccggccagccttgcagagagagagtggaacaagattctcaggccctgctgggcttcctgagcctgaggcaaatactgtctggttgctaaaaatgccttaaaagagcacacttccattctcggtctccaccctgttccttcagaattaactttatgaagtttctagaaatagcaacagctcaaaaccacaatttctttggctgctaaggagtgtctggcaacctgctgagattttttttcagatgaggggataggcatgacccaaaacaatctgttttttccgtggcgtggttacaattataccttattccaaatactttccaaggtttttccagtatcttcaaaacttttaaaaccactcttagaggtgggtttgtagccttttgagtcagttttcaaggaggccagaatgatccagacgaggctattactggaatagccgccacctccagattggaatcagggccatacgtctagagctgtccagcagacaatgggagacattccttcagcgtgaactttgacatgagagaaaagaataaaattgtacttcggagcttcttgtgatgcgcacacgaggaggcagcacacagcctgctgtggtgccaggtcacaggacagcttccagaggctcaggccccccctgttcctaccctcttcttggaagcacacacacagcaccagttccctcctaagccacagggaacttatagtaggaacttttcatggttagaagaggaaggagttctcctcacaggggaagtccagccgctagccagggcacccacagtcacattctcaggactactggccatctcaatgacactggtgggcccggctctgcccctggcccgaactatttgctactccatattcttggtgactctggaactgaggtggcagaaaggagagcctctggcccaaactattccctactctgaattcttggtgactctggaactgaggtggcagaaaggagaaccagagcctgtgacagcacctggtatcaccagagacaaaaaagaggaaaaattaccagtctctgatttgtagacttccttgccatgctcttcattttcatttttttacattaaattattatgtacaccttatttttttttattattatactttcagttttagggtacatgtgcacaatgtgcaggttcgttacatatgtatacatgtgccatgctgatgtgctgcacccattaactcatcatttacattagctatatctcctaatgctatccctcccccctccccccaccccacaacaggccccggtgtgtgatgttccccttcctgtgtccaagtgttctcattgttcaattcccacctatgagtgagaacatgcagtgtttggttttttgtccttgcaatagtttgctgagaatgatggtttccagcttcatctgtgtccctaaaagggacatgaactcatccttttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttataatcctttgggtatatacccagtaatggggtggctgggtcaaatggtatttctagttctagatccttgaggaatcgccacactgtcctccacaatggttgaactagtttacattaccaccaacagtgtaaaattgttcctatttctccacatcctctccagcatctgttgtttcctgactttttaatgatcaccattctaactggtgtgagatggtatctcattgtggttttgatttgcatttctctgatgaccagtgatggttagcattttttcatgtgtctgttggctgcataaatgtcttcttttgagaagcatctgttcatatccttcgcccacttcttgatggggttgtttgtttttttcttgtaaatttgtttgagttatttatagattctggatattagcccttcatcagatgagtagattgcaaaaattttctcccattctgtaggttgcctgttcactttgatcatagtttcttttgctgtgcagaagctctttagtttaattagatcccatttgtcaattttggcttttgttgccattgctttaagtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttccacgtatggctagccagttttcccagcaccatttattaaatagggaatcctttccccatttcttgtttttgtcaggtttgtcaaagatcagatggttgtagatgtgtggtattatttctgagggctctgttctgttccattgatctacatctctgttttggtaccagtaccatgctgttttggttactatagccttgtagtatagtttgaagtcaggtagcatgatgcctccagctttgttcttttggcttaagattgtcttggcaatgcgggaccttttttggttccatatgaactttaaagtagttttttccaattctgtgaagaaagtcattggtagcttgatggggatggcactgaatctataaattaccttgggcagtatggccattttcacgatattggttcttcctatccatgagcatggaatgttcttccatttgtttgtatactcttttatttcattgagcagtggtttgtagttctccttgaagaggtccttcacatcccttgtaagttggattcctaggattcccaaattcctagttggattttattctctttgtagcaattgtgaatgggagttccctcatgatttggctctctgtttgtctgttattggtgcataagaatgcttgtgatttttgcacactgattttgtctcctgagactttgctgaagttgcttatcagcttaaggagattttgggctgaaacgatggggttttctaaatatacaatcatgtcatctgcaaacagggacaatttgacttcctcttttcctaattgaataccctttatttctttctcctgcctgattgccttggccagatcttccaacactatgttgaataggaatggtgaaagagggcatccctgtcttgtgccagttttcaaagggaatgcttccagtttttgcccattcagtatgatattggctgtgggtttgtcatagatagctcttattattttgagataagtcccatcaatgcctaatttattgagagtttttagcatgaagggctgttgaattttgtcaaaggccttttctgcatctattgagataatcatgtggtttttgtctttggttctgtttatatgatgaattacattttttgatttgcatatgttgaaccagccttgcatcccagggatgaagcccacttgatcatggtggataagctttttgatgtgctgctggatttggtttgccagtattttactgaggatttttgtgccaatgttcatcagggatattggtctaaaattctctttttttgttgtgtctctgccaggctttggtatcaggatgatgctggtctcataaaatgagttagggaggattccctctttttctattgattggaatagtttcagaaggaatggtaccagctcctccttgtacctctggtagaattcggctgtgaatccatctggtcctggactttttttggttggtaggctattaattattgcctcaatttcagagcctgttattggtctattcagggattcaacttcttcctggtttagtcttgggagggtgtatgtgtccaggaatttatccatttcttctagattttgtagtttatttgcataggggtgtttatagtattttctgatggtagtttgtatttctgtgggatcagtggtgatatcccctttatcattttttattgcatctatttgattcttctctcttttcttctttattagtcttgctagcagtctatcaattttgttgatcctttcaaaaaaccagctcctggattcattgatttttttgaagggttttttgtgtctctatctccctcagttctgctctgatcttagttatttcttgacttctgcgagcttttgaatgtgtttgctcttgcttctacagttattttaattgtgatgttagggtgtcaattttagatcttttctgctttctcttgtgggcatttagtgttataaatttccctctacacactgctttaaatgtgtcccagagattctggtatgttgtatcttgttctcattggtttcaaagaacatcttcatgtctgccttcatttcattatgtatccagtagtcattcaggagcaggttgttcagtttccagtagttgagtggttttgagttagtttcttaaccctgagctctagtttgattgcactgtggtctgagagacagttcgttataatttctgttcttttacatttgctgaggaatgctttacttccaactatgtgatcaattttggaataagtgcgatgtggtgctgagaagaatgtatattctgttgatttggggtggagagttctgtagatgtctattaggtccgtttggtgcacagctagttcaattcctggatattcttgttaactttctgtctcattgatctgtctaatgttgacagtggggtgttaaagtctcccattactattgtgtgggagtctaagtctctttgtagtttctaaggacttgctttatgaatctgcgtactcctgtattgggtgcatatatatttaggatagttagctcttcttgttgaattgatccctttaccattaagtaatggccttctttgtctcttttgatctttgttggtttaaagtctcttttatgagagactaggattgcaacccctgcctttttttgttttccatttgcttggtagatcttcctccatccctttattttgagcctatgtgtgtctttgcacatgagatgggtctcctgaatacagcacaccgatgggtcttgactcttgagccaatttgccagtctgtgtcttttaattggagcatttagcccatatacatttaaggttaatattgttatgtgtgaatttgatcctgtcattataatgttagctggttattttgctcgttaattgatgcagtttcttcctagcatggatggtctttacaatttggcatgtttttgcagtggctagtaccggttgttcctttccatgtttagtgcttccttcaggagctcttgtagggcaggcctggtggtgaaaaaatctctcagcatttgcttgtctgtaaaggattttatttctccttcacttatgaagcttagtttggctggatatgaaattctgggttgaaaattcttttcttcaagaatgttgaatattggcccccactctcttctggcttatagagtttctgccgaaagatccgctgttagtctgatgggcttccctttgtgggtaacctgacctttctctctgactgcctttaacatttttttccttcatttcaactttggtgagtctgacagttatgtgtcttggaattgctcttctcgaggaatatctttgtggtgttctctgtatttcctgaatttgaatgttggcctgccttgctaggttggggaagttctcctgaataatatcctgcagagtgttttccaacttggttccattctccccatcactttcaggtacaccaataagacgtagatttggtcttttcacatagtcccgtatttcttggaggctttgttcatttctttttactctttattctctaaacttctcttcttgcttcatttcattcattcgatcttcaatcactgataccctttcttccagttgatcgaattggctactgaagcttgtgcgctcgtcaggtagttcttgtgccatggttttcagctccattaggtcatttaaggacttctctagactggttattctagttagccattcgtctaatcttttttcaaggtttttagcttctttgtgatgggttcaaacttcctcctttagctcagagaagtttgatcgtctgaagccttcttctctcaactcgtcaaagtcattctccgtccagctttgttccattgctggcgaggtgctttgttcctttggagggggagaggtgctctgatttttagaattttcagcttttctgctgttttttccccatctttggggttttatctacctttggtttttgatgatggtgacgtacagatggggttttggtgtggatgtcctttctgtttgttagttttccttctaacagtcaggaccctcagctgcaggtctgttggagtttgctggaggtccactccagatgctgtttgcctgggtatcagcagcggaggctgcagaatagcaaatactgctgaacagccaatgttgctgcctgacttcgtctcagaggggtacgtggctgtgtgaggtgtcagtctgcccctactggagggtgcctcccagttaggctactcgggggtcagggacccacttgaggaggcagtctgtccattcttagatctcaaattctgtgctgggagaaccactactctcttcaaagctgtcagacagggacatttaagtctgcagatgtttctgctgccttttgtttggctatgccctgcccccagaggtggagtctacagaggcaggcaggcctccttgagctgtgctgggctccatccagttccagcttcctggccactttgtttacctgctcaagcctcagcaatggcgggcgcccctctcccagccttgctgccgccttgcagtttgatctcagactgctgtgctagcaatgagcgagtctccgtgggtgtgggacccgccgagccaggcaccagatataatctcctggtgtgccatttgctaagactgttggaaaagtgcagtattagggtgggagtgacccaattttccaggtgccgtctgtcacacctttgcttgtctatgaaagggaattccctgaccccttgcgcttcccgggtgacgcgatgccctgccctgcttcagctcatgtttggtgggctgcacccactgtcctgcacccactgtccgacaagccccaatgagatgaacctggtaactcagttggaaatgcagaaatcacccgtcttctgcgtcgttcaagctgggagctgtagactagagctgttcctattcagccatcttagaactgcctatgtcgccatgttcttcattttcaaagtcacctcttgagataggctggacctggttatgttactagtgagccgcataatcacaagtcacttcctctctgtgggtcacaactttgaatagctgtgaaataagagggtggggctagcagcccatactagatgattctgtgtcctctccagtactgattattccacaacacccatcttacggtgctaactggctttacaggtggctagaggttagatgtatgcttaatcctggagcagaaggatacgcatataaatgtcaatgtttccaacagcagtttttttctttgttttttttttgagacgaagtctcactcttgtctcccaggctggagtgcaatgggataatctcggctcactgcaacctccgcctcctgggttgaagggattctcctgcctcagcttcccaagtagctgggattacaggcgcctgccaccacgcctggctaattttttgtatttttagtagagacagggtttcaccatgttggccaggctggtctccaactcctgatctcaggtgatccacccacctcggcctcccaaagtgctgggattacaggcgtgagtcactgcgcccagcctctaccaatagcagtttgtgaagtggctatcaatgactcagatgaaagcaactattcccttacagacatcactgatggtatctatagacccaaacctcaatcccatgcattttcagggtaagatgtgaatttcagtctttataagcaattgcttaaataggattctagaaagaagtcaacagacttgaaagaatttatctttggcctcattcctttaaactccttcctcttctaaccatgaaaaggttcccactacaaagaggtagctcaactgataactgtcagcaaagcacatatatgtgccaaactaccaagatttcctagtcattcctttcttttcagactggagtacagtggtgcatttgtggctcactgcagcctcaacctcccagggttaagtgatcctcccttctctcagcctcctgagtagctgggactataggtgtgcacctccatgcccagctaattcttgtattttttgtagagatggagttttgccatgttgcccaggctgatctcaaactcctgggctcaagcgatctgcccacttcagcctcccaaagtgctaggattacaggcatgagccactgtgcccaactgatttcctagccattcttgtgaaagtccgcctacaactcatagagaacagggaaaacaaaaattcctcctggcatccacgtaagttcagcctgttgcatggtggcaaccccaaatgggtcactcttcagaaacaaaagattcattgtgctgcccagaaaggaaagtcaaccaggtggtttctggcatcctccatgccacgtgactgcagggctgttccaaggcaccctttcctaaaagtgttctcagcttttcgtaagggggagtcacagacagacagcaaattatgaacattgttcagatatctgtggataaagtagccctgagacttttgttaccttgtgagtgacagtcccaaagaaaacacccccaacagttcccaaataaatataccgccctcccaaaccacagtcttctaaacagcagggttaattagtcaaatgctacagttccaaacagacaccataaagaatctcagcctagaatcttgagtgaccccatgagacacttctgagatcaccaaggacaacactcatacttggcaaccgaggacaacactcatacttggaaagcgaggacaacactcatacttggaaagcgaggacaacactcatacttggaaagcgaggaaaacactcatactcggaaaccgaggacaacactcatacttggaaagcgaggacaacactcatacttggcaactgaggacaacactcatacttggaaaccgaggacaacactcatacttggaaagcgaggacaacactcatacttggaaagcgaggacaacactcatacttggaaatcaaggacaacactcatacttggcaactgaggacaacactcatacttggcaactggggacaacactcatacttggaaagcgaggacaacactcatacttggaaagcgaggacaacactcatacttggcaaccgaggacaacactcatacttggcaaccgaggacaacactcatacttggaaagcgaggacaacactcatacttggaaagcgaggacaacactcatacttggaaatcaaggacaacactcatacttggaaagcgaggacaacactcatacttggaaagcgaggacaacactcatacttggaaatcgaggacaacactcatacttggaaatcgaggacaacactcatacttggcaaccgaggacaacactcatacttggcaaccgaggacaactctcatacttggaaagcgaggacaacactcatacttggaaagcgaggacaacactcatacttggaaagcgaggacaacactcatacttggaaatcaaggacaacactcatacttggcaactgaggacaacactcatacttggaaaccgaggacaacactcacacttggaaagcgaggacaacactcatacttggaaagcgaggacaacactcatacttggaaagcgaggacaacactcatacttggcaactgaggacaacactcatacttggaaaccgaggacaacactcatacttggaaagtgaggacaacactcatacttggaaagtgaggacaacactcatactgggaaaccgaggacaacactcatacttggcaactgaggacaacactcatacttggaaaccgaggacaacactcatacttggcaactgaggacaatactcatacttggaaagcgaggacaacactcatacttggaaagcgaggacaacactcatacttggaaatcaaggacaacactcatacttggaaatcaaggacaacactcatacttggcaactgaggacaacactcatacttggaaaccgaggacaacactcatacttggaaaccgaggacaacactcatacttggcaaccgaggacaacactcatacttggaaaccgaggacaacactcatacttggaaagcgaggacaacactcatacttggaaagcgaggacaacactcatacttggaaagtgaggacaacactcatacttggaaagtgaggacaacactcatacttggaaagcgaggacaacactcatacttggaaatcaaggacaacactcatacttggcaactgaggacaacactcatacttggaaaccgaggacaacactcatacgtgtcaacccaggaggcccaggaggaacttgtcgaggccatagagctgtgcaggcctgtccatttccaggttgagttcttttttcactccatcatgagacctgccaagcctttctcacatttataagaggttagaaatggctgtgaaaaatatattttcgttcaagagtttcatggttttcaagagaatgtaaggctcttccattcttcattgggagatactgactgatgactagaaacattccctttcacggatatgcttaggccaggaggatttgaaatgtaaagatgctaaagaaaaaactctttcctccaatgctacattaagcatggaagcatttgccagaagggtagttggaagaattagctatgctcaaatcaaggctcatgaacttcctatttcaaatgtacaggcaaagatttcagaacacaacttttcacatgacttctacactttacagacagcaagacagtaaatttgagaaacggaagcaatgcagagggtggtaacccgcctgccatctcccgccccttacaacaaatagctatttctctcatttccagatggttctaccatcagcacgtaaacataagggaagcaaattcaccagaaaggatgctaaaaataagaagtctggacttttctcaaacgtttagtacctcttaaaaaaacaatcctagtcaagcactgaaaataaaaataagaagttgtctcctcttgtgctctttttagtgttatttttttttttcccccgagacgggtctgctttcttgcccaggctggagtgcagtggcacagtctcggctcactgcagcctccacttccggagctcaagtgatcctcccatttcagcctcccaagtaactggaaccacaggcacacatcaccacaccagctcactttttgtatttttggtagagacagggtttcaccatgttgtccaggctggtcttgaactccagagctcaagcgatctgcctgtctcagcctaccaaagtgctgggactccaggtgtgagccaccatgcccagcctttttagtgttacttaatagcacatattctgtattaacctacacaaaattattgcaaatagagattgcgaaatgaactaaaagataagtaaatcctcctgtgtttgcagcaaccttatgtgataatgaatgtttggagcactgaaatatattcatagaatgttggactttctatttttcaggaatgtgattataacagtgattattaagttccttcaaatttttaaaactacctctttaaacaaatgttgaaaagcaaagagcccaccaaaagtacaggcagcaaaagcaaaaagaaacaagtgggactacatcaacctaaaaagcctgttggagaaatgcaggtggaaaccacaatgcagtgtcacttcacgtcctaacgggggcatcttttcatgtttattggccatttatttatcttctttggagaaatgcttattcaaatcctttgctggttttttaattgagttgtttggctttttgttgttgatttctgggaattctttatatattctagatattaatccattatcagataaatgatttggaaatattcttcccattctgtgcattgccattttaccctgctgatagtgttttttcatgcacaagttttaaaatttttcataaagtcccatttatctatgttttccttttgttgcctaggactttggtgtcatatccaagaaactgctgccaaatacagtggtgtgaagatctggtcttcgttttcttctaagagttttagaattaggttttacatctaggttacagatccattttgagttattaacgaatccctatgctggtttctgccaaataaaagttagttctgtcatgttcctgccatgcacaaccccttcctttataccgactggagataggctcccacacacatctccgtgaccgtgtggccactgcctcctaagggtcttatcttttctaatccatatcacggactggagactggctcttacacacatctccgtgaccgcgtggtctctgcctgataagggtcttatcttttctaattcataccacggactggagactggctcccacacacatctccgtgaccgtgtggccactgcctcctaagggtcttatcttttctaatccatatcacggactggagactggctcccacacacatctcggtgaccgcgtggcctctgcctgataagggtcttatcttttctaattcataccacggactggagactggctcttacacacatctcggtgaccgcgtggcctctgcctgataagggtcttatcttttctaattcataccacggactggagactggctcccacacacatctccgtgaccgtgtggcctctgcctgataagggtcttatcttttctaatccataccacggactggagatcggctcccacacacatctccatgaccgcgtggcctctgcctgataagggtcttattttttctaatccatactacggactggagatcggctcccacacacatctccgtgaccgtgtggccactgcctcctaagggtcttatcttttctaatccataccactgactggagattggctcccacacacatctccgtgaccgcgtggccactgcctcctaagggtcttatcttttctaatccgtatcacggactggagactggctcccacacacatctccgtgaccgcatggccactgcctcctaagggtcttatcttttctaatccacaccactgactggagatcggctcccacacacatctccgtgaccgcgtggccactgcctcctaagggtcttatcttttctaatccatatcacggactggagactggctcccacacacatctccgtgaccgcgtggccactgcctcctaagggtcttatcttttctaatccacaccactgactggagatcggctcccacacacatctccgtgaccgcgtggccactgcctcctaagggtcttatcttttctaatccatatcacggactggagatcggctcccacacacatctccgtgaccgcgtggccactgcctcctaagggtcttattttatccagactcctgtacctctataatccactagacttttacaaaatacaagtgagatcatgccccccgcacttaaaatctttcactgtccacaaaataaaaaataaattatttagcaaggcatataaaacctgacccgatctacctatgcagccctgtctccctctgctgcctccaaactccatgagactccctcttccttctttcccccattactgtcacgttggtaagatcccacccattcttttaagattcagattaaaacagaatttgtctatgacccctgccctcagcccctgcttcagcctatcaattcctcttctgagatcctgctatgccttgtacagcatataccagttttgttacatctgttatactggaatcttctattaatgtctttcttctccatacaaaaatggtgaactctttgaaggcagagagtgtgtatttcttatctttgtgccttcagtccccagcacggggcctaggatgtagaaaatgcagagtaaatatctatcatgcaaatgaagaaaagaacaaatgaatatgaaagagatcaactctgaatcatcctgagagcaggggtagaagggactgccttcctcctcccccatccgctgacagcaaatctgcctgctccatccaggctccttctttcttgcagctcataaagtcctgttcgcctgctttcttggctgcctcacagtccagtctgataaggtgatcagctggctctaggtgtgaggggtaggaaggatgagggaaagggtggcgatttccctagcgttctgccaagctcggcaagatgcacactgagcacacgttgcaacctcccattcctgccccggagcgtcagaaataataaaaagattttcatgaaaatccaaatccagacaagaaaagtggtatactagaagcctgaggacttcctggtaggaaggatgacagaaaatcactgcccaaaaatgcttctcgaaaatgaaagacatgaaggtggcgataccaggagcaggatggggccgctgtccgtgtctgcacccacaccgtgaatgcgtgaatgctcacgtcaggcggcaggggtgggcctctgggtctgagaacttcagcagtagccagaggggcggccaacacccaagaagaccagggagcctccaagcctaggagatcagctgctgggacacccacctggcaggtttctccaggtctggcccccctcactttggaaaagctgtctgtgatacacttagccaagtagcaattcccatttctcgcccacgagcaggtagcagtaaaagagcattcttgatcagactaatagagaatgtcaaaaataaaaataaggccgggcacggtggctcacacctgtcatcccagcactttgggagactgagacaggtggatcacttgaggtgtcaagagttcgagaccagcctggccaacatggtgaaaccctgtctctactaaaaatacaaaacttagctgggcatgggtggtgggcgcctgtagtcccagctacttgggaggctgaggcaggagaattgcttaaacccaggaggcggcgattgcagtgagctgagattgtgccactgcactccagcctgggcgatggagtgagacttggtctcaaaaaataaacaaataaaataaaaatgaggtttcagctaagaatcactaaacatttgagaaatgctaaagagaaagaattgccatgctgaacaaactgaagatcttacactggaggacagaggaatggaacaggcactgaagatcttacactggaggacagaggaatggaacaggcactgaagatcttacactataggacagaggaatggaacaggcactgaagatcttacactggaggacagaggaatggaacaggtaatgaagatcttacactggaggacagaggaatggtacaggcactgaagatcttacactggaggacagaggaatggaacaggcactaagatcttacactataggacagaggaatggaacaggcactgaagatcttacactggaggacagaggaatggaacaggcaatgaagatcttacactagaggacagaggaatgaacaggcaatgaaaatcttacactggaggacagaggaatggaacaggcactgaagatcttacactggaggacagaggaatggaacaggcactgaagatcttacactggaggacagaggaatggaacaggcactgaagatcttacactggaggacagaggaatggaacaggcaccgaagatcttacactggaggacagaggaatggaacaggcaccgaagatcttacactagaggacagaggaatggaacaggcaccgaagatcttacactggaggacagaggaatggaacaggcaccgaagatcttacactggaggacagaggaatggaacaggcaccgaagatcttacactggaggacagaggaatggaacaggcaccgaagatcttacactggaggacagaggaatggaacaggcaatgaagatcttacactggaggacagaggaatggaacaggcactgaagatcttacactggaggacagaggaatggaacaggcactgaagatcttacactggaggacagaggaatggaacaggcactgaagatcttacactggaggacagaggaatggaacaggcactgaagatcttacagtggaggacagaggaatggaacaggcactgaagagcttacacttgaggacagagaaatggaacaggcactgaagatcttacactggaggacagaggaatggaacacgcactgaagatcttacactggaggacagaggaatggaacaggcactgaagattgtacactgtaggacagagaaatggaacaggcaacccagtgctttaacaaacacataatttctattccgtgggagagacatgagaatattatgcccatgagaaaagaatcagctagatatgctggaaattaaaaagctggatttttaaaataaaaattcaacagctgggccaaatagcacaatggatgcaagtgaagaataaattaaaataggaagactgggttgaggaattctttcagaaagcagttcaaaaggacaaagagacagaaagcatgaaaggaaaattaagagacatggcagcagatctagaagatccaacgttcacgtaacaagaattccacaaggaaagaatgcagagaccaagttgtagagactactcaaagaaaggaataaaggagaataatttcttagagtatgagaaactcatgagtgtttagaggaagaagacaactggggctaggtacagtggctcacgcttgtaatcccagcactttgggaggatgaggcaggaggatcacttgagcccaggagttgaagaccaacctgggcaacataagaagatcccacctctacagaaaaatgttaaaaatcagccaggcatggtggtatttgcctgtattcctggctactcaggaggtggaggcaggaggatggtttgagcccaggagttccaggttgcagtgagctatgaccacgccactgcactccagcctgggcaacacagcaagactccgtctcaaaaaaacaaaacaaaacactaatcttactagctacaaggaaaatgaaaattaaaggaaccggataccgttttcaaccataagatagataaaaatgaaaaacaacaatatcaagtgttgctgagggtaagggtgctctcatacagtacagatcgtactacaagtatataaagctttgctggagggcaaatgggcagtagctactaaaattttaaatgtatacaaacctataacccagaatctgtcccagagaaatacttgcatatgtgcaaaagggggcatattttaagaattagaaacaacgacctagtgctaccaaaatggtgaaataatctgtggtatgtcacgctatggggttctgtgcatcaattccagagaatgaagcaggtttatacatactgatgagaaaaaaaatatctaaaatacatgtggttgaaaacaaaaagcagtttttagaataaagcgtaaggcatgaaaccatttagttaaaacaaaacaaagcaaaaacaaagccattaactgaaactatagatttatataaatacacacacaaatccggagagataggattaaaactatagatttatgtaaatacacacacaaatccagagcgatagccactgaaactacagatttatgtaaatacacacacacaaatccggagcgatagccattaaactacagatttacgtaaatacacacacacaaatccgcagtgatagccattaaactgataacaattaccacctctgaggacaacaatgggattctgaagtctaggtaaagggaacttaggtttcacctgtatacatatttgacctttttaaacaatagaagatgtggaaccaggtgcagtggctcacgcctgtaaccccgatgcactgggagcccaagaccagccctgggccacagagtgagaccctgtctctacaaaaaagtaacaaagttagttgggtgaggtgctgcgtgcttgtagtcccagctgcttgggaaactgtggtgggaggatcacttgagcccaggagttccaagctgcagtgagcagtaattctgccactacactccatcctgggtgacagagtgagaccctgtctctattttttaaagtctatgtgtattacttatataattacaaataaggaaacttaaggaaaacaaagaagcctgtagcattcgggccttattaagaaggcagagtcagaaacgtagctgctgctcagtaacaacgccttcatttcttctttgctgcaaggaaggttagaatttgtcaattgtgacggtctctgccttctcagtgttcttcctgcccctccttctaacagaaaaggtggtgcatcaactcctcctcgtcctcccttggaatcctcatcctccttcgctctgagaaattactttcctttccactggatctgaatctgggattaaaactcaacagcaataagaaggaaagaataaggttggggggaaagtcatctttttatcgtatctaaagtttttgtggttcactgtatttttttttttttttgagtctcaccctgtcgcccaggctagagtacaatggcaggatctcagctcactgcaacctccacttcccaggttcaagtgactcctgcctcagcttcccgagtagctgggattacaggcacctgccaccatgtccagataatttttgtatttttagtagagacggggtttcgccatgttggccaggctggcctcgaactcctgacctcgggtgatccacccgcctcggcctcccaaagtgctgggattacaggtgtgagccaccatacccggccgtggctcactgtattttctaaagaccgccacagcaatctatcccatcccacatgctttttgtaacaatgtgactttgacattcctcccgttagtgggtgggagaagactatgttccttcctcttgaatcttagcagccttgtgactatggcagaagtgatgctatgaaatttccaaggcttggttctcttgggacgctcattcttggaaccagccaccttaccgtgaggaagtccaagcagcccgtggaagacaacaaagaatcccagcaacggcctggccaagctcccagctgacagcaagcaccaaggagccagccatgagagtgagccaatgcattctccagtcccctcctgagctgcctcggctaatgctgcacggagcagggatgagctggtccccgagccaggccaaattatacgtgcaaaacaattattgttttaagctactaagttttgtgctggtttgttacaaagaaatagatacctagaacagtttctctcacaaatggggacaactgagagttgtccatatatacaactgtaactatctaccacaggcagctttggaagacatgggaaggggtaaagtgggggaacgtctgcaccagacagttagatcaggtagcatctgatattccttcacacactaagactctgcagtgaacacgctgagctaagtgcttaagcacttcctagcaccaggtccttttctgaaagcaagatcacttcttccggtgacagtttaccttttggaaagtttagctgccggatctgcggaatccccatatactttccctccagtgacagtttacctttcggaaagctgccggatctgtggaatccccatatactttccctccggtgacagtttaccttttggaaagctgccggatctgcggaatccccatatactttccctctggtgacagtttacctttcggaaagctgccggatctgcggaatccccatatactttccctctggtgacagtttacctttcggaaagctgccggatctgcggaatccccatatacttgtggaagtgctccaggacattcatcacaccctgaaggagattagcaacttctccgtattgtcttcgcctggtcatggctctgcaaggaaagaataagtttaaaagtctagaaaaacactaaagacgcaagatacagacacagaacaacccacgctagctctcaaacagatatcaactcagctgaatcaacgttcgctgagcactgagtatataagctgctgtgcgttgtgggaggaaaaaacaggatctggtccaaatcctcaaggtgacaccatatagtaagggagagagtcaagtacacatctaactagtatcaaaaaggatgaactatgttctaaacagaagtacaaattatgtgctacggcaggaagaatgtgtgagtgatgaattctcatttggtgtggggaggggaatctgggaagacgatgaatttagaatttgggttggatattatgggattagcaagcttgggacagagaaccggggtagggatgttactatctgaggattacagcctatgagcaaaccaaacacaaagggtgcggccaggcgcggtggctcagcctgtcatccccgcgctgtgggaggccgaggtggctcacgcctgtcatacccacactgtgggaggccgaggcgggcagatcacgaagtcacgagatcgagatcatcctggccaacacggtgaaacaccgtctctactaaaaatacacaaaattagctgggcgtggtggtggatgcctgtaatcccagctactcgggaggctgaggcaagagactcacttgaacctgggaggcggaggtttcagtgacccgagatcgtgccactgcactccagccagggtgacagtgggagactccgtctcaaaaacaaaaacaaaaatacacaaagagcagcactttacctattaactgaaatctgtaggttctaaggcgtctgtatcacagacctctactttccctactgctaaggttaatgacgcttaaataaaaggatgctgataaaatcaagttacacacagggaggaaatataaactattagatctaaatttttcattagggttgggttatttcattaaatttgtaatttatgattttccataagaagcattgaaaaagacaggattggccgggcgcggtggctcaagcctgtaatcccagcactttgggaggccgaggcgggcagatcacaaggtcaggagatcgagaccatcctggctaacacggcgaaaccccgtctctactaaaaatacaaaaattaaccgggcttagtggcgggcgcctgtagtcccagctactcgggaggctgaggcaggagaatggcgggaacccgggaggcggagcttgcagtgagcctagatcgcgccactgcactccagcctgggcgacagagccagactccaactcaaaaaaaaaaaaaaaaaagaaaaaagaaaaagacaggatcaagttcaagccaaggtgttccgttgctaccaccacctggttttaccaccgcctggtcttaccaccgcccagtcttaccactgcctggtctgatggtttggtggacaccgaccaccccacgaaggaacaaatgtgaccgccctctggcctccctctggccgctgctctcactgctcacaggagagtggaccaggcatccctggagctcatccaatacctagagaggtcaggaaggggcccgcccctcctcctctttccctcaaggcactctcccacttcccccacccaggactttgaatgctgcatctcagtttctatgacgatgcgctttccctgtccacatacggaatcacactgaggctggagcagggggagtccccagcctgagacgggccacagaggtgagctggagtgtcagaatcttgctagtaaaggaggctttagattgctcctttgtagtaaatcaccagctcttccttctctatttctaatgttctgatgtatcattccctctacaagccaaacggaaatctactttataaaaaaaagtggtttgaatgattgagttctgtctcatagggtctcttccatgacagtgcaactcagcccaacgcaagcaggaaacctgctgaggcagaagcagcagggagtgaatatgggcctgtgtcactctgtctgcctggagtgaatatgggcccgcgtcactctgtctgcctggagtgcatatgggcctgtgtcactctgtctgcctggagtgaatatggccctgtgtcactctgtctgccttgatggtacagagccacagcctgaagatgggccatattcttggagtcgtcctgaaaggcttctggggtccccttttgactagctgccagtgtttgttaggttctgaacaccagagggcacaaagcaaaaatggtgactgaacacttgaagccaatttgcagaaagtggggcaggatggtgagactttcctggctgagaagtaaataggcgacaacaccattttctctatgcgatacatttcccgtggccccaaaagagaaagttggcattgcttactcgagggagtcgacacctcctgccagcatgtgcaggtggttcagtgtggtgattgaggtggtcaggtggcgtttggcgtgatctaattgcttaatatcacgggtgatttctttcacctaaacattgaaaaaccacaagaaagaaaggaagacggtcaagaaagatgtaaaacacttctgcaagtagctctgtaagaaacgaatgcagatgaagcagggaaaaatctcaggttagcaaacattctcacaatacaaaataaaaataatttccaaccaggcatttaaaatttaatgtggcatctctttggactttactcagggttataaaaccttcagttgtgagcatgaaatgaactttatttttttaccccaaatgaaatgatccaaacagcaattcagtattgagcacacaggacagaggaggtaagcacagcacctttccttgaacaaggtgaggaaagtgtgccttctggtgatgaagccgctgggccatataaaacacctatcagtcagtactaggtactcagacggtctttactaatggaatgagggcctgagcttccagcaaagaagactttcaaatctcaagaagattgaaatataagctctgtaacatacgcttaacatgtaagttactaggagggcaggagcagtcttcagggagtgagaaggcaatttggggagtaagagcctgacagtgttgtttcagcaggtccaagagaagagaagctgtctctgggaatgcaagtatatttcagtcaccagaaaagcatattcaatagagaagttggaaaaattccccaactttactaacacccaggtgaaatcatccactgtgtttcttggtccatgctgactaagaaatgtgtgtgtgtgtgtgtgtgtgtgtgtgtgttttatcatgccacattatttttaattacgtacaaagatctaacatgtcacccacggaccatttcacccgctgctctgtttggccgccagtctcttgtctctctcttcagcaatggtgaggcggataccctttcctcggggaagagaaatccatcgtttgttgcccttgccaatagtgaaaatgttggaaacttgagtgccaaagctgttgccactggtgtctttcacatgaaccacgtcagaagatcccgggtacctctctctgttggggatcacaccaactcttcccaggtgagcacctccagtcaccatatatggcttgccagtgtcgaacgtgatgaaatcggtcatcttgccagtctccaaatcaatctgaatggtgtcattcaccttgatgaggggtcagggtagcggatggtgcgagcatcatgagtcaccagatgagggattccttttgtgcccacaaagatttttctcactttgcacaacttgtacttggtctcctcaggtgtacagcaaagcaacctttggtgtcacggatcagatggaaattctctcctgtcttgtcaatgctgatgacatccatgaacccagcagggtatgttatatcagttcggaccgtgccatcgatcttaatgaaccgctgcatgcaaatcttcttaagtctgttccttaggaaaatgatgaggggaagacactctctcaacttgtggggactggtggacggacgaggagcaaacacaccggtcaatttatccagcatccaatgctttggagctgctacccgcttcagatgcttcttggcaccacgagccatggctgcattaggcaaggaaaagaggacctttgtcttccggtgcacatagcgaaagtttcttaatagcaatttggttgcccaggttctgtgatacctggaaggaagggagtgccctggataccaaacacaaatactgtagtcactggatagatacatcccattaaagtgagtaacttggccatgagttcatggatagatacgtcctcattaaagtgagaaacttggccgtgagtttgtggatagatacatcctcattaaagtgagaaactcggccgttgaggtcgtggatagatatatcctcattaaagtgagaaactcggcagggagttcgtggatagatacatcccactaaagtgagaaactcggccgtgagttcttggatagatacatcgcactaaagtgagaaactcggcagggagttcgtggatagatacatcccactaaagtgagatactcggccgtgagttcgtggatagatacatcccactaaagtgagaaactcggcagggagttcgtggatagatacatcccactaaagtgagatactcggccgtgagttcgtggatagatacatcccactaaagtgagaaactcggcagggagttcgtggatagttacatcccactaaagtgagaaactcagcagggagttcgtggatagatacatcccattgaagtgagacactcggccgtgagttcgtggatagataacatcccactaaagtgagaaactcggccgtgagttcgtggatagatacatcccactgaagtgagacactcggccgtgagttcgtggatagatacatcccactgaagtgagaaactcggccgtgagttcgtggatagatacatcccactgaagtgagaaactcggccgtgagttcgtggatagatacatcccactgaagtgagaaacttggccgtgagttcgtggatagatacatcccactgaagtgagaaactcggcagggagttcgtggatagatacatcccaccaaagtgagaaacttggccgtgagttcttggatagatacatcgcactaaagtgagaaactcggcagggagttcgtgggtagatacatcccactaaagtgagatactcggccgtgagttcgtggatagatacatcccactgaagtgagacactcggccgtgagttcgtggatagatacatcccactgaagtgagacactcggccgtgagttcgtggatagatacatcccactgaagtgagaaactcggccgtgagttcgtggatagatacatcccactgaagtgagacactcggccgtgagttcgtgtgccctgctctttcagggtctgatcaccctaggtgaactcatacaggttacgacctgcacagctcaattccacacctatgatcctgcaagccttacctggatcttagctataaaaagcctctttcatggggacttccccatcaagccttctctcctgtaacctccaaacaatctctgtttccaatgaattaaaaaaaaaaaaaaaggttaagaccaccaccactttaccaaatacttaaatttggggcaaaaaaaataaaaataaataaatcaggagtggtataataaattagatatagaaggctgaagattggccctgtaacctgatcacccacttgcaactctgaaatcagcatcctttttcctacaaaaaaatctctgtatctcttccagcgtttttagcttcagtctaacatagggagtctttatttatttatttatttttttattttttgagatagagtttcgctctgtcgcccaggctgtactgcagtagtgcgatcttggttcactgcagcctccacttcccaggcaagcgattctctgcctcagcctccagagtagctgggattacaggtgtgctccacgacgcctggttaatttttgtatttttagtagagacacggttttgccatgttggccaggctggtcttgaactcctggcctcaagtgatcccccctccttggcctcccaaactgctgggattacaggcatgagccaccgtgcccggctgcatcaggggtctttaaccactgtgttcaaagtcacatcatctatgactcttcctggtccctgcatcaagtcctaaatattctccctctgcttcatctcaagactctatcccttctctctatgtcctaaatattctccctctgcttcatctcaagactctatcccttctctctatgtcctaaatattctccctctgcttcatctcaagactctatcccttctctctactccttgttcaggccctcactgctctgcactggagctgactggtctctttattcccaggatctcccgtcactccccatcccacagcctgtgtttctctagacaaactgaaccactgatttttccctaaacaaagccatcaatggcagggcacaccaggggtactcaggtcaaacctacacgagatcatctgcgagacagaaggcccatggttgattcgcctcaactgacttacacgagaccacctgtgagacagaatgcccatagttgatttgcctcaactgttgcccacgggctgcgaaaacgggtagagcatgaaatgggaggttgtagagtcagacagatctagggctgaaccccagctctaccactcaccaacgatgcatcctagaacaagtttctcagcctcactgagtctcagttttctcatctataagatgggtaatcgcaaagataataatgaacataaatcctagttcataaggttgtggtgagggctaaattagagtgctgacacaaaggaaccagcacactgctggcactgaaagagctcaacaaagatcacttctcccctcactcccacctcttcctcccttcagcacagcactgtccaggaaagcaagctgctttaaaataagacatctcataacttgggagtaaactgtcactgcaaaccccctcggttggaagaggaagcatactccagaacacagattagcatcataaggatatcaataaatgcaatcaactccagcaaaagcagcatcggatactctcgctgatcttcacgctttgagggcccctggtgctgctgggtgtggtgcacccttggggaaggacgagggcccctgggtgctgctgggtgtggtgcatccttggtgaaggacgagggcccctgggtgctgctgggtgtggtgcacccttggggaaggaccacagaaaatccaggtccctaggactatgctcagtgctcttcatacgtttaattctcacaacaaccctgtgaggcaaatgccattattcttattttacagttgaagaagctggaattctgagacaactgacagacaggacattattgagtctgaatctgaacccaggatccagcacttcccagcgcctcccatggaggaggagaaggtgaatgctggattctcggtcttcggggcaagcttctgagcacaacaccgggggacacaaatttgtcaggggagaactcaaccaaaaccacatacacagatcatgggcggggacatccctcctccctccatccctccctcctcccggctccaggaccattctcagcgtgcatcgagctacataccgtacatctcgatggagaaatgcatgataccaataccaagaaatgttagagaaaggaaaatccaaaatgactaggaaactattttcagaaaggagaaaaaaaaaagttgcagctgggcacagtggctcacacctgtaatcccagcactttgggaggccgaggcgggcggatcatgaggtcaagagattgagaccatcctggccaacatggtgaaaccctttctctactaaaaatacaaaaaattagccgggcgtggtggcaggcgcctgtaatcccagctacttgggcggctgaggcaggggaatcgcttgaacctgggaggcggaggttgcagtgagccaagatcgcaccactgcactccaaggctggcgacagagcaagactccatctcaaaaaaaaaaaaaaaaatacccaaaaaacaaaacaaaacaaaacaaaaaagttgcctatttaaaactagggctgcaaacacagggcagcagagatggtgagccaccactgaccagcagctccccttgaattgatctgaacgcattcatagggggcttgctttagagatgcagatgactctggttggcaggaggtgccattattagaaaaagctcattattagaatgcctagatgagaagctcacttcctcttttggtgcaaaaaggttaggaagaaaccagaactcaccatttgctctgatttttcagctttgtctttgatatctttgattttgccaaagagttgttggatagctttctgagcctcttcaagcgcctagagtaagggaaatacatgaaaaacaaaaagtggctagagacagctccagtcactaactgtaatcaatgctaggcacaaaagaaatttccatgaagctctcctgattcattgtacttatgccaacaatttttctggaccaaaatagtagagacctatagagtccagtggctgcgaacaggtaaacactcgggactcttaccaatgttcctcacaaagtttcaacttaaaactaaatgattcccctctacctcagtcattactgtacatgttattgataacagcaaataggacaagtagatctctgtgtgtgggtgtatgcaaagactcacacagagggacaggggtagctctaaattggggcaagggaaagctctggacttggaagttccagattgtgcattcaaaaaaacctgaaccgtgaatggggactccagaactgcaacaaatcttaaagactttcatagtaagccatttgaaaaccaatgaaatgcacttagaaaggaacactgggccggacacagtggctcacgcctgtaatcccagcactttgggaggccaaggcgggcagatcacgaggtcaggagatcaagaccatcctggctaacacggtgaaaccccatctctactaaaaatacaaaaaactagccaggcacagtggcacgcacctgtagtcccagctactcaggaagctgaggcagaagaattgcttgaacccgggaggcagagcttgcagtgagccgaaattgcgccactgcactccagcctgggtgacagagcgagactccaaaaggaaagaaaagaaaagaaagagaaagaatgaaagaagaagggagagaaagagagacaaagaaagagaaagaaagaaagaaagaaagagaaagaaagaaaaaaagaaagagaaagaaagaaaaaaagaaagaaagagaaagagaaagaaaggaaggaaggaaggaaggaaggaaggaaggaaggaacgaaggaaggaaggaaggaaggcaggcaggcaggcaggcaggcaggcaggcagaaagctaatggtggctcacacctgtaatcccagcacttcagaggctgaggcaggaggattgcttgagcccaggagttcaagactagcctggggaacatggcaagactcggtctctgcaaaaaaaaaagttagccaggcatggtggcgcacaccagtagtctcagctacttgggaggctgaggtgggaagattacttgagcctgggaggtcaaggctgcagtgaactgtgatcatgccactgcactccagcctggtgactgagcgagatcttgtctcaaaaaaacaagcaaaaagctaatggtgagcccagcatttccactgaaataaaaacctacaaggacagatgctacacaatgaaagtattacaacacagctgcagcttctgctaggaggggaagcaacatgagggcagttgtgacatgtggagaccagaaagttcctgtgagtgccagcaggccacagacgtgtacagaccaaatgcactggaccgtccgtgagtaaagactacccacagctaaagtacctgtgagtgccagcagcccacagacgtgtatcgaccacatgcactggaccatccgtgagtaaagactacctacagctaaagtacctgtgagtgccagcagcccacagacgtgtatagaccacaggcactggaccgtccgtgagtaaagactacctacagctaaagtgtctgtgagcgtgtcagcaggccacggatgtgtatagaccacatgcactggactgtccgtgactaaagactatgaattcctgaggcagttatagttctaggcacgagtcagcatctccttaattcactccttcaatcactcaatgagtatttactgaatgcctcccatataccaggcatgattctaggcattgggaatccaatggtaaacaagacagtatggtctctctctctgtcctcaaggaatgaacttactttgagaagtaagggggaggagatcctggaaaaacaacaaaataaagaaacaagataattcctaagtgtggtgaattgacaggtgtggtgaaggacttatgcagtgatgagaataagggagatggtggtcacagaaggtctcctgagaaagggcacacaaatcgggacctgcaggatgaggaggtgtgagaatttgtagatttggagtaagatgattttttttttcttgagatggagtctcactctgttgcccaggctagagttaagtggcgtgatctcagctcactgcaacctctgcctcccaggttcaagcaattctcctgcctcagcctcccgagtagctgggactacaggcacctgccaccacacctggctaattttttgtatttttagtagagacggggtttcaccgtgttggccaggatggtctcgatctcctgacctcgtgatctgcccgcctcggcctcccaaagtgctgggattacagacgtgagccgccgcgcccagcctggagtaagaggattttcagcagagagaaaagcaaatgtgaagatcctgacagagaaaagacctcggtgttttggaggtccgaaaagacagacagtaggtggtagtgcaatattgcagcgggaagtgtctggaaataatctggagaggtgggcacgagccagagcacggaggcctcaaagcataaggattctgctctaagtgccaatgagaagccactgaagggtctaaacaagggacagatgtatggcttacttgtataagactgtcctggctgctgtgtggcaaaggggctgtgcaggggcaggagggaaagcgggagtgaaagctctgtgagaagttgctgcagtgtccacgagacggtggaggcctagaagaggcagccggtgctgacgggaagacgccgagcgattcagggtttccaggaaggtacaatgtgtaggactcactgatggactgtgtgtgggtgatgagggagagggagaaccaaggatgacgcccgggttttggttgaaaagccaaggccagggttcactgtctgaaccagggaatgcaggaggaggacgggcttgacaggcaggtgtgtgtggtggtggcggggctggaagtgaagagtcccatctgcaatacgttacgggtgcctgtgctatggctggaatgcatccccaaagttcatgtgttggaaacataatccccaatgcaatggtgttggcaggtggggcctttacgaggtgaccaggtcatgaggggtttgccctcacgaacaaatgaatggcattatctcgggagtgggttcttgataaaaggatctgttcagccactttctcgtgcatgcacacactttcttgccttccaactctgccatgggacgacgcagtgagaaggccctcgccgcaggacgacatggtgagaaggcgctcgccgcgggacgacgcagtgagaaagccctcgccgcgggaagatgcggtaagaagcccttgcctgatgtgggccccttgaccttggacttcccagcctccagaattataagaaatctcttttctttataaatgattcagtctgtactattctgttacagtaacataaaacagactaagaaaactggtatcaagaagtgggctactgctatagtaaatacctgaaaacatggctttggagctgggtgatggacagatgtggaacagtcttgaagtgaaggctggaaaaagcctgtattgctgtgaacagagtgctaagggggattctgctaagggctcagaagaaaagcagaaatgtagagaaagtctggaacttcttagaaattacttcatggttgtgaccggagtgttggtagaaatacagacagtaagctgggcatggtggctcacgcctgtcatcccagtactttgggagcctgaggcgggcggatcgcctgaggtcaagagttcaagacagcctggccaacatggtgaaaccccgtctctactaaaaatacaaaaattagatgggcgtggtggcgggcacctgtcatcccagctactcgggaggctgaggcaggagaatcacttaaacccaggaggcggaggttgcagtgagctgagatagcaccactgcactccaacctgggtaataagagcaaaactctgtcccgaccaaaaaaaaagatagcttacttgagatcaagtagagacattaagttggacataagattctggagcttggaagagaggtgataggttgggatttaaattcagaagtcattactttagagatgatatgtaagtctgtaagattagaagtcacctaggaagacagaatacacaagagaagaaaagatggcacagggctgacccttgggcatgccaatattcagaagtctaaaataaaaaaaagcagagatgcagagaaaaaccaccagtgacatgagaaaaaatcagggacgatgggtgttacagaagccaaacagaagtgtttgaaggagaaggaaagagtgattgtgccttctgttgttaaacactcatgtaagaggctgggcgcagtggctcaggcctataatcccagcactttgggaggccagggcgggtggatgacctgaggtcaggagttcaagaccagcctgaccaatatgatgaaaccctgtctctactcaaaatacaaaaattagccgggcgtggtggcaggcgcctgtaatcccagctactcaggaggctgagacaggataatcgcgtgaacccaggaggcagaggttgcagtgagccaagatcgtgccactgcactccagcctgggcaacaagagcaaaactccatctcaaaacaacaacaacaacaaaaaactcatgtggatcatgaggtcaagagtttgtgaccagcctgaccaacatggtgaaacccctgtctctactaaaaatacaaaaattagccaggcatggtggtgtgcacctgtaatcccagctactcaggaggctgaggtaggagaattgcttgaacccaggaaacggaagctgcagtgagccaagatggtgccattgcactccagcctaggcgacagagcaagactccatctcaaaaaaaaaaatgaagacagctgctactgattttgacaacagggaagttgttggtgaccttgacaagagcagtctcaatgcagtcaagggaatggacagcgatgacatgaagtagaggctgtgatcacagagcaggccacaaatgatggcctgtgggctgaagccagtctgccacgtctgccacctgtttttgtaaacaatgtgtttttggaccgaaactcattaataatacttaaaccaaactcatttgtttaagtattgtttatggggacttttgccacacaatggcagagataaatagttacaacagagaccatatggtcagtaaaggctaaaatatttactatccagcccttaacagaaagcttgctgaccctggtatagactttttttttcaagaagtttttgctatgagaaaggaagaaaaatagggcaaaagatggcgtaaagggagtaatttttaaagatgagaaatgcttgcatacgtctgcttgggagtgatttagcaggagagaaatttatttgggggggcaatgggttaattacagaagaggactgttttaaacataatgttctggggggggcaatgggttaattacagaagaggactgttttaaacataatgttctggggggggcaatgggttaattacagaagaggactgttttaaacataatgttctgcggagggggcaatgggttaattacagaagaggactgttttaaacataatgttctgggggggggggcaatgggttaattacagaagaggacttttttaaacataatgttcttgaattgtttagtgcaggggaccccaagccctgggccgtgggccagcaccagtccgtggcctgttgggaactgggccgcacagcaggaggtgagcggtgggcaagtgagtgagcatgatcttctgagctccccctcctcagatcagcagcggtattagattctcataggagcgcgaaccctactgtgaactgcacacgcgagggatctaggttgcaagctccttaacagaatctaactaaggcctgattatctgaggtggaacagtttcatcctgaaaccatgtccccctccctggtccatggaaaaactgtcttccaaaaaactgctcgctggtgccaaaaaggttggggaccactggtttagtgtatgagtattagccctttagcagggttataagtatcctttagaatggggaccaaggatatgaacagcactcctatagagcccatagctgagccaatcatccatttggtttaccggggacacgctgcgtttatgattcagtatagttattaacagctccctctccttctcaaagtgactctggtgataaatcatatggtcacctcacctacagcacctaagcaaggctatggcacagtgggaccttgacaaatattgcccactgattaaaagtatcatggtgcacctgtaagagtgctggtgctgaggctaccgctctgaataagtgcgctcataaccattcctctaacttcaggcccaaccatgagcagtggttcaaaatcacagcttcatgctttctgtaagtattctctatttggcttaaacagagtctaatatccaagatgctacatgggatcagtaaattctaaaaaagtttcaatcgtggagtaaaaagtgcaacagaggcctctgtaggcaactgaccactagaaaggactgatctttttcgacacagctcacatggaattctgtgatactgcaggtcatgtcatgttatggtgacatgctaatgggaccatagctactgtgttctagacaaacaccctaaaacatatgacatgcagctaagaaaggcaaaaaaggggctaagttatacacttaggtctcacatatgaagaagtctgcatgatcctatctcagagaaagggtttctatccctttctctcttacattaaacctggcatcctaccagaactgtctctgctgaaggtatcgcttttttcttccagcaaacaaataagactcacacaatcttacatgtcacagtctccaagatagataaactatgtgccagacttttttcgggctggaatacttttgcttgttttaataaggtactgaagttggggaaatgtactataattcattttgcagagtttaaaaactcctctgaagcactggtgctatcaggcaagtccattctcaacacacaccctaatatttgacatctaacctctgatcatgagtcatatagaaagattgttttgcaactggaagaatcatgggtcctacaagaagttaaggtttttttaagaaacacaaaaataccttcactacctggctaatcagaaatgtgctgaaagaatcactctggcactgtccctagacactttttaaaataaaaacgtggttggccgggggggcagtagctcacacctataatcccagcacgctgcaaggctgacggtggattacttgaggccaggagttcaagaccagtctgaccaacatgacgaaactccgtctctactaaaaatactaaaaaaattagctgtgtgtgctagtacatgcctatagttccagctactccggaggctgaggcatgagaatcacttgagcccaggaggcggaggctgcagtgagccaagattgcgccactgcactccagcctgggtgacagagacatactctgtcttaaaaaaaaaaaaaaaattaggccaggtgcgatggctcatgcctgtaatcccagcactttgggaggctgaggcaggtggatcatgaggtcaagagatcaagaccatcctgcccaacatggtgaaaccccatctctactaaaaatacaaaaattagctgggtgtggtggcgcatgcctgtaatcccagctactcgggaggctgaggcaggagaatcacttgaaccagggagtcggaggttgcagtgagctgagatggtgccatcgcactccagcctggtgacagagcgagactccatctaaaaaaaaaaaaagaagaaaaaaaagtaataataaaaaaattaaaaggtggctactttccattccaagctgtatgtggattaaaaacagaactaatcactcccaaaaatgtctgcatttaatctaccccactagagtttctgaacggagcactggagctacagcttacgtctaaaggtgttataaagcagtgactgttgtggccctttttaggactcaaattctatacacacacagcctgcatcctaaagtgttataaagcggcgactgtgtttaatctgcccctactggagtttctgaactgggcactggtgaactgggcactggtgaactgggcactggtgaactgggcactggagccacagcctgtatctgacggtgttataaagcggtgactgccgtgctcctcttttaagactcaaattctgtaaacaggagatgaaaagcaacccactgaattagcctagaaggctcagcaaaaccaattccagcatctttgtatttctgtgcatcctaatggtaaccactactctgaattctccttgcctcctggaggagacggtgagcaggctctcaaagccacaggaggtcacgtgtggaagataaggagtatggaacctggcacagactctcctgctttcttctttctctttttcctttttttgcagaactgttgtctgccacgttagtagacagaggggctctgattcattggcagtgccttaagaaatgagcatccctctggctctcaggtccatctaattttgcagtctgcgccatcagagaatgatgctgcctttatcctgtgagtccgcaggcagcctttcagagattttaaaccgagatcccctttgtggccactgcaggaaggaggaaaggttgttcattttccgaagagctggtatggctttagactattctgtgaaaaaataaggtgctattattcacggttactggggagaaaattagatttttccactattttgctaccatttctgttttccaacttgacatctatctgctggttcccttttctattatatggaaaagcaacgtgctgggccaggtgcagtggctcacgcctgtaatcccagcactttcggaggccgaggcaggcaaatcacctaaggtcaggagttagagaccagcctagccaacatggtgaaaccccgtctcttctaaaaatacaaaaactagccagccatcatggtacacacctgtaatcccagctactggggaggatgaggcaggagaatcgcctgcacctaggaggtggaggttgcagtgagccaagattatgccactgcactccagcctgggcaacagagtgagacggagaaagaaaagaaaagaaagaagaaaggaaaaggaaaagggaagggaagggacaaaaagaaggaaggaagggagggaggaaggaaaaagaaaaaaagaaaagagagacaggaaagaaagaggaaagaaagaaagaaaagaaagaaaagagaaagagggagggagggagggagcaacatgctgtatgagttacaagcaagggattttcaactagcagactgggattcaaaccttggctctgccagttactgtgtgatttctgtcaagcctcttatcctctaggaagtagtttcataatttccagaatgcaaattctatcagctacctgaaaggtagtaaggaatgtgagagtagaaaatatgtttggaatcgtttacccaacactcttcccctccgcatgcgaaatcttcctttcaccgtgtttctacagagtctgctgtccaagagctgaccaggccctcgttggagcagttttcccatgactttttttttttttttttgagacagagtcacgcttcgtcgtggcatgatctcagctcactgcaacatccgcctcctgggttcaagtgattctcatgcctcagcctcctgagtagctgggattacaggcacccgccaccacacccagctaatttttgtatttttagtagagacggggtttcaccatgttggccaggacggtctccatctcctgacctcatgacccgcttacctcggcctcccaacatgctgggattacaggcgtgagccaccagaatgagaattgggaaaaagagtttgtctttcgcgggtggtaggagtcccaagaagtgaaactgagttagagagcagctaggttccccaggaagggcaggaggctggactacaggtagagatgatgagggtgacacacacacacacacacacacacacacacacacacacacacaatctctctctcacacaatctcaatctctctctctctctctctctctctctctctctctctgagctttactcccgtctttggcttcagctgtttgacaagcccagctgagacgctatccttctggcggtcacacttgttgaacttcttcaaacgagacacaacaggatccttccaaataatcccccttttgcctaagcccgtttgaattgggatttttgtcttctgcaaccaagagagtcttgaatgagtttataaagcactcagctcacagaaagtgctcacttaatggcaactattagtattcccacatctcctagatggagtaggatatttcagatgagactaccctctaagaatcagaggttgttactcatcttttagagctttgtaaataagatggctaagttcagtatctgcaggcagactcagaagaacggctcatggattaagaggatggaatctttgaaccatgctgaaaatgagacattctccagaaaaaaattgaagtcttttgttcattcattcaattaaaaagtgagtgcctattacatgtactgtgctagatactgagagaaaaagatcactagctagggaatgtatctttaaagggcttgtaaggaatacatgtctgaattatacacaaaatgatacaaagagcgatgaataaagaatggcagcggccgggcgcagtggctcacgcctgtaatcccagcactgtgggaggctgaggaaggtggatcacgaggtcaggagatcgagaccatcctggcgaacacggtgaaaccccgtctctactaaaaatacaaaaaattaaccgggcgtggtggcgggcgcctgtagtcccagctactcgggagacttaggcaggagaatggcgtgaacccaggaggtggagcttgcagtgagccgagattgtgccactgcactccagcctggggcacagagcaagattccgtcgcaaaaaaaaaacaaaaacaaaaacaaaaaaaaaacaacggcagcatcatttcgaaagccaggaggtcctccagagagcagaaacatggatgagtgctaccacatctgataagccctacacggaagccctcaccacatccactgagggtggacaccaagggtcaagtcgcctctctttagagaaagtctcttcttttgttactgctgaccaccccggcatcactgagagctgttgctatggaaacgaggtatccccagctgaaacagaggtgcttcagccagcctcagcaatgctaacaatgcagcccgctctccacgacggtgctcaacagcagcagaggctgcgggactctcacacacccagcctcagcaatgccaacaacgcagcccactccccatgatggtgctcaacagcagcagaggctgtcggactctcacagccacagatggctgcacgtctacagctctttgcttccctacgtgtccgagaactcaaccaggactgccctggtcaaatgccagatggcgcccatcagatgagaatcactgatgtttacacaaattcctccacaccacttaggaacctggagtataagaaggctttatttaaagcacagatttctttccaagtttgtgaaccaaaaaccaaaggactgtaaagagcaaacggagtaattctcaccttgtttgttaaaatgttctgttccatgtaagttacttttatttatgatttctgcaaaccaaagccactgaaaatgtgaaccaaagagctcatttttgttgttttcaggagacaagccagaaattaaaatcacaagacgaggctcggaaacaaattcagcagtgcccaaataagactaaacatttacattgcaaagttctgcctatatctgttatcacccctaacttaaaacaagctagccctgaaatagctgcgagtgacggatgcgttcatgcagcttcctttgacgaaaggtaaccccggaggatgagagcatttcaagcaacacctccaagtggcaaaagacaaggaaacgtttaagcaaaagtttctgctgcttttgctgaatgaaaggtaaagaaattcaatatttttggaaatggggcacattaaaaggaacaacttgtccaagtttaacaaaggactacttttcccaaatagccaggacttccagttgccaagttcgaggttattgacttcattctaattccccatatcttactattacttctcattttagtcacttcataactctcatctatatcgtaagtcttcattcaggagaaaacatccttttgcgtgacatctggatgttccctcagctgactttttgagacaccttctgtgccaaatgcccttcaggctgcgaggattcatctgtgtgatttttttctcttcctggttcgcttactctctttagggcctcactggtgtctgtattttcggcagcacaggtgtgcagaacacagagagttctcttcaacctggggttcttctctcagtccagtttcttcgtcatactgagggggaccaagctggctaatgaggccatggtcactgccattatttgaaattccttatgaatcagccttccaggctccacagcaaaacaggtggctcccaaatctgcttttaaatgtttgtcactgtttaaagataatttagtatggacaagtatgcagcatactgcgaatgagaaaatctgggtctgtgattaactcgcttcgtgtgattttgggcacgtcacagaactgatgcgggccatctcttcatctgtaaaatggggagaacagcatctacgtggcctaattcacacatctttgtaaacatgtgaatcgagtaaatcaagtaaagtaatatatgcaacaatattttgcaaggtaaacatttatagtgtaataaaacattagcattacagatcaagacaaatgactcaaaatgttatgttctgcaaaagcaactgaaaatgtgtctttgcttacagtgaatgaatcaagaacagatcagccttaaaacagtacatccttaattacagagatctggaaaattccagggctgacaaacggtcctagaacctgcccacaagacactagttaccagaaatctctaaagactagaatctctaagtcttcaatgaaaaaaaagtttaaatttctgacttattagaagtagcactttgcctagctgataattctacggttatcacggaagtaggagagggctgtctgtcgcgaccgttcccttgtgactaggaacaagaaaagctcaagtacaacaaggagacaggagttaagaattcggtctgagatggggtaaagacccctcaaatacaccttttctcctgctttaaagacagaatttgaatcatcaaacttacttggggccaggtgcagtggctcacgcctgtaatcacaacactttgggaggcagaggcgggcggatcacctcaggttgggtgttcgagaccagcctggccaacctggtgaaaacccgtctctaccgaaaatacaaaaattagccgggtgtggtggcaggcacctgtaatctcagctactcaggaggctgaggcaggagaatcacttgaacccaggaggcggaggttgcagtgagctgagatcacacctccatcctgggcgacagggcgagactcccatctcaaaaaaaaaaaaaaaaaaaaaacttacttggtagtaagtatatctccagaagaaatgcccccctccaaattgggggtcattatgaaagtggcactaatacatttttgcctaacatccatattccaggtatcacatacaatacctagaaacgaacacagcatctgttcagagtctacgatgcaatacagaaacagaaattagaaaccccggcatgggatccaataatatacggaggacgacaagtttctgatgtattttagagctttaatctagatgactacaaaacgccaagccaaaacagatgtattatctttggttttgcaaaactaatctccttccagaggagaccctggagtccaaattggagcaaaggaaattttatagttacagactcttgaaaatggagacttacacatggaaatggtgacggcacaaccacaacgctgaatctgtgctcttctaaatactgtttccgtggatgaaagagggaagaggaaaaaggaggccaagttcttccatgaagacagaaagccaaattcccatccattgtacaaacatatctcagtgacttcttgtatcaaggacctgaaatccagaaggctttgctctgttggcagtaattccgcaatttttctaatgcacagcctcaaactgaggatggaattttccttacacgatttctaactactagcaatcaaaagcaagagtgacctgggtactagccagagcagttacagtggtgatgaatggcattttcctcttgagacgcagagtctagtttaaacttgtgactgcctctaacatggaaataagcagatggtgagttacgcttgaccttctttcttggctcctgaagactgccagtttatatggagatggctcagaagaacctgccaatttatatggagatggctcagaagaacaataaacttcagtgttctttcttggcgcagtattttcctaaaactattttcaataatcatgttgcagaaaagcgggacttggcgtttctaaggtcaggaaggaaacagtccaactgctggactagttaactaaataaaagaaaaaatcagggtggttttttttttttgtgggagagaacatctccatgagtaggcactacatacaaaagcttaagattcttgctaatcagaaacatgttgtctatattaattaaatgaagacaaaacagaacgcttgtgttaatgcacctgagtctatggaaagaatgaatctatgaaagttcagaacaatatggaaaaatgtttctaaagagattaaatattgcaatgattaaaaattaccatgtgacccagcaattccactcctaggtacacagcataagggacggaagcagaaactcaaacaggtatttgtatgccaatattcatagcatcactgttcacaaaagccaaatggtggaaacaatccaagtgtccatggacagatgaatggatacacacaatgtggtggaactacaccacggaatattattcacccgtaaaagagaagaaagtgctgatacatgctacaacgtggatgaatcctgaagaccacagaagtgaaatacaccagatacaaagggtcaaatattgtagaattccacttatattaatataaagttcccagaataggcaaattcatagagacagaaagtaaaatagaggttacaagaagttgaggaaagtgggcaggggaaggaaggacttaatggttttaatgtttacagagtttctatttggggtgatgaataaatttcagaaatagtggtagtggtggttgtacattatgaatgtaattaataccactaattatacacttaaaaatgttaaaataataaattctatattatatacatattttacaaggtttaaaaaataatgtaatatcaaaaaccactgaacagtatactttaaatagatgaattatatgtgaattatagctcactaatgctgttaaaatatagccatataaaaaattgaaaaaggttatatttactaaaatgaaatttaataaaatttttaaaagcatcatcaattacaccaagctacttgccaagaaaaaaaaccaggccaggtgtggtggctcacacctgtaatcccaacatttaaaaggctgaggcaggaggtcgcttgaacccatgagttcaagaccagtctgggcaacacagcaaaacccggattccacgagaaatacaaaaaaaattagccaggcgtggtggcgagtgcctgtagtcccagctactcaggaggctgaggtgggaggattacttgagcctgggaggtcgaggctgcagtgagccatgattttatcactgcactgaagccgaggtgacacagccagaccctgtctcaagagagaaaaaaagccaggcccggtggctcacgcctgaagtcccagcactttgagaggtcaaatgaggcaggcggactgcctgaggtcaggagtttcagactagcctggccaacatagcaaaaccctatctctactaaaaatacaaaaaaattagctggacatggtggcgggcacctgtagtcccagcttcttgggaggctgaggcaggagaatcgcttgaacccgggaggtggagactgcagtgagccaagatcaagccactgcactccagactgggtgacagagtgagactctgtctcaaaataacaaaaacaaaaaacccataaaaataaaaacaataaaaattcttttttattttttttgatacagagtctcgctctgtcgcctaggctggagtgcagtggcacgatctcggctcactacaacctctgcctcctgggctccagcgattctcctgtctcagcttcccgggtagctgggattacaggcatgtgccaccactcctggctaaatatatatatatatatatttttttgagacagagtctcgctctgtcgcccaggtagagtgcagtggcatgatctcggctcactgcaagctccaccccccgggttcacgccattctcctgcctcagcctcccaagtagctgggactacaggcgcccgccatcacgcctggctaatttttttgtatttttagtagagacggggtttcaccgtgttagccaggatggtctcgatctcctgacctcgtgatctgcccgcctcggcctcccaaagtgccgggatgacaggcgtgagccaccgcgcccccgccattaaaaattcatttttaacactcaggagatgtggccaaagtggcattcagagaaaagccgtacctttaagcgctcttcttacataacaagaagtagaaggagcataaagacaacagagatgaaagcagtaaaatataaaggtacagagtaatgaactgaaacaggaaaagaggagaactgacaaatatatccaagtgcaagtcctctgagaaggcctaaagaaattctggctgttttaatctaggattgggggtgtgggaaagagaaaacataaaattaagaatgaaaagagaggccagatgcggtggctcacacctgtcatcccagcacattgggaggccgaggcgcgcagatcacgaggtcaggagattgagaccatcctggccaacacggtgaaaccccatctctactaaaaatacaaaaattagccaggcgtggtggcggccacctgtagtcccagctacttgggaggctgaggcgggagaatcgcttgaacccaggaggcggagcttgcagtgagccgagattgcgccactgcactccagcctgagcaacagagcaagactccgtctcaaaaaaccaaaacaaaacaaaaagaatggaaagagaatataaacagagaattggaaaggatgaataaacttaaacatctgagtaaaattattttcaagaacaaggacttactaaaatcaactcaagaagtggaagatgtaactataaccacagaaataacagaaaaggctgccaagaaaccaatctcccaaaaggcacttgaccttgataatgggtcaattgtttcaaagacttcagggacttcagggtatattatctatagtctgactctctgaaacagtttactatttaaatggtctctgcggttgcaaaaaatgggaagcatcccagtttgttttataaagctgacaaaggtcaggcatggtggctcacacctgtaatcccagcactttgggaggccgaggcaggtggatcacctgaggtcaggagttcgagaccagcctggccaacatggtgaaaccccgtctctactaaaaatacaaaaatttagctgggcatggctgggcgcggtggctcacgcctgtaatcccagcactttgggaggccgaagtgggtgaatcatttcaggtcaggagttcaagaccaatctggccaacatggtgaaaccccatctctactacaaatacaaaaattagccggtcatggtagcaggcgtctgttatcccagctactcgggaggctgaggcaggagaatcgcttgaacccaggaggcagaggttgcagtgagtcaagatcgcactactgcactccagcctgggtgacaaagcgagattccgtctcaaaataacaacaacaaaaactgacataaacccgatacaaaatctaacaatgataaccaaaaagaagaaaatgtcaaactaatttcattttttaacatgaatcaaaatcccagataaaaatactaggattcaacaatatatttaaaagacaatacacgatgacccagcaagcatttatgaaaggttaaatattttaaaaagaaggaaaaaaaaacttaaacaaatcaacaacatgaaaaaacccctatgactatattcagtacatgctgagagggcatatgataaaatccaacgtctattttctggcaaaagtgcttagtgaccaagattgtgaagatctctccttaacagtcaaaagaatcgggaaacaagacaacattacacttggtgtcagctccgggagagaagtgtcttttgcttttttcattgtgtaattctcaatgcttaaaatagtgccaaccacacagaaggcactcactaaatatgtactgagtgagcaaatgaacagatacactatgtaaagtgcctgtcattaaaatcaagaacaaactgcctgccattcccactcttagctgatcctaaagagcatttctaaaactttttgacctcagaatctctttatacccttggaaatttattgaaagggtttatgtaggttatatctactgacatataccaatgttggagattaaaactgaggagtttaaataaaaaatatgtatctgttaatccatttaaacatgacaatgataaatatattacatgttagcataaattacatgttttttgaaaaataactatattttccccccagacaaaacaaagttgtttttttgtttgtttgttttttgttttctgttttgagagggaatattgctctgttgcccaggctggagtgcagtggtgcaatttcggctcaccgcaacctcagcctcctgggttcaagttattcttctgcctcagcctcccgagtagctgggcctacaggtgcatgccaccacactcagctaacttttgtatttttagtagagacatggtttcaccatattggtcagggtggtctcgaactcctgacctcgtgatctgcctgcctcagcctccccaagtgctgggattccaggcgtgagccactgcgcccggcctacaaaacaaatttcttgagaagcgtggcactgctggggtgtctctgcaaaaatctttagtgtctgctctgataaacaccagctggactcccatacacgcttccatattgaatctgttgtgatctgttgttctggttgaaaatatgaagaaaatctggcttcacatagatatatgtagttagaaaaggaagaaatactttaatacccaactctttgtctatttaggctgctattaatataaccaaatactttaaactgggtaatttctaaacaacagaaattgttaacagtcctggaagctggaaagtccaagatggaggcaccaggagatctggtgcccagtgagggccctttcctcacagacggcatcttctatgtgtcctcacatggggaaaggggcaaatggccatccttcaaaagtcttttatgaggacactgatctcacagatgagggcagaccccttgtgactcagtcacctcccaaaggccctgcttttaaatcctgtcacaatagggattaagttccagcataggaatcgtgggagataccaacattcctgtgctgtgacatgctgttttggttgaaaatatgaagaaaatctggcttcacatagatatatgtaattagaaaaggaagaaatattttaatacccatttcttagtctattcagctgcaattcatagaacagaacactttaaacacagcagcccttttcaggtacttggtgataagccttttttaaactacactaaaactcaaaaagtggtagattcttgaggattagctgcagtgtgggatttgaaattgaattaatgaacttgccatactatatgctgcatgaaacccgctgatcagctgtgcttctgccgaggatgcagaaagcagaaagagtgctgctcttacactaacaaggaggaaaacggaaactgaaaaccacaacttttcttgaacctagcagagagctaaaggtaaccaagcatcctgaaatccaagaaggaaggtgctcccccaggaaagacaggacaggagaaccgtctccatgtagaagggcatgtaaggaagacgggggtgccacacaagcaggcgagagggctgaaggaaagtttttaacaagttactaaaggccaagtgtgggctggcgcaatggtagggaggcctggaaagtgtaagcacaggtgggtttgcacccactctcaggctcttttccaagaccttcactgggtgttcatgaggaaaaaatgggggcactctctcctcttctacacaaaatgcctggcattcaataaaaaattttaagacatatatacgccaaaaaagaaaaaaaagaagaaagggaagaaaggaaaagcacccattgttaagagacaaagcaaccaacagaacctgtctcaaagaggagccatttggtataaatattagataggctacagaggaggggattttaaaataacaatgaataatatgctaaagaatctggtagaaaaggtgttttacctgcacgaacagatgaagaattgcagcagagagcaggaaattataagagtcaaatggaaatgctagaaaaaaggacatggtgtcagagctgaagaattccttcaacagcctcatcacactcgacacagcaaaaaaaggattggtgaactttaaggtgggtcaatagaaagtacccaaactgaaacacaaagaggaaaaaagaaaagaaaatccaacacctgcaggacagtattaaatgttctaaaacacatgtaagtagaattctaggaggaagagagaacacaacagaaacatttgaagagataatggctgagaatttttttttaagtgaaaggcattaaaccactgatccaagaagtgctgagatcccaagaggaataagggttgacttctcagaaacaatgcaagctagaagacaaagactgacatttttaaagtactaaaaaaaaataaaacaacaaaactgccaacctagagtcctaaaccaagcaaaaatatttttaaaaaataaaagcaaaattaaaacttttcaagcaaagaaaagctgagagcatttcttgccagcagaccgtgttataagaaacactaaaggaagttcatgaggcagaacaaatatggtacagaaaaaactcagatctaaggagataaaaatgagatctatgtgaggtgacaaatgccttcatttgcttctctgcaggctattttactgtctttatgtatcctataacatgttatacaccttacatatacacaatacaatttacttcttcaaacataaaataaaatagctgggtgtggtggcacacgccaatagcctccggctactcaggaggctgaggcaggaagatcacttgagccaaggagtttgaggccagctcaggcaacatagcaagaccccatctctaaaaatataaaataaatgtagaaacttgaaaactgacaaacaataaaaatatttttaaaatttatttttaattactctaattagcaaaaatagcaacagtgatggtgttcataatacgtaaaaacaagatgtggggcagagtggaatgcagagaggatgtgaggaagaggtcagaagcctgctatgaaaagactctcacattacatgtgaagtgatacaatgtcatcactgtgacatcagtgacaatatgactgtgataaagatgcatattgtggacccaggacaaggaagtacaagaacaaacagaaaacaagcaagatgctagatttaaatccaactatatcatgggaacaaagcaaactattcactttcaccagttttattccatatcacactgtaggtcctagccagagtaataaggcaaaaaatattttattcataggtgagatgattatctactttttaaaaatcccaaaagcctacaaaaaaaaaattcctgaaactaataagtgagttcagcaaagctgcacaatataaggtcaataaataaaaatcaattacatttccacaactagcaagagacaactggaaatttaaattttaagagataccatttataatcataccaaaaaccacaaaatatttagtataaatctagcaaactatgagcaagatctatatactaaaaactaaaacacactgttgagagaaactaaagacctaaatatatgaagaaatattccatgttcatagattggaagatttaatattgtaaagatgtcaattctccttcaattgatctatagactcaacgcaatcccaatcaaagtcccagagatttcctttttttcttttcttaaatcaacaagttggccgggcgcggtggctcacacctgtaatcccagcattttgggaggccgaggcgagtgaatcaccgaggtcaggagttcgagaccagcctggccaacataattaaaccccgtccctactaaagaatacaaaaaattagccaggcatggtggctcacgcctgtaatcccagcgactcgagagattgaggcaggagaatcacttgaacctaggaggcggaggttgccgtgggccgagatcgcgccactgcactccagcctgggcaacaagagctagattctgtttccaaaaaaaggaaaaaaaaagactaataaaggaaaacagatcccaatacctgtaaaagtcctgatgatcttggcgtaaaaactgccttgctttagagatgcaatgagagacagagaaaacaaaaagacagatgtactcaacacaaacagctggagtggagaaagcgggcagctttgagtctgagagccaggaagggaagactgcagttccaagagcctgggtctggaaaccggtgttgaacaggcagcaaaggctccctgcagtgacccaggtgtcagttccttctgttcattacaatacggcatccaaaaatacttttcttctaaaataatataccaacggccctcaacttgggatggttcaacacagaattttcttactacacgatggtgcaaaggtgagaaacattctgtagaaaccatactttgggtacccatacaaccactctgtttttcactttctgtacagtattcaacagatcacatgagctattcaacactttagtataaaataggctcggtgttagatgatttgcctgactgtagcctaatgtaagtgttctgagcaaataaatttaaggcacggtaggctaagctatgatgttcagtaaattacatgtattaataaattttcaacttaggatattttcaacttacgatgggtttatcagaataagaacttattcttcattgcaagttaagaagcatgtgtatgattgagaaaaatctggaaacaggtgtggtggcttgcacctgtaattccagccactcaggaggctgaggcaggaagatcgcttgaggtaaggagtccaagaccagccagagcaataaaggaacaccccatcactacaaaaaaaaactttttaaattaaaaaattagccagacatggtgacatgcacttgtagtcctacctacttggaagtctgaggtgggaggatcgtttgaggccaggagtttgagacagtgagctatgcacgccacactccagcctggatgaccctggagcgagaccctgtctctaaaaaaaaaaacagagagagaagagaattggctggttgcagtggctcatgcctgtaattccagcactctgggaagcgtaggtgggaggatcacctgaagccaggagttctaaaccagcctgggcaacacagtgagattccatctctacaaaaagtgttttaaaacagtcaggcatagtggtgtgcacctgtagtcctagctacttgggaggctgaggtggaaggatcacgtgagcccaggagttcaaggctagagtgagctacgatcctgccattacattccagcctgaatgacagagtgagaccctgtctctaagaagaaaaaaaagaagaatttggaagttataaaaactagaaatgaaaaaaaatctatctgcagtctcaaatttcaaaaacaatacaaataataaattctgttgtcaagtggaatgtttattttaactatagggtgatattgcatgtcacgccaggcaaacatctaatggaggtcttgaagacaggacaagagaaatgaacctttgaccaccactgttgccacagcagatattctggaccataggtaagctgtgccgccatttttattcacagagaacagcacgctgaaggcagtaaggggcctgggataattcagaacaagtaaacctggagttgctttaaagcacagcagtggggctggagaggagctgatggagctgacggaaaagccacaggaactcgacaaatacctggatgcacggaactaggaaaactgaaattccagtggactgtgtatcagcagcactggtgttcctgccatttactaaacatgagtgagcccaacattgtgcaaaaaaggtgttttaaaatacatttattctaggccagatgtggtggctcatgcctgtaatcccagcactttaggaggctgaggcagaaggattgcttgaggccaggagtttgagactagcctgggcaacatagcgagacctcatctacacaatacttaaaaattacattagctgggcgcagtggctcacgcctgtaatcccagcactttgagaggccaaggtgggcagatcacctgagatcagaagttcaagaccagcctggccaacatggtgaaaccctgtctctaccaaaaatataaaaactagccaggcgtggtggtggtcgcctgtaatctcagctacttgggaggctgaggcagggagaatcacttgaacccaggagacggaggttgcagtgagcagagatcgtaacacggcactccagcctgggtgacacagcaagactccagctcaaaaaaaaaaagccaggtgcggtggctcatacctgtaatcccagcactttgggaggctgaggcacgcagatcatgaggtcagaagatcgagaccatcctggccaacatggggaaaccccatctccactaaaatacagaaaattagccgggcgtggtggcacatgcctgtagtcccagctactcaggaggctgaggcaggggaattgcttgaacccaggaggcagaagctgcagtgagccaagatcgcaccaatgcactccagcctggagagagagcaagactcagtctcaaaaaaaaaaaaaaaaagatgcgcatggtggcatgtgcctgtggtcccagctactcgggacgctgaagtgagaggatcacttgagcccacgaggttgagggcgcagcgagctgtgattgcaccactccactctagcctgggcaacaaagtaagaccctgtctcaaaaacaaataaataaataagtggataaataaaataaagtatattaattctaatcccccctaaccctgaggtacgtattattatctccatgtcacagatggaaagttaaatatcttgtccaaggtcacacagataacagcagagacaaaatttaaattcaaagctcaagtttttttcactttaccaagatgccatccaatgttacatcactgaagatatctaactacaccaatccttagagaattgaaataaaatgcccagtccttcactgtacatagaggagagaagatagctatttggattccttatagcttttctaaaaatgagggattttagaggatacgtggcaaagtgttccaaatatgccgcagacatgtctccctgccaaaaaagcgctatcaaggtgatatgatttggctgtgtccccacccaaatccctacatgtcataggagggacctggtgggaagtcactgaaccacggggtggtttctcccattctattcacgtgatagtaagttctcacaagatctgatggttttgtaagaggcttcccccttcgctcagctctcattcttcctctctcctgccaccttgtgaagaaggatgggtttgcttccctttccaccatgattgtaagtttcctgaggcatccccagccctgcagaaatgtgagtcaattaaacctctttcctttataaattaccccgtctaaggtatttcttcatagcagtgtgagaacggactaatacacaaggcttgtgtgcaataaacaggatgaagaatggtagtgaggccaaacccagttgcactacattgttaaacagttaacggacattttatgagtccccgcctcaactacaaccagtagcactctagaagcaggcaaaatgaacagtcgcccgccccgcctcaactacaaccagtagcactctagaagcaggcaaaatgaacagtcaccggattcaacttgacaaaggcaagccaaccttgacctctgcactagacgtaagaaatcctggttgggaaatgactgtgagcccgaatcaaaactctgcccctacaaaaggctgatctaacaacccgactccagggctgccccacagatcacggtgttcagggcactcccaggtcatgtccaaacctcagcaattcctgaagtttagtgttatttgcagacatgctgaaaagtacaacgcaaaaaataataacagaaaagaaacaaaaaatgtccagccaatcttggccactaatgggaaacttcgaggccatactctaaaagctcagtcgctttagctgtggtatgttttagtaggaagaagcaagtagcaattgccatttttttccaaactatttgtggtccctttaatactaataccaattactttcttcaatttttatcaatcaatgggcttcattttcctcccaagagaggatgagagaaaggatcaatttaaagtgagggaggataagaatataaagtctccttctagtgagctgacaatgacaaattcaaaatcccacataatgaagatcaatgccatgctgggaagtcagtcttggagagcagttatttttgttcttttcacttgagacagggtccccaggctgcagtgtagaggtgccatcatagactgctgtaacctcaaacccctgggctcacgcaatcctcctacctcaaactcctgagtagccaagactataggtttgtgccaccatgctggactaatttttttttttttttttttttttttttgagatggagtctcactctgtcaccaaggctggagtgcagtggcaccatctcagctcactgcaacctccacttcctaggttcaagtgattctccagcctcagcctcgtgagtagctgggactacaggcacgcaccactgcatctggctaatttttgtatttttagtaaagcccaggtttccccatgttggccaggctggtcttaaactcctgatctcaggcgatccgcccacctccgcctcccaaagtgttgggattacaggcgtaagctaccaagcccggcctattttcgttctaatgcttgaattgcataatatgctaattttgaggaagaaaagcaaggaacactttctccttggaaggcaatgtactttgctgctttagttcataatctttatgatatctctatgtaaaagtgaagaaggcaagtattaacagcctccttttttggtgaaaatcaagacatgggaagatgaagaaacagccccggacgacacacacagacaggtagaaatcctgttttttgggtctggcactttgcgctgaagtgaggaggaagaacaggaagcctctgacggcacgtcacacggctctgaatccactccattctgccttttcatctacaacttgaatgaagacacagaaggcatgtctggcaaatctgctaatgataaagtggggaggtcatcaaggctcccaaagatcttgatgggataaacaatcgagcagaactagtgggatgaaacgaaagctgagacacacacggtctgacaatttcaaagactctcttgcacaaacagaggtggagaaagtttaaatgaaagtcatatgaagaaagacctgggacagtactggcccacagatgtgttttgtttgccctttgcagtgtttgtgaaaaacactaagccaatagttaaaaattgtgagagttacatgaaaatccggatttccggctgctcttgaaaaactgatagatctggcaattccaggtctgcgttcagacgtgacaacagctgattagaattcacttgtgactatccccttaggacctggtggatgcatgtggacacacaccagcctgcttacgccgcttaggttactttcccagctctgcggacatctgtttgcgactcttgacctgggggtttcaggtgactgccaactcagtagaagccaaccatgtaatacggctgccaaaaatctcagcaaatccaaggtaatggaagaatagtgtctaaaataaaaaatctcagcaaatccaaggtaatggaagaacaatgtctacaatcaaaaatctcagcaaatccaaggtaatggaagaacagtgtctaaaatcggtggcccttaagttttgaagagtcacagactccttagaaaatctagaaaaatcaataagttttcctcccataaatatgtctagacatacaaaaatttacagttaatttcagggacttgacagacactctggacccccagtccctaagttaatgagctcggcccagaacaaagaggtcaactgtctcagtgtatatgttgacacagcatgtccactcctgggaaccacattttaagagggatgctgacaaacagctatcaagagcaaggatgataaagggtctggaaattgcattataaagatgaagaaactaagaatggttagcctagaaaagggaacacttaggaacataatatccattttcaatttcagaagctgtagtaaggaaaagggattaggcttacacccatccagctggcagaactaagatcaacaagaagttacaatgaagtctatttcactgtttcagttcagtctaagaaaggagtttctcacaactaaagctataaaactgaactagtctgtcctgtggaccaacaaagtagcaagctccccatcactgaaagtagccaagcttctgcaagataatgaaacgtcagagatgtaatacaaaggactcctgaactgggtggaagattgtactacaattacctaatccttcttccaaagcgaaggagtgagcaatacagcaccccctccttatcagcagttcactttctgaggttttagccacctgtagttgactgtggtccaaaaatattacatggaaaattccagaaacagacaattagtaaattttaaattatgcgccattctgagtagtgtgataaaatcttgcaccacccaattctgtcctgaccaggtcacgaatcattccttcacccagtatatccatgctgaatacagcacctattagtcacttagcagccatctcggctattacatacagctccaaatcacaagaggagtgatgctggcatactgtcataattgtgctattttatttttagttattgtggtgaatctcttactgtgcctaatttgcatgctaaagtttatcacaggtatgtatacataggaaaaaatacggcatatatagggtttgctactctctgggtttcaggcatccactgggggtcttggaatgtatcccccacaggtaagtggggacgacttgtaataattctcttctcctcccaaaccttactcttgttctgatcaaagaaatggctacattgcagccaggctccattgaagagacagaaactcggtggctgatcctctcctgtgagtctgagagcttactgacgaccggtcaacgttggccactcttgaaacttcccactgccggctttttcttcctctaacccgcccctctattcacctctctttcacctacgttcaagccatccattttaattcttgggaagctgcaaaaatttcatagcataccacatcatgtacttgttgaattgactcatccacaaagttttaaacgtgggcatttaattaaagcttttgactgatgatttcaacagataaaaatggggaggattccgtgccatataaactttataagagcatcatcgtctggttagaagaggtcacagactagaccagttcaagctggcccacatagaaggtggtcaaaaaacaaagactctgcaaacgtttagcagaatgttaaccaagcggctggtatttcagaaacttcaagaagctcaagaaatgacctaattatgccttcaatatttaaatcattccttacccccaaataatttttgagtcaaaaacattgcttttcaaaagcaacttttctgctaaaaatgtcatttaagacaccatgaatgtgaagtcaacactttccccttatttacagatatagaagcacacctagccgggtgcggtggctcacgcctgtcatcccagcactttgggaggccgaggcgggcggaccacaaggtcaggagtttgagaccagcctgaccaacatggtgaaaccctgtctctactaaaaatacaaaaatgagctgggcatggtggtgcgcacctgtaatcccagcactttgggaggccgaggcgggcggaccatgaagtcaggagtttgagaccagcctgaccaacatggtgaaatcccgtctctactaaaaatacaaaaattagccaggcgtggtggtgcatgcctgtaatcccagctactcaggaggctgaggcaggagagtcgcttgaacccaggaggcagaagttgcagtaagccgagatcacaccactgcactgcagcctggctgacagcgagactctgactcaaaaacaaaacaaaaaacaaagaagcaagaagcacatctaggctgggtatagcctagcagccatctcggctattacatacagctccaaatcacaagaggagtgatgctggcatactgtcataattgtgctattttattttcagttattgtggtgaatctcttactgtgcctaatttgcatgctaaaatttatcacaggtatgtatacataggaaaaaatatggcatatatagggtttgctactctctgggtttcaggcatccactgggggtcttggaatgtatcccccacaggtaagtggggacgacttgtaataataagtgtctcatgcctataatctcagcattttgggagcccaaggcaggaggatcacttcaggccaggagttcaagaccagcccgggcaacacagcaagaacccatctctaccaaaaataaaaaattaaaaattaaaaatagctgtgtgtggtggcacatgcctgtagtcctagctacttcggaggctaaggtgggaggatcacttggccccaggagttcaaggttaccgtgaaaaatgattgcactccagcctgagcaacaaggcaggaccctgtccctaacatgataataataaatacaaatttaaaagcggcacatcggttctggttaaacacaatcaagattaaatttataaaacgaaaacctccttttgtccatatgccactcccttctgagtgttcttcagaagcttaggaagcgagtgctgaaagcaaacttctcttctcttccagggaagaggggaacgtggggcctcttgacctacaaaactcagtattttggaacatccgtaattccaccaagtctgttgcagtcaaatagactccttttagcaaaccagccagccagggctggagagcaaggctttcatacctaggagttgacaaggacaggacccaagagctccttggaaaaaaaaaagcttgtacttcagtttgcattacaaagtgctggaaaagacagatggggccatgacaggaaaagcagttatttcttctgggcttcctttctgtctggattctaaggagacgaatacaaagttccatcacagattgaaatgctatctaaacattcttgaaaatgtggtcttgctctgtgaaatacgacctgctctgctgcggcaacctgtaacctattaatacgggatgggggagaacgccgacattcctgcagactgtcgaattctgggtctgactctgtaataccgctagtttgcaagagtccagaaccacaggttgaaacgtaaataactgaaagatacacatctattatgcacagcatgacccaacaaaaaatgccgatgaatcactcactattttcacattcttgaaattttaaacatctatgactcctgcactgtaagacttctagtgagccattccaaatgtaggctgaatcacactgaacaagcagtgttactattcccagtagcagcaagttgggactcttaatgcacaaagcaagttctaaatcacttttaaggaacacccacttgctgatcaaaatgatgtttttatgataaaatgtttttgtttatttataattaataaacaatcttagacagacaaaatattcaatacagttgcataaaatgttgtgggggttttgctgttgcttttggggatggggtctcgctctgtcatccgggctggagcgcggcggcaccattacagctcactgaagcttgtactaccacacccagctaattattttaccttttcgtagagacgtgtattgctatgttgccgaggctggtctcaaactcctggcctcaagtcatcctcccacctaggcatcccaaagtgttgagattacaggcatgagccattgtgcctggctcagttgaataaaatgttattgcatgtggcctatgtgtagtgaaatagaaagatgacaaagatacagttcttaccttccaggagcttacaaacatcaaagggatgagacttgttctctggtaagtcaagggagaccccaaaagccaaatgaaaagtacaagaatggggctgtgggatttatggagaaaggacatcgagggacactggaatccattttctcctctgtaaaatgaggggaggggcccagatgagtttcaaatcctttccagttcaaaattctgattccttggtgtattcagataaggtccatggaaaacatcgtcaagaaactagtatctgagctggtccttggatgggtaagattgggaaatgcggcggcttaaagaaataggaggaaaagcatttcaagcacaaaagagtctgtaagcacaggtccagaaagcacaggcatgctcgtagagcacaaagtcttcagtgtagacagaacacaagaggaggcaaaactggaattggagaccagaattttgaatgccaagcaaaggaatttggatttctttttttttttaaacagggtctcactctgtttcccaggctggagtgcagtggcgcgatgatggcttactgcagcctcgaacttcctggctcagctgatcttcctgtctcggcctcctcagtagctgggactacaggcacaggccaccaccatgcccagctaattttgtactttttgaagatgcagggttttgtcatgttgcccaggctggccttgaactcctaggctcaagtgatctccccgcctcggcctcccaaagtgttgggattgcaggtgtgggccaccatgcctggccttggatttcatttagtggccagagctgatacggtgtctgaagaggtagacaatacgatcaaacacagattaggacagctaagcagcagaatgcagctggagtgcttgaggctgccctgtccctctgtaggacccctctgaaggtcccatttacatgggcctcatctgccaaagaagccatgcttcatgaaatatacctcaacagacaaaacgaggtaacgagggctaaaaaaaatacaggagtccagaaaaccagaacagttttaggaacctaatgtgtctacacacaaattctgatgatgacaagaaggccagctactcacaaacaggccaaaggaaactggctatcaaatggaaagtgactataaagtggaaaaatggaaaaagaaagtgatataaagtagtaaaaatagacagatgggaaaactacagatgtaaaagaaagagactcctaatatctgtaagcaactggcagaaggaaacagaaatatcagagatctggaaatttcagcgtaggattatatgctcctcccactccaaatctgggcagcaggatgaacatttttagaaattagctgtcctaaaaaatgtcaaagaggagaaatcacagcattgaagcaattgcaaagaagcagtcctgacctgagttagtgctgataagggaggacaggacatggcaagagaggacggctagaaaggcaagctcagcatttctactacaacagccattctgaaatacgatgcctcaacagaagaacagaatcaaataaaaagggaaatggttcacagataacatctggcccctcaattattaaagagtatctcctccctacacacttttcccttcattgcctccaacagcctccttaactagatccagtaagacttacttcattccctccaatggcctccttaactagatccaataagacttataaaacttttttttttttttttttttgagacagtctcacccctgtcgtccatgctggagtgcagcggtgcaatctcgcctcactgcaacctctggctcctgggttcaagtgactctcatgcctcagcctcctgagtagctgggattacaggcgtgagccgctgtgcccgctgtgcccggccaacttgtaaaattttttaatgaatcttgagtcacctgcctgctggcaaagcgaggtacgaggaaatggtaactatgtcaggttactatcttttacagccacaaaatatcaaaaccccaacaactcagctgacgaatgcagcaacctcatttagccacagcccacaaaataaaagagggcacaagagatgcccgacacgaaggagaaagacaaggaagccccagtgttctcatctggcctcgggtgagcggtgccacagttcacggtcctggtccaagggacactgagggacagcacgtggctgctgtgggcgcctgccctgtcttgtcctgccatgtatgaaacggatcaatcggaaagtgctctgcaagagggcacatcgacgttttggtcatctggttgccgggagaaaccaggggagcataggtaatatggaggaatgagttacttacttgccgtccatcctgccccacgttcgtctgacctcttacaacagttcgaatattgtcatccagtctcctagcaaaacagttcaaggatacagtcattcaaataatctttattctaggttgaccaaaagaaaaaaagtaaaaagtaatttattcatcaacttctgcagactgcacctaattgtccagaaaaccaaacatgtgtgagtggcatcaggcaggaggagggcagcgacagccgtgcgggaagtcaagcccagtgcaggctgatgcatcgccttgttgttaaaaatgcctattttcacttaatagtcagagctatctgaaaggactaataaaatctgcaggatttttcatggagtacatcaggaatgacaaagttccggagcctttacgtgaacatgccagataactcaaattacctcacacacaatccctttctcggtccccttatgaggcggaaagagccagagtgatagatggaatcagtgcttccgggccctgatcatgcaatccatgcctgaggcagatctacggcttccagctcctctgcccccacggttcacaatgtttaatcatgggccaccacccaacccaccagcagatctgacatggttagctgttatgtgaccaagggatacacatataagcccatcttcatgtctaagccttgggaacacaaaaacaggtaaatccacaaaaacagggaaataaagccattaaaaagctagtcgaaggacagacagaatggctcacacctataatcctagcactttgggaggccaaggcaggcagatcacttgaggctaggagttcaagaccagcctggccaacacagtgtaaccctgtaactactaaaaacacaaaaattagctgggcatggtggtgcatgcctataattccagctacttgggtggctgaggctcaagaattgctcgaacctgggaggtggagattacagtaagccaagatcacaccactgcactctagcctgggtgacagagccagactccatctcaaaaaaaaaaaaaaaaaatctagtagatgtgggagactgaggcaggcagattgcttgagctcagcagtttgagaccagcctagccaacaaggcgaaaccccatctctacaaaaaatataaacattagcaaagtgtggtggtgcgcctgtagtcccagctactcaggaggctgaggtgggaggatcacttgagcccaggagttcgaggctgcagtgagctgtaactgcaccagtacgctccagcctgggacacagagtaagaccttgttttgaaaaaaaaacagaaaaaaagaaaaaaaaaatctatcagaaaagcttttgcctccttctataattacaaaagatgttttgagtagactctatcacagcttccttccttttgtatgaagaattgaagactggccaaagcattgagttccttgccacaaagttcatatggataaaataattatatggccgggtgcggtggctcacccctgtcatcccagcacgttgggaggcgaaggcaggtggatcacttgaggtcaggagttcgagaccagcctgaccaacatggtgaaaccccgtctctactaaaagtacaaaatttgccaggcgtggtggctcacacctgtaatcccagctactagggaggctaaggcaggagaatcacttgaacctgggaggtggaggttgcagtgagccaagatcacaccattgcactccagcctaggcaatgagcaaaaatccgtctcaaaaataaataaataaataataaaaattttaaaaggaattatattaccatctatggcaaacttgagatttcagtgctctcacagaaaaatgtgatccagaatgtgattaactaaattaacaatatacttttcattaattatgaacaatcacacagctttactcaccttattttcagcctaattttgttcacgacttcgtctatgttcgccagagactacaataaagaaggaagagtgcccagctgttagtccacttcctggaattcctctttcacaggaaaatgatgtgctataatagctacttatgaaatctcaaaaaatttaatcacatgatatgagttttgctttaaaaaaaaaaaaagtaaagcagtagttggaagctacagccacatctagcccagcccctgttttttgtaaataaagtttcactggaacacagccatgcccgttcacttacatattgcctgcggctgctcttaagctaacatggcaggtaggcagtcgtgaaagacgctgtacagccacaaagcctgaagtatttactatctggacctttacaggagagtctgctgacccatggtgtacgtgattgtgacaaattcacgtaacgaaatacagcaacaaaaatgaatgaatgcacaacaccatggataaacattttactaacggaatggggcacagaaaaagccagacacaaggggacagaggatatgatttcactaacataattctcctgttagaagctaggacagtggttatctctgggggaaggtagtgacagtgaacaggcaaggaaaggccttctgaagatttttttaaatgttttatttcttgatctgggtggcagttacatggctatgttcattttgtgaaacttcatcaagttgtacccttaagatttgtgtactcctctgtattatgttatacttcaataaatacacaaatttattttttattatatagatccactagaaaaaagtctggaaggatagataggagtaattgtaatgtattagtagttgcagcattagtagctataatctatcaactacgtattgcaatatgaaaagaagtgatttcaaatttttcttcttgggccgggtgcagtggctcacgcctgtaatcccagcactttgggaggccaaggcaggcggatcacctgaggtcaggagtttgagaccagccagaccgtcatggcgaaaccccatctctactaaaaatacaaaaaaaaaaaaattaggcaggcttggtggtgggcacctgttgtcccaactactcaagaggctgcggcaggagaatcgcttgaacccgggaggcagaggttgcagtgagctgagaatgtgccattgcactccagcctgggcaacaagagcaaaactctgtctcaaaaaaaaatattttcttctttttgtctgtattttataattattgactatgcactactactgtgattataataagcttattataacaacaattaaaacaaagggatcacttctgaccttagagatgagaaaatgtgaggaaatggtgccccctaatggacaagaggaggtacaattttatagtactattttaattcaagttttcaaaatacaatttaataaatcctcttcctctctcccttaacaaatattttatctcagaaggaattagggatattgtaggaaatatgcttataaattgcttctggctacctctgatgggaggaggaggccaggtgccttccaggagcaggtctggtaagagaaacaggccatgagtgtttgagatgtcagactgggttgtcacagctcatcctactgttctgaccaagccaacagttactcagaattttcagaaatccaagaacagcttgaggtaaaaatgaatctcaggctggacgtgatggctcatgcctgtaatcccagcactttgggaggctaaggtgggaggatcacttaaatccaggaattcaagaccagcccagacaatacagtgagatcccatctctccaaaaaataaaaaaaagttagccaggcatggtggcatgtgcttgcagtcccaggtactcaggaggctgaggtgggaggatcacctgagcccagaaggtcgaggctgcagtaagtcatgtttgcaccactgcactccagcctgggctaaacagccctgtctcaaaaaaaaagaaaaacgaatctcagaaaaattactttaatttatatataattatatatatacatatatttttgtgtgtgatggagactagctctgtcaccaggctggagtgcaatggcgcgatctcggctcactgcaacctccgactccctggttcaagcgattctcctgcctcagcctcccgagtagctgggattacaggcacatgccaccacgcccagctaatttttgtatttttagtagagacggggtttcaccacgttggccaggatggtctcgatctcttgacctcgtgatctgcccgccttggcctcccaaagtgctaggattacaggtatgagccaccgcgcctggccaagaggaaaacatttctaatatcattttatgatagcaagtatttttataatatcaaatagcctacctttaagatggcggctcactctgtcaccaaggctggagtgcagtggtgcaatcatagctcactgtaacctcaaactcctgggctcaagcaatcctcccaccccagcctcctgagtggctaggaacaaaaaggtacatgcactgagcctggctaattttattattttgttataaacacagggtcttgctatgctgtccaagctgatcttgaattcctggcttcaagcaatgctcccgccttggcctcccaaagcactgggattacaggcatgaggcagtgcacccggccctataatatcatttttataatataatgaatgtagcttttaaaaagaacagaggccgggtgtggaggcttatgtctgtcctttgggaggctgaggtgggtggactgctagagcccaagagttagagaccaacctggacaacgtggtgaaactccgtctctacaaaaaaatagaaaaattagccgggtatggtagcacacgcctgtagtacaatctgcttattaggctgaggaaagaagactgattgagtctgtaaattccagggcacagtgagctgtgatggagccactgaactgtagcctgggtgatgggtgacaatctcaaaaagaaaaaataaataaaaataaaataaaaataggctgggcgcggtggctcatgcctgtaatcccagcactttgaggccgaggtgggcggatcacaaggtcaggagttcgagaccagccaggccaatatggtgaaaccccgtctctactaaaaatacaaaaaaaaattagccgggcgtggtggcaggtgcctgtaatcccagctactcgggaggctgaggcaggagaactgcttgaacccaggaagcagaggttgcggtgagccgagatcgcgccactgcactccagcctggataacagaaggagactctgtctcaataaataaataaatagaagagaaagaaatatcctaaagttacactatttgatagtcaggtggcctttgggtgactgttttcccttcatttccaggctttctgctggaggggaaagggaaaggctgctagcatttaatgtggatctcctaggcaacaattgcaggcacttcacagaaattatttcccttaatcccctctgccaggcgaggcacacttttctcctcttcaacgttaagattgggaactatggaggcggaggccgggcatggtggctcatgcctgtaatcccaacactttgggaggccaaggtacgtgggtttcctaagctcagcagttcaagaccagtctctgggcaacctggcaaaaccctgtctctaccaaaaatacaaaaaactacctgggcttgctggtgcacacctgtggtcccagctactcaggaggctgaggtgggaggatcgcttgagcctgggaggcagaggttgcagcgagccgagatcacaccactgcattccaacctaggtgacagagtgggaacccacctcaaataaaaaacagatgggaaacgtgctctgcaggacaggtgctttgcctgaagctgcagagatcccacctcaaataaaaaacagatgggaaacgtgctctgcaggacaggtgctttgcctgaagctgcagagatcctctttcttactctagcatctacctctaacgcaatgattcttgacctaattttcctgcaccccaagacaccggacagctatgacacacccactctcatcagttagttcagtgtctggctatggcagtgatcctcaccagggtcgagggcctctcctggagttggggaaaagccctgtgggaatccacattggctgggcagaggggtttatcctgctttgagaatcactcatctcgtttagttataatgtggttgtacagttttgtttactttttaaatgttttagttattgcaaaatatttcctgattctaatggtaattcttgacaattacagaaaataggtagtcatctgcacacccaggacagtatgaccacaatcagaatttttgcgtattgccttctactacgaaactgtatagctgtacaaaaataaactgggatgataagcaatttggcatcttttttttttttttttaaggcaggatctcattctgtcacccaggctgcagtgcagtggcacgatctcagctgactgcaacttccacctcccaggctcaagcgatcctcctgcctcagtgatccacccgccttggtctcccaaagtgctgggattagagaatacagccatgagctggatcttgggtttttttttctcttaacaatacagatccagagcatttttggggtcaccagaaactctttagaaacatccccatataactcttttctcaaagttcctaattatgttagttttgtattagttttccataaatttcatttagtttcctctaatcaaactttcaaatgattatcttcagtttactattaggaggctaaaacgattttctagaccactgcgaccaaacctggctactatttaaaccccacaggcactctgctgcatggaaaatcccaagctcctctcaggcctggctgggtgaaatagtaagaggcatccattccaggccactcaacaggctccagacaaccgcagacacacaagtacttccactcaacagaaacatattctcaccctcctcctcacagtaacactaaattcactctggaaatactgaaatctactttaaacaatctaaactcataatgtacaagtgtttactggaggtccatgaggtatacagatggtttttgcccaatatctgacaatagttaaatttcaagctatgccactactttctactaccttttcattaagatccacaggaatctggcttagatttcactcagatgacctgctaagtgaaactctgagactagagaagtaaagataaccctgtgtcataaatgttctgagttactctaagaaacgtgactgtacattatcatatacctggggcataattagacaagacacagaactgaatctgtggaacaacaaagatcttgagttttcagtagtttaaaaaaaaatacagcacatacacacacaccacaagaggtgagaacctggtggtttcctacaaaattttcaaatctaacacttctttttgttttggtgaatcagcaattactatctttatcctagctattcccaaatgtctatctccagctaattcctaaaattcccctttcatacaaaatgatgagctataaaggcttttcgtgaaatctcaaaaaagacaatcacacagtatatcatcttttaaactttattttaaaaatcagtatatccattaaaaaaagtttggaaggatctgccaaaatattcacaatgatggggatcaagagctctgcactcaaatacccaacaacttatttccacctggatgacctgagtatgttcaaacttgggctcaccttacagcccactccagccctacctgccactgaaacctgctctttctccttacactcagtaattgggtaaagtggaaagctgccattacccatccagtcagccaaatctggctacctagaaaccagttcaaaattcttaacttagggccaggcacagtggctcaaatctgtaatcccagcactcggagaggctgaggcaggagggtggcttgaggccaggagttccagaccagcctgggcaacacagcaaggcccagtctgtaaaaaaaaaaaaaaaattaaaaatcagctggggctgggcgcggtggctcactcctgtaatcccagcactttgggaggctggggcagatggatcatgaggtcaggagatcgagaccatcctatcctggccaacatggtgaaaccccatctctactaaaaatacagaaattggctgggcgtggtggcgcgtgcctataatctcagctactcgggaggctaagacaggggaattgcttgaaccagggagtgggaggttgcagtgagccgagatggcaccaccccaccccaacctggtgacaaagcaagactccatctcaaaataataataatactcagctgggtgtggtggcacacacctgtagtgctagctactgaggaggctgaagtgggaggagtgcttgagtccaggaatttgaggttgcagtgagctatgattgtgccactgcactctagcccgggcaagagagtgagaccccatctcaaaaaaaaattattaacttggcctgtagtattcagctaaaacaccatttcctcaagggagtaagccttttcaatccatcttgagcaagtaaggccctgggttctgctgtcactgtatttggcatgcttccttcatggcaacgctatcacatttaagccgagtgttatctttccgtgcctcgtgattcttactctaaaataagaaggataacaaagtggagtttatcactgtttagtgcctagagtgctgtcgggtacacaggaagtatctaataaagattactattacagttgtagtaaaggttatataagagcaagtgacaaataatatttaaaaattatatgagcaagtcaggccaggcgtggtggctcacgcctgtaatcccagcactttgggaggtcaaggtgggcagatcacaaggtcaagagattgaaaccatcctggccaacatggtgaaaccccgtctctactaaaaatacaaaaattagccaggcttggtggcgcgtgtctgtaaactcagctactcaggaggctgaggcgggagaatcgcttgaacccaggagttggaggttgcagtgagccgggattgtgctactgcattccatcctggcaacagagtgagactcagtctcaaaaaaaaaaaaaaaaaattacacaagcaagtcattgtaacatcataatttacctataatctgttactgtgagattaactatcaagatagactatgaagtctgtgttggtagactatatctgtcttgctcacttctctaccccagatttcttataaagctaggtagagtgggtgtttttttaactgaataaacgaatgagtgaattttggattctccatgaccctctactttcatgccctcaggtaccaaactgcatgactttggtcccctcaatagctctcagatctggttctctctatcccacagcttttctccaggtctcaccatctctttccagtgatctactgcgtgagtctcctgcctgtagtctctccccacctccatcccttgctcgtcctccacatggctgccagacggaattttaaaaacgtgaatgtgctccagtcattatcctgccaaaagtccttcaatgaatactcactgcctacagcagcaacctccagagcagggtgcgaacgtccccacggggtctgccacactgccccctggggtgtgaggagcaaacactgaagcctctatgtttattttctatttatatagcaaatactactgaagcctaacatttaaaattggtactcacatatgtatataatattctggggatacaggcttaaaaattatccaagtgaaaatcagctctgtgggtcgggcgcggtggctcacgcctgtcatcccagcactttgggaggccgaggcgggcggatcacctgaggtcaggaatttgagaccagcctggccaacatggtgaaaccccatctctactaaaaatacaaaaattagccgcgtagtggcaggcccctgtaatcccagctgctcaggaggctgacacaggagaatcacttgaacccaggaggcagaggttgcagtgagccgagatcatgccattgcactccagcctgggggacaagaatgagactttgtctcaaaaaaaaaaaaaaaaaaagaaaatcagttctgtgaaaaatatttgggccaggtgcagtggctcatgcctgtaatcccaacattttgggaggctgaggcgggaggatcacattagctcaggagttcgagaccagcctgggcttcgtagtgagatctcgtctctactaaaaaaattttaaaacttagctgtgtgtggtggcatgcgcctgtagtcgcagctactcagaaggccgatgtagtgggagcgctagagttcgggagttcacagttactgtgattgtgccactgcactccaacctgggcaacagagtaaaactctctttcaaaaaaaaaaaaaaaaggaagaaagaaaaaaagcatttcactgaaaggcatgtggtctccaaaaaaactggcaacgataagcctagaggacagagatcctccaggatccttgctctccctcctcagcctcatctcctgtgagtctctgctcactgtgcacatcttatgtctcctgtttctgtgccttggtcctgtgtttagaagggccttctgtagggtccagccctacggggccttgtgggttttctcttcgtgtgcggagacgagagattgtagaaagacacgaaactaagaagtagtaggaaagacagctgggcccggggcaccactaccaccaatgcacagagtccaatagtggccccgaatgcctggacccactgctatttattgtatacaaggcaaggaggcagggtaaggagtgtgggtcatctcaaatgattgacaaggtcaagcaagtcacatgtccacgtgacagggggcccttccctttgtggtagccgaagcagagagggaggacagcagacgtcagcattttttctttgcacttatcagaaagatcaaagactttaacactttcactaattctgctactgctatcttctaagaacttaaaggaggagccaggtgtacaggtggaacatgaaagtggaccaggagcatgaccactgaagcacagcaccacagggagatgctgaagcctccggatgactgtgggcaggcctggggaatgtcaggccccccacgagagctggtggagcagagtgttctctaactcccccagggaaagggagactccctttcacagtccgctaagtaacgggtgccttcccaggcactggcactaccgcaagaccaaggtgccttcaagcagcccttatccaggcatgacagaggttctcactgttgtcttctggtctcctgactctgtatggcctggtttttccttggtcgtaataatgaaacaaagattaatactaaagactaatgattgataatatccatatacaatcatctctatatcctatttctattataactctacttatttaactattttctttattatattggaacaggttgtgccttcagtctcttgcctcggcacctgggtttctttccgcccacgccttccttccctcatcatcctggaagagatacctagctgctggctctgtctagaatactgttctgccagactgctgcaagcttgactccttcctgtccatcaggtctcagcttagagggaaccacctcacagagaacttcccgttaagcccctttatttaaaggaccctccgcagcacgctctgtcacggaacctgcctggtatcacggcgcatcacgctctgtcacggaacctgcctggtatcacggcgcagcacgctctgtcacggaacctgcctggtatcacggccaccatgtttgatcatctctagtgtatttgttggtttatttcttgtctttctccctacactagactccataagaccaagaccagatttgtcatgtttacatttctccctagtttctaaaaataatacctgacacttagcagacatttaataaacgactgctacgttttactaaatgaatacatgaatgaatccctcaagctcggcagacaggctacctcctctctgaagttgtgattttccttggaagaactggtctttgtttccttaccgcactgtcccactgtcactgacggcattcgccagggtctcccaccacttgatcctgcacacctcaagggcatggactggaccttatcatctctgcaccctcagcacctagcacagtgactgacaacacatgacaggcacctactgaacaactgctgactgaaaaaatggaaacgaagcgggactctcactgcccttctcccaactctgctacttccagttctggtctacttctcacccaaacacccaaaaaccaattttgtaagaaaatccatctccacaggaaaatcaccggacaaaaaataataaaacgtgaagtctaaaaatctgtatcttgaggccgggcgcagtggctcacgcctgtaatcccagcactttagggggccaaggcaggtggatcacgaggtcaggagtttgagaccagcctggccaacatgctgaaaccccgtctctactaaaatcacaaaaattagccaggcgtgatggtgggtacctatagtgccagctactcaggaggctgaggcagaagaatcgcctgaacccaggaggcagacgttgcagtgagccgagaccgcgccattgcactccagcctgaacgacaacagcaaaactccgtctcaaaaaaactaataaatagaaataaaaatttacatcttgaaatagaggtgaaagtggctttatgattctgggcttatcctgcctgcctcacccccacttgtccctactacattataaaaatcctttccactttcaatttacagcagaaaatttgggaggactctcacaacctaagagtacaattattaataatatgttcactatacaatgaattccattccaacacagtgtagctcactgccccagctggtgatgatggagtttgatttgaatttaactctcccttgtgtatcaagggcccgtagatgatctagtgtaacacacgaagcataacacccaagatgtgccaaaagctgctgaaaggaaggaaacctgaaactctacttacttgctcggttgggaacagggtattgatatactcaacagcattgaaatctgctcgatctagagggtcctggcttggaaacacctatatagaaagagaggagtatatataaaaacatgtagtataccgtaaatatatataattttaatttgtcaattaaaaggaaagggccgggcacggtggctcatgcctgtaatcacagcactttgggaggccaaagcagatggatcacctgaggtcaggtctctactaaaaataaaaacttggctgggtgtggtgttggcgcacacctgtaatcccaactactcaggaggctgaggcaggagaattgcttgaacccgggaggcggaggttacagtgagccgagatcacaccactacactccagtctgggcgaaagagcaagactctgtctcaaaattaaattaattaattaattaattaaaataaggctgcgcggatcgcttgagctcaggagttggagactggcctgggcaacatggtgaaaccacatctctacaaaaaaaaattagctgggtgccatggcacatgcctgtcatagtcccagctacgtgggaggctgagatgggaggatcaccagagcccaggaggttgaggttgcagtgagccgagattctatcactgaactccagcctgggcgacagagtgagatcctctctcaaaaacagtccacctctaagacatacagctaactccctaacaacctgaagaacacgcaacaaggtggatgatacaagcagccaaattatccactggacactgggtctcacccagcttgatagagttacaactgtgggaagcaacttcatctctgaagaagccttccaaagaaatatagagtcaaaaaatcaaaatatcttcaagacaactgttagaaaagctgaagccttctaccacatcaagaggaggtggatgagaagaaagtgaagatgttttctttttaaaatgttcagcattgctgtttccataatgcacatatacacaggttatttacacagtctcaatgatacgtgctcaccagagggaaagtataacccacagagagcaggatacaagagatacaaactatttcctcaagttgctctcagtttctgtattcctctcacgactcctaggttttagtgctgtcctaggttttaaattgttttcatgtaacaaggctcctaacaaaagccagctgaaaaaagaatgactggttccaatgatggaggaaaaaaactaacagccctagacttatcagagatgcatacgtggtacttcatgggcaatttttttttttttttttgacacggagtctcgcgctgtcacccaggctggagtgcagtagcgcgatcttggttcactacaagctccacctcccaggttcatgccattctcctgtctcagcctcttgagaaggtgggactacaggcgctcgccaccatacccggcttattttttgtgtttttagtagagaaggggtttcaccgtgttggccaggatggtctcaatctcctgaacttgtgatccacccgcctcggcctcccaaagtgctgggattacaggcgtgagcctccacacccggccttcatgggcaatttaaagaacttcagggcagagtgattttcatgtctagagtgactttcgccttttttttttttttttttttcgagatggagtctcactctgtcgctcaggctggaaggcagtggcaccatctcagctcactgcaacctctgcctcccgggttcaagcagttctttgcctcaacctcccgagtagctgagattacgggcacctgccaccatgcccagctaaatttttgtatttttaggagagacggggtttcaccatgttggccaggctggtcttgaactcctgacatcgtgatccacccgccctggcctcccaaagtgctgggattacaggtgtgagccaccgagcccagccaattttcaccttatgcaatgactctgggacttcatcttggagtaaaatgtgattccattttatcaacccttcctgactcctcacacatcactactctttacaagtatgctactacagaatttcattcagagtgctaaagtaagaaaaaattctgaattcatcttgacataatgatgtctgaattctgcttgacataaagatgtctgctatactatcactcaaacttattcttacaaaataggaaaaatgtcagaattcaccgctatgtaattcatccatgtaatcaaaaaccacctgtaccccaaaagctgttgaaacaaacaaaagaaatagcaaaaatgtgcttttctgatacctgtcaaccaaacagtaactgactgcattattcttttcttccatgagagcccactagtccaaagagcaacagaaatgttatgtctttttctggcaaaaggaggtaagtggtggagccgtgtggccggaacactaaaagcttcctgcccaatggtttggcgttctcaggctaggacaaagttggttgtataagtaatccaaccactactggaaaaacacacatcgaagcgtcaatgaatgcacctgtagtcccagctactcgggaggctgaggcagggttatcacttgagccccaggagttcgaggctgcagtgagctacgattatgccactgtactccagcctggacaacagagcaagaccctatctcaaaaaaaaaaagtttcccaggggtcattaaataaggcataatggaattgtccatttcctcaatcataaatccctttcttaaatcatataacttcatgacaattcctttaagggagattttctccgtttatcaggagcaataccctgcagtattagaaatcactatttctgaccgggtgcagtggctcacacctgtaatcccagcactttgggaggccgaggcgggcggatagcctgaggtcaggagttcaagaccagcctggccaacatggtgaaacccggtctctactaaaaatacaaaaattagctaggcatggtagcggttgcctgtagtcccagctactcaggaggctgaggcaggagaatcacttgaacctggaagcggaggttgcagtgagccgagatggcacccctacactccaacctgggcgaaagagcgagactccgtctcagaaaacaaaaaaaaagaaaaaaagaaaagaaaaaaatcactatttctaatatcattagccttaaaaactcaataaacttgcaaaggcaagagttcctgcaggcagggccgcgcgtggtggctcacgcctgtaatcccagcactttgggaggccaaggcgggcgggttacttgagctcaggagttcgagaccatcctggccaaaacggtgaaacccccgtctttaccccaaaaaaaaaaaaaaattagccgggtgtggtggcgtgcgcctgtaatcacagctactcaggaggctgagacaggagaatcgcttgaactcgggaggcggaggtcgcagtgagccgagatcgtgccgttgcactccagcccgggcgacagagcgagaatccgtctcaaaaaaaaaaaaaaaaaaaagttcctgaagggaaaagaggccccttgggagtattctccaacctcacccaaactattcaacggtaggaattctcaaccttttaagaatggtaacgatgtcatttttcaacactttctctcttctctgccgtccgcttcagaaattaaagtcattcccttcccccagttccaagccactcacgaggtgccagcttgcaaaaccggggcgttggcacgagtctggtaaatgcatgaagcccccacagtccccagaatctgaggatggcacccaaggcctgcattctcctagcgtcgtcctctctaagcgcacaattcctttccccaaaaccaccagaacccccagccctcgccaaagacaatcaaagcctagaaagggttctctttcctttccttctgattcagaaaccgcttctcacccgcaccacctccccacctccactttcccttctgccgcgagcccccggccctccgtccacccgccgcggcctccccagcgcccggagctgccgtctcccctcccgcactcccgtttcccctcctgaggggcggaacgcttacctgctcgatggccagctgcacctcgggcgtgagctgcagcacggcttccagctcctccacgaactccagttcctcctcctccatcattccgccacccggccccctgccgacccccgccgcgagcccaactcaggcctccagccgccacccaggccccagcacagcaactccctcgcggcagcgacctggtgagcccggctccgtcagccgctctgtcagccgctccggcacttc

SEQ ID NO: 1854 - DNA, 206190 bp, Homo sapiens
agcctgttaccatctctgtttaattgaagagcctctaccattgcaagaagagctgtttaaaacaaaacaaaatggatactatttgaaaattcttagctggattaaatcaagatttctctattctgtgcaacccagaagtaaactggggttgatacacacacattttcatccataaccttggtttaaagtgcttcctatttgctggaatagttttcaatgcttttactgatttcttctgaaaaatatttgaactcataaaatgtattcataaaatacttttatctattttgtatagagggaatccaatgtaaaattttgtcccataaatttgaaaactgctggtgaagtacaaaaggcatggatgttggaatgaaggctggagccaaatcctggctcgcccccttactagtcacatagcaaatcctggctcacccctcactagtcacatatcaaatcctgtctcacccctcaccagtcacatatcaaatcctgcctcacccccttactagtcacatatcaaatcctgcctcacccccttactagtcacatatcaaatcctggctcactcgtcactagtcacatatcaaatcctggctggctcaccccttactagccacatatcaaatcctggctgacccctcactaggtacatatcgaatcctggctcacccctcactagtcacatattgaatcctggctcacccctcactagtcacatgtcaaatcctggctcacccctcactagtcacatatcaaatcctggctgaccccttactagtcacgtatcgaatcctggctgaccccctgactagtcacgtatcaaatcctggctgaccccttactagtcacatatcaaatcctggctcgcccctcagtagccacatatcaaatcctggctcactcctcactactcacatatcgaatcctggctcacccctcactagtcacgtatggaatcctggctcgcccctcactggtcacgtatcgcatcctggctcgcccctcactggtcacgtatcgaatcctggctcgcccctcactggtcacgtattgaatcctggctcacccctcacttgtcacgtattgaatcctggctcacccccttactagtcacatatcaaatcctggctcgcccctcactagccacatatcaaatcctgactggctaacccctcactaaccacatatcaaatcctgactggctccacccctcaccagtcacatatcaaatcctggctcgcccctcaccagtcacatatcaaatcctggctcgcccctcaccagtcacatatcaaatcctggctcgcccctcaccagtcacatatcaaatcctggctcgcccctcaccagtcacatatcaaatcctggctcgcccctcaccagtcacatatcaaatcctggctcgcccctcaccagtcacatatcaaatcctggctcgcccctcaccagtcacatatcaaatcctggctcgcccctcaccagtcacatatcaaatcctggctcgcccctcaccagtcacatatcaaatcctggctcgcccctcaccagtcacatatcaaatcctggctcgcccctcaccagtcacatatcaaatcctggctcgcccctcactagtcacatatcaaatcctgtctcgcccctcactagtcacatatcaaatcttggctgaccccttactagtcacatatcgaatcctggctcgcccctcactagtcacatatcaaatcctggcttgtccccttgctagtcacgtatcaaatcctggccgaccccttactagtcccatatgaaatcctggctgaccccttactagtcacatattgaatcctggctgaccccttactagtcacacatcgaatcctggctcacccctcactaggcacatatccttgggcctgtcacttaccctctttgagcctccaagtcccgtccactaaacggagcttaacttagcaggaatttcatccgatgagataatgtatccaggacacagtaaatacacagttaccttttccttcccaccccaccaacatgtacagatagcactgaattgcccaggccctctcatgacctaagataccacatgcaggccacacagcagctggactgtgcagccagggcccagggctaccccaactgacctccactcccctcagcaccctcctctggcctccgagctagccagctgctgatccaaagctctggatcctttagggctgtgcaaagatgtgacaggcatgggtatgaggctgtgggggactctgtgtgtaaactgatgtttctttgtatagcatttgatattcggtgtgggtatgaggttgtggggggctctgtgtgtaaactgatgtttctttatacagcatttgatattgggtgtaggtatgaggctgtgggggactctgtgtaaacagatgttttctttatatagcatttgatatgtattccatttgccttctaaagccctccagtggctgctccagttggtccactgcagtgcttgattttgtgaagaaccctgtggaatgtggtctctggcagctgagaagtgccttccttttccatcagcgcaaggcaaacacatgaagggagctggggtttcttgccaccatttcacctgagacccctgaaagctgcagcccacactgcaaatacttttcttggccctggaagtagagggaagtttgttgagaagctgttcttaatttctcacttgttgaaaaattacccaaaacaggaggcaagacaattgtgcaaattccatttgatgactgagcagaagctcccagaaccctcggatgaagtgagcagcattcccaggaggcgggacgttggacgctatttttattttaacatctcatattgccccaggttctctgagtcaacaccctcaaaggggacagacagaaacagaaaggaacttttgggctgattataaggattcagctggccttgggaaaagtctaaacatctttgaaacacaattggaaagtaatccaaacagcctgtgagctcaggcttcccagttagaactgcctgtcccaagttaatcttgcttagttttttggggggcatcatacctaaagaagaagaagaagaaaaaaggcaagaataagtaaaaggaaaaaaaagaaaaagaaaggcaggcaagaatttttgtccctgtcgggagaagagtctggtctgtggacaccagacacctaagcaagtttcttggaagggaggctttggcaaccctcgcaattcgcattcacaggagacatgccctattttccacaacaggcagcctcgccaccagccccaggagggaggaagctctcttctcagtgtctgcaggtttatccctaaatgctacggaagcagcagctgccaggggaaggggatactgctcagtcttttaaaactctcgtgtaagcttgatattacagtcatgacctaaaaaggcaaagaccagatatgcggagctcgctgcggatgtagcctgcacacggccgcaggatttgtcaccactcatccatgtttaaaaaagccagtccaggcaagacagccacaggctcccgcccacaagtgatcacgaacacacttcacactgccttatggcagagcaagtgcatatagcccggtcttgtgtgaccttcacagccaatattcattataatcccctctcaccaatattgaaaatggatgctcaggggatcagtgactcgcctggtgtcaaagtgccaggtccaaatcaagacctgcagatcaagtcttctgtggatgcttccaatcccaggctgctttcatttctgatggacacgtccttcatgtcccacagatccatggatcgccggcatcttccctcctgttcacataggtgagaaggaaggagctggcaggcaatgcccttccaggtgggctacagggaaggttcttttctcattaggttgatcccttggcttccctagtaaagtggggagctgttgaaaagaaagaatggaaacgaggtaatgatcctggagcctaatggaagggccgcagccagttttcccctgttgaaaggacacaggacttcccgaagagttttcatggcaaaaacgtccaaccagctactaaggaaacaggatggactcatgcgtgcaggagagaaatcactaaaggacacaagacttcccaaagagttttcatggcaaaacgtccatccagctactaaggaaacaggatggactcatgcgtgcaggagagaaatcacttggccgtcactggaagagcaggctgtgatgggaacggtaaggacagagaagggaaggttcacaggatagaaattcacagggcaagtagggttccaagtcagaagcaaaacactttacacaacattacagacaggctccactgcaactgggcaggtcaggactgggctcagtcggccacattctgctcccacgcgttgcttccttagactgtcagggaagggagaagggcagccaccaggagcggccagggtcacggacttgctacttctttcctagagtctgttctgttttctgtcagcagtaaggaaatacattctagcaaatgacatccagtaatgctttaattaactgcagtattttgtgctccaacatgcaggcagaaatcacttccagatggagaaaatgaaagctatttacacaaagaagcaatccctttattttaaggaaatttatatctcccaaaggtgtagaacttcgagggtccaagaggctattctgatgaatactaaaacaggactgggaatttttatttaatatataaaatgtcatcgtacccttcatgtaggccagcatttcaggtgtccatgtttctaaggcttttgcttaaattgcccattggagctctattttatttttaggaatctgacttggagtagacgagaagtgtgagacacttgctgtcaccctcaagcaggcaggttgttctgagtgctcttcctagcgaaggaatcccatttccagcaggttattccgagtgctcttcctagcgaaggaatcccatttccagcaggttattccgagtgctcttcctagggaaggaatctcatttccagcaggttattccgagtgctcttcctagggaaggaatcccatttccagcaggttattccgagtgctcttcctagcgaaggaatcccatttccagcaggttattccgagtgctcttcctagcgaaggaatcccatttccagcaggttattccgagtgctcttcctagcgaaggaatctcatttccagcaggttattccgagtgctcttcctagcgaaggaatcccatttccagcaggttattccgagtgctcttcctagcgaaggaatctcatttccagcaggttattccgagtgctcttcctagcgaaggaatcccatttccagcaggttattccgagtgctcttcctagggaaggaatctcatttccagcaggttattccgagtgctcttcctagcgaaggaatcccatttccagcaggttattccgagtgctcttcctagcgaaggaatcccatttccagcaggttattccgagtgctcttcctagcgaaggaaccccatttccagcaggttattccgagtgctcttcctagggaaggaaccccatttccagcaggttattccgagtgctcttcctagggaaggaaccccatttccagcaggttattccgagtgctcttcctaggtaaggaatcccatttccagcaggttattccgagtgctcttcctaggtaaggaatcccatttccagcaggttattctgagtgctcttcctagccaaggaatcccatttccagcaggttattctgagtgctcttcctagccaaggaatcccatttccagcaggttattctgagtgctcttcctagggaaggaaccccatttccagcaggttattccgagtgctcttcctagagaaggaaccccatttccagctgtgcacatgcagcatttcccctggcattctttcaacagggaaccaggtctcctcatccgatggcaattcaggaagggttggtgtcataccctgcatcgagcagcagcctcggacctgcccccacgctctgcgtgccctgtactggtcatgctggtctcagcttgtctgctctcagtcctgtctgatctgcacagaggagccaccctagacataagaaatcaggcaccccttctcgggggtgggcagagccctgggtactggctctttgttcttcgagagaggaaggagtggcggtagttagcttcaatccctgagctgggtttggagatcagaacaccttgtccattgcggctcctgtttcattgttaagagtccacacaggatgttctctggcctggacaccgctaagccagctttcagacaagtcccctcagtaagagcagagtgaactctttattgattatacaaattaccactatttattttaaacccaaagtgacttcaaagttgttttttggtttttaaaggggctacagaaaatggactgaggggaaggaatgggcacaatatctaggtctagctgaatcacagagctgttagctgctgctttcatccacaggtactccttttaccttattattttttagagagtcttgctccgtcacccaggcaggagtgcaatggcatgatctcggctcactgcagcctctgcctcctgggttcaagcgatcctcctgcttcagcctcctgagtagctgggattacaggcgcccaccaccacgcctggctaattttgtatttttagtaaagacagggtttcaccatgtcggccaggctggtctcgaactcctgacctcacatgatccacctgcctcggcctcccaaagtgctgggattaccagtgtgagccaccatgcccggcctattttttaatagagatggggtctcactctgttgcccaggcttgtcttgaagtcctgggctcaagcaatcttcccacctcagcctctcaaagcactggcattacaggtgtgatgccacagtacccggcctagggtgcccctttgatacgttatttttgaagtgatgttaataaataaagcttctgcttgggggttggtcatcaaaacaagaagaatcctcatcagtatggagagagcccaatcctgggcatggtccccaccaccaccaaaagtcttttttttttaactgagtctcactctgtctcccaggctggagtgcagtggcgggacctcggctcactgcaacctccgcctcccggattcaactgattcccctgcctcagcctcccaagtagctgggattacaggcacccgccacctgcctgctttttttttttttttttttgtatttttagtagagatgggattttgccatgttggccaggctggtctcaaactcgtgacctcatgtgatccgcccacctcggcctcccaaagtgctgggattacaggcgtgagccaccgcgcctgacccaacacaagtttaaaatgaaagctgttatcagtagagaatcttcaccacgttggcaccagctcaagtgtagtgtcggcgcacttttagcttagagtcagaaaaatagacatgtatgaaaatgcgtggcaggagcccttccataaagcaaatctctctgttgcagtggttcttaacaaggtgtaaacgttataactacctatggaacttttaaacctgtatgccaggccccatccaaacttactgactcaaaatctccgggcatctgtttttttgtttgttttgagatagagtctcactctgtcgccaggctggagtgcagtggcgtgatctcggctcactgcaatctttgcctcccgggttcaagcgattctcctgcctcagcctcccaagtagctgggaggtgtgcacgccaccacaccccggtaatttttgtattttttgtagagatggggtttcaccatattggcaaggatggtctcaatttcctgcgcttgtgatccgcccgcctcagcctccccaagtgctgggattccaggcgtgagccacggcgcccggccggcatctgtagattttaaaaggccccagtggttctgatgcacacccccagaagagaaacacagcgtctctacacagtactgagtccccatcaaggagacatttaacagaaactcctactgacatccattggttccttggggattactgacaatgtaacaaatcaagacagcaacttccctggctgtgaccaccaactgtggaaaacagcagcttgatagctcaatgctgtgatggagccgtccggaaaacgactcctcaacaatgaaccaaaaagagaagtggtgatctgtacacaaacgccaggagtgacaagaaccaggtgcaggagtccactggctttcccagctctcctgggttgaggacagacggctgaactggctgtgctatttggagatgggccccaccgccccttttcaactgtacggctcaggctgcttaaccatagcaactccatgggctggggtgggggcatctacagggcttcctgggggctctcccgactgccgccccccgcccttgtcttatttggaatcttttcctaatagacctcaactgaaggccgcatctccttctcgcaacacttcttttctcctccgcattctcaaatttgagacgcttgatgcgtgagagtcaaaccagctagcaaggacagcctggaagccgatgaagaaatgacactcaggatcagagctggacggcatcggggagaaagcctggcagagagggcaggggcacagagcagtggttatgttgggaaacaaggtggggatgaggaaatcaggtttccaggcagatttccaaaccttattcctactgtacggctgttacaagttttatggattttaaggaaatttcctctatcctgaaaactttttgagaaggggtcttgctctgtcacccaggctggagtgcagtggtgaaatcttggctcactgcagcctccacctcccgggtttaagtgattctcctgcctcagcctccccagtagctgggattacaggcactcgccatgacacccggctaattttttttatttttagttgagacagggtttcgccatgttgggcaggctggtctcgaattcctgacctcaggtgatccacctgcctcagcctcccaaagtgctgtgattacaggcatgagccaccacacccagccaattttttgtatttttggttttgccaggttgcccagactggtctcaaactcctgagctcaagcaatctgcccacctcagcctccctagcagttgggactacaggtgcatgccaccacaccttgcaaatttttatttttgtagacatctgtatgttgcccaggctggtctcaaactcctggactcaagtgatcctcctgccttggtctcccaaagtgttgcgactacaggcatgagccgccgtgcctggcaagatatcattcttcagcaaaagcaggcagcaacagcagcggtttgcctgtagctgtggtcatggttaactgaggcctggtttcaagggaaccgagtgaatcagggttaacggcttgatatgctgccattctctggatgcaggatgacatgagaggtcgggagcagtctcttcggcaagccctgctgcagagagcccgcggtggacaggaagggcggggggggcgggcaggctgcgtgccaggccaggctctcagcctggtctttaaggtccatattctgttcctgaggcatccagaaccccagactccttctcataacacaggaacacatcactgggatgctgcacatcacctttgctatttcagatgacgctggaaagtgctgtggacctgaaggtgagtgggcagaaaggggtttgagagtatggacttcctgggcgttcccatggcttcatctgatgagaaaacctaggaaacgtcttccaagtgaacttcctggtttcccttccctagaaaccaggagcagggtgggagtaaagaaatggaggaaggggctgggctcggtggctcacgcctgtaatccgatactcaggaggctgaggcaggagaattgcttgaacctgggaggcggaggttgcagtgagccgagatcacgccactgcactccagcctgggtgacagagcgagactctgtctcaaaaaaaaaaaaaaaaaaaaaaaaaaaggacgggtggggcccacgtgtcaagagggtgtgactgccatggggaggctacatgagtcaagggcagctcagggacctatcctccactgctgcctctgcttcacgaaccagagatcacctaaatcgccctcttagagcccagcccttactcagcgtctccgattagggcaggaagtaagacagggcatgggagagactcagtaacaacccacatgtcccaggaagtttgaagaccgacgatgtgagagtgccggggagcacaggagaggttgggggcttctggggaacgggcgctgagggtctccagccaggagcaaagggccccttgctgctgctacagtctctttttaatgagtttctcgagcttgcggatgcgtgacgactcttgctctggtgttggcgccgtcagggacagtgagccggagctttctgcccccgagggcggtgcggggagccgctggcgcaggagttccagcatgctgctctgctcactcctcttcagcccctgaggttgagagagaaacagaaccgtcacgaagtctgggccagaatggcccacgggggacagcgcagtatctggatatggggtcagcagaggctctggagacagcatagttactccaggctgaggatgaaccgtttcctcaagggactcaccatcccctgggtagtagcgtgggaggaaaagagaggggaagaaaaggtaaaggaagggaaagaagcggctgacagaggagaaaggacaggtcaagaaggtgggaaggacaacatgcctgtcctcatccccctgcccctgccccatcctccctgtgcaggtggtctcagcggggcatgcagggcctgtcagaatcctgaagtgcacgtgcccggggccatcctcctccagaggcttctctgaatccggtttgctctgtggagccaggcacatgcattttgagaaagcccccccggaacttatatcccaattcccggttaagaaccgctgagtgtgagggggatgagcaggtgtggaccaaatgtcccggcacaaaccttcatgtccagtatcttctgaaaggtttctgtgttgcagtctgtgagaagtttgatgtagttgtcaacaaacaccaccaacggttcatgaggggccatcactacctacagcgggaggagacaggagcaagcccctcaggaaaactaccaccacgggaggagacaggagcgggccctcaagaaaactcactacccaccgcaggaggagacgggagcgggcccttcaggaaaactcactcctcacttgcccgccgagcgctaaatggattctgagaggtttccttaagcagcagcaacccagactagaaacgccccagtggcccatctcatcttcacatgccactacagcaatgtcctaaatttgctgaatcctaaatacacctgcgctgctgtttgaagtatgggtttccggggccctcctctaaagactctaattcagtaggcctggctggagtcccaggtgacttttaaactatcaggaccatccgggaaaccctgcgtgagagggtctcctgttccaggcatttcaccagtacacggtacttgctccttctgccttgacgtactatgattcctgagaaatgggtggcaaaaggagctggtataagtaagtggatttctgcaaaaacaaaaatgccaaagctgcctcaccttttggagacttaaaatctgtaacttcatgtaacgactaacttaaactatcaattaacatacaaacaaaggaaaggaacggcactgcaacccttattcatttccgttttgttctggaatgcagtatctgattttctttccccagccgactgatttgttttgaattcctgagactgaagggaagagtggcgaggaggagttcactcaggcatcctctgccgataattcccagaccacaggctctcctccccagcagtaagcagcagggaaagaacatgatgaggcagcttcaccctcacctacatgagctcttcaccctcacctacatgagctgcttcaccctcacctacatgagctgcttcaccctcacctacatgagctcttcaccctcacctacatgagctcttcacccttacctacatgagctgcttcatcctcacccacatcccaccggtgtctgaggccctgctgccacttcctactcctgccgtccctgagtcatctggtttaggaagtggcctgaagagcctacaggtcctgggcttttaagaccacatcaccacaggaccatctgttctccagccctcatccctactcttcaaaatagctggaaaccagaggcagatgcgcagggcttcagacgttcctcactcgaagtacagtcttgttaaatggggctttaaaatatccatttgctgattagattcagttactacaacatctgttcagagttcatttaaagtggcagagtacagaaagccaaaaaggctgatgtggaagggagtaactgagagctgtgcctgaaattcctgctgagaagcggagatccctgacatacactgattcacagtggcaaccacctaacctccaagcttgaccacatttgatcacaagagaatcccacgccaacaagaaattcatttgtcagaaggaattactgagccctaataactatccacagactttcaacaatatctgatgaggccaaaatccagtccagcccaagaatgtggaccatgctttgaggccggtgaggataggacctaccctgtgctttcaaaaccaaggcttctcagaaaaagagattaaataaataactggccccttttaacacaagccatcaccttgaggatcatctcagcccgggtcatgcctttgacaacgatcttggtgtagctggcgggtgccttcctcaccacctgcgagctgatggaggggagatcgagcaggaccatcttcagcgagtgggtgtccagcagcagctgtggagcaaagcagagagcattaccggccccttccagcgacccagtgccgagtggactcatgccgatgagtcatgtttttctcgttatacacgtaacacattcttgttgcaaaaaattggggaaataaacagaaatataaaagaaaaaaattatgtataattcccatcacctaggagaaacaacatcaaggagccagcctatgtgtacgtatataaaaaactaaatcagggggccaggagccgtggctcacacctgtaatcccagcacttcaggagggccaggcagcaggatcgcttgagctcaggaatttgagaccagcctgggcaacatggcaaaaccccgcctctacaaaaaatgcaaaaattagccaggcgtgggggtgcgcatctgtggtcccagctactgaggaagactgaggtgggtggatcgcttaagcctgggaggttgaggctgcagtgactcaagattgtgccactgtaactctccagcctgggtgacagagggagaccctgcctcagtaacaaaccacaactcctccataaaactaaatcagaatcatactgtatgtatattcaattttataacctggttttctcacttaatatacacaatttttatattctattttcccatctttgcagtctttaaaaaacaaatcaaggtttttaagtgcactctagcctgggcctcatggcgagaccccatctctaaagaagaatcgtgatttaatggctgtgcagtactctgtgatgtgtgtggttgtgtaaactttaagatctttccaatggaatggacccatttacacctctgccagccatgcagactgcacccttatcagcactgaaaactcatcaaatcctgattattcattaggcaaaaaatagtaactcattattgttttactttgaatttctctggatgttactgaggatgtaggagatttacccaaatgtaaacattgtatcctggcaacaatctaccttttcctctttgtttgttctggttctctgggatgccaattatctagaaggacacccatagtcctaaaggctcactgactgccgggaatgacatgaggaacgttttgtcacatttaatctgagtaaagccttacctaccctggatgttatttattgttcccattttacagatgagaaaaagttccagaggattaacagctcaccaaactcatctcatgcaacggacggggttagacaaaagttggacgggaagctggaattcatttccggttgccaggtaacggggttagagaaaaggtggactggaagctggaattccatttccggttgcccaggtaacggggttagacaaaaggtggaagggaagctggaattccatttccggttgcccaggtaaatgtccctgggtggttttggtgacgagctcacactgactcctgctgactgccctgctctgctgccgccgctgctcttggcaaccagggagcagagaaatggctgaagacagaagggtgtactctggcctgttgagatggcttaggagaatggaaccacatggtcaccaagcagacaacggcagcagtggggtgacagctcccaatgccaccactcaactccggtgataacggccaaacttatattcagggcaaggcctgtactctctgccactgcctgcttctttgggaaagccttctgtaatcctatcaggtaggtgagaaatgggacccttcaggccctgcgacactttgcatcctccaatttcctatttactttgctttggacagaagaattaatgattaaagagaaactaagtaacgacagatactatgaacttaagggttatggcaattgtaattttaacaatggtagaaacatggggaagacgtcagtgttttatgtggaataatttaggtgtggtaaggaattacactaaggtcagagcaatttcatgcagctagtcaaaggcctgcaccacgcaggtcattcaactgtagccagcaaagtgcagggcattttggacctttctggatttctagagatagaaattcttactatcctagtgtctgctttgttgaaaaggccaagggctcagagaaaagggtatgcaaacctccaggagggggaatggcactgattgctcaaggcccacgtgaagagcctggcgttagcgcactttccagaattccagtggaaatgactgctgcttttcctcggaggaacccagaacaagcctctaaagcattctaggtggattaaattcttagatataaaaaagaaaaactttaagaagaaaatacagggcgcagtggctcatgcctgtaatcccagcattttgggaggccgaggcgggtggatcatctgaggtcaggagttcgagaccagcctggccaacatggagaaaccccatctctactaaaaatacaaaaattagccgggtgtggtggcgcatgcctgtaatcccagctactcgggaggctgaggcaggagaattgcttgaacctgggaggtttgcgctacagcctgggtgacagaacaagacactgtctcaaaaaaataaatacataaaaaataaaaaataaaaaagaagaagaagaagaaaatacagagattattttcattgcttatgggtggagaagaatgtcaaacatcagaaagaatgaaccacctaccctaaaatgaaaggcatctatatcagaagaaacaaacaaagtaaaagacaagacataaatcaggagaagatacgtgcaacgttgacaagggaacggggttccgaacatgaagattcctacacatcaacaggaaaagcacaaactatcccaacagcgacacaacaacaggcaaacaatactaacaccggattcacaaaagaggaaactcaaatgcccgaaaggcatatgaaatgacacgcaacctggttagtaactgggaaatgcaaattaaaaccacagatgtacaccataatacatccatcagagtcagaagtaaacagattatttgataatcaagtgtgggcacggccatggcactgaaattcacaaatgtacaccgtaatacacccatcagagtcagaagtaaacaggttgataatctagtgtgggcacggccacactgaaattcagactagtggtgacagtagaagttagttcaagcacgttgggggaaatttagcaacatttccttagctggagatgtgtatcacccataacacagcattaatacttatatccattagaggaattcttgcccatgtaaaaacgttccctgcatccgctatttataaaagcaaaagtttggaaacaacctacacgtccattgacagtggaatgaataaacaaatgacagcacattcgtgcaatggaatatgctgctgaggtgaaaatgaatgggtgcacacagcatgcattaacatgcataaatctcagaaaatagtaagttgggcaaaaaaaagcaagtggggaaatgatatgtctaatgccatttatatagttttaaaatatgcaaaacaaaatcatatatcatttgtgaatatatacacatatatcaaaacacatatgagaataaaatcaaaatcaggacagtgtttactttggggcatggaggaagagatgggcagggtggggttcatgggggcggtcttcagcaataactgtaatgatttactttacataaaaatgatctaaagcaggcagggtgtggcagctcatgcctgtaatcccagcattttgggaggctgaggcagaaggatcacttgaggctacgaattcaagattaccctgggcaacacagtgagaccttgtctctacaaaaacaaaaataataagattagacaggcacagtggcacacacttgtagtctcagctacttaggaggctgaggtgggaagatggcttaagcccaggaattccaggttgcagtgagctatgatggcaccattgcaccccagcctgggagacagagtgggaccctgtctcttaagaaaagaaaaaaaaaatgggccaggcgcggtgtctcatgcctgcaatcccagaactttgggaggctgaggtgggaggatcacttaaggtcaggaatttgagaccagcctggccaacatggtgagaccccatctctactaaaatacaaaaattagccagatatggtggtgcacacctgtaatcccagctactcgggaggctgaggcaggagaattgcttgaactcgggaggtgaaggttgcagtgagccgagatcgcgccattgtactccagactgggcaacacggtgagacattttctcaaaaaaaaaaaaaaaaaaaaaaaagatgtaaagtaaatgtggaaacatgttacatattttgctgagctgagtagttagttactgttttttacattattttctgtacattaattaactggaatttttgtttaaagactaccattcaggactcaactctgtcttccatgtagcaaattttgagagccttgtcaaaatcaaagccatgtcttagcattcatttgttggtaggaaaaaaaaaatcagtcattatattttaaagcatatggagatatttcctacttttctacttcccagagatacattatatgcataaataattgtacagtcttaaatgacaggaagggtttgaatgcaccaggcataattctctagtgtccctcatatacagggagatatgacactttcattccctggccagtcaccataaaattctgtctttaccagacactgagaggtgaaaaccctggtctcaggttttatacataaagcaaggcagtcagaaaaggcgggaatgagcctgacagatttggcggctgtctgtgcaaagacaagacagaaaggtcccatttatcatgaaaatctgctagttttcaactttgaaatagttgataattcatcttcttaggcatgagacattgggcaaggggtggctattgccacattcatttctgcctcagcgataatttctggggcagtgtgggctggctaatgttgttgatgggatgtgggggtgcaagggtggccagtatgccatgcctgtgaaggctgatcacccagcaatggaaatctttgagaggggccctttacttcccgaggagcctcctacaattcttggggacatgatgactatcaacagtgatgaaaattttgcgtaaataagatacaggcccacactcctagaagacaaagaaccatgtgaacaaaaccacataggtgaaccatattggtcccaccatagaaaattcttcaatgaggtggcacaggggagacagctcaggctatcaggagggatggaacaaggtggacacatgttctatttctttttctttttaaaaaaattaggtataactttcacagagtacacaaacaccacgtatgccatttgatcaacatccagacatgtgcacatcctgctgcctaacggaagacagagcacacttctggcatccctgaagccttcctcatgctctcgtccagtcaatgctctcctttccctctcaacaaactctcctgctgtctctcactgtagctagttgcctgctcataaacctgctctgaacattcgtctctcctactctctctcactgtagctagttgcctgcttcataaacttgctgtgaacattcgtctctcctgctctctctcactgtagcttgtttcctgctcataaacctgctgtgaacattcgtgcgcatgcctttggtggtcataaagtcctcatttctctagggtggaagctactcaagagtagaactgctggatcatggggtaggcatatgtttggctaactgcctaggagttttccaatgtggctgggctaacttccatttctaccagcacatatgaaagttccagatgctccacatccttaccaacacttggtatcatcactcttttaaattattattatgattagagacagggtcttactctgtcacctgggctggaatgcagtggtgcaatcatagctcactgcaaccttgaactccttggctcaactgatcctcctgtctcagcttcccgagtggctaggactacaggcacgtgccacacttggctaatttttaaattgttttgtagagatggggtctcgctgtgttgcccaggctgatctcaaactgctgagctcaagcagtcttcctgccacagcctcccagagtgctaggattacaggcacaagccatcgcacttggccaaagtcttttaagtactcaaaataaccaatcttttcttttatggttagtgcttttaatgttttgtttaagggatctttgcctaacccaaggtcataaacatattgtcttatattaaatcttccagaagctttattgccttattttttagagccataatccatctgggattaattttctaaaaatggagatataattcaaaaaccataaaatttaccttttggaagtgtacaattcagtggtttttaaggtctattcacaaggttgtacagctgtcagcattatctggtttcagaacacattatcaccccagaaagaaacccttacccattagcagccattcccatctccccctccctcagcctttgccaaccattaatccactttctgttttacggatttgcctgttctggacatttcacagaagcagagtcacacaataggtggctttttgtgtctggcttctttcacttaacatggtttcaaggctcttccatgttgtagcatgaatgggtactttattccttttaatggctgagtaatattcccttgtatggatagaccacattttgtttatcatcagctgatggacatttgagttgtttctactttctggctattataaatggtgctgctatgaatatttgtgtacaagcttttgtgtgaacacatttttttttcaattcttttttttttttttttttttgagacagagtctcaccctgtcacccagcctgaaggtacagtggcgcaatcttggctcactgcaatctctgcctcccaggttcaagtgattctcctgcctcagcttcccgagtagctggagttacaggtgcacaccaccatgtacagctaatttttgtatttttagtagaagtgggttttcaccatgttggccaggctggtctcgaactcctgacctcaggtgatctgcctgcctcagcctcccaaagtgctgggattacaggtgtgaaccatgcaccctgcctttttcaattcatttgggtatatatctaggagtataattgctgggccctgtggtaactctatgtaaatgccaaactgttttccaaaatggctgtaccgttttgcattaccaccagcaatgtatgagtgttctaatttcaccaaatcctctttggaattgatttttatatatggtgtgtggcaaaggtcaagatttttttccgatatggatatccaattacccagcactatttactgaaaagactctctttgaatgatgccactttggtcataaatcaagtatctacacatgtgtgggtctatccctcagctcagatctgttctgttggcctctttgtccctggggccagtgccacactgctctaattacaatactgctgcaataagtcttgatatcctgagctttaactcctccaattctgttctaagattattttggctgttgtcttctgtattttcatctaacttttaaaatcagcatatcaattcacacacacacactcacacacacacacacacacacacacccctgctgggattctactgtatctatagataaattgatacagtaattaggattgaattctatctatagattaattttggaataatttgccgctttttaaattgttatttattttttattgggcagcctcctcagccagagcaggctcagaaagactccatatgtatttctttttgagtctttcttatcaatgaacatgagctatcctgtcattttaaaggtctttatggattctgtgtcttaatattgtacagttttctgtgtagaagacttgtacatttttaatttactcctaggtatttaatgtttcctgatgttattgtaaatgatttcatttaggcctgggagccatggctcacgcctgtaatcgcaccactttgggaggctgaggagggtggagtttgagaccagcctgggagacacagggaggcagaccctatatctaccaaaaaaaaaaaaaaagagccagccaggcatggtagtacattcctgtagtcccagatacttgagaagttgaggcaggaggatggcttgagcccacgaattgagactgcagtgagctatgattgtgccactgtactcactccagcctgggcaatacagcaaaaaaaaaaagtatttcactcaaaaatgttcatttttaaattgtttgctgctggtatatagaaatatattttaaaacactttccttatagccagcaaccttgctaaatttatattctttttttttttttttttttgagacggagtctctatcactcaggctggagtgcagtggcgcaatctcagctcactgcaacctcccaggttcaagcagttctcccaggttcaagcaattctcctgcctcagcctctcgagcagctgggattacaggcgcaccacaccttgcccagctaatttttgtatttttagtagagacgggggtttcactgtgttggtcaggctggtctttaactcttgaccttgtgatccgcccgcctcggcctcccaaagtgttgggattaagggtgtaagccactgcacccggcctgctaaatttatattctaacagtttatctgtagatccttttagatttattactcataatcatattttccatgaaaaatgacagcttagtttcctcctttctaatctgtatatattttgtttcttttaaaaatattgtattttttgccttgttgtcctagccaggacttcaacaacaacgtgggatagaaatggtgacagcggacattctcctcttatccttaatctcaagggaaagaaaagctttcataggtgaacgcagtcataagaataattagtgaccctgcaaaacaggatgatctgaagatcataaactagcaagaagcatgatcaatattggtgtgggtcagttccacgtgcccttgcaattgctcgaggactctggggcccaaagataaagaactcactttatatagtactcagagaacaaagagcagaaaaatgtctcccatcccattttcagcataagtattaaagcaaaacctaatttaggatctggcacccttgtggcaaggcagacacagctgaggttgggctaaatcttagcttccaatgccatagcttttgttcaagtttggatggcagctgctccactactggaggcagcgtctgtttcagtctatgaacactgctgagttaacttgattctgatggttctgctgcctgagtgaacacgcctgcagctacatggctgcttgagtttcaaggcccagacatcagggcaagtacaggcccagccaaacctcaactcatgtgagaatcgttcaggggccacgttgccctgtagttcccacccacaccctccccattctgggcctgtcaagatccacactcccctactgcccacctgaactggcctggggtctgattaagtaaaactccagttccagcagatggttttctcatccacacctcaaaacggaagtaaacataggatgttggctgtgggtttgttaaaaaataataacaataatggatgtaagcactggatgaactgatatttttctgaagatattggctttgggtctgagcttactataatcattaaaagactctttttttttttgtggggcagatggtgtcttactctgttgcccaggcttcagtgcagcggcacgatcatagctcacttcagcctggattcaaagaatcctccgacttcagcctcctcctgagcagctgggactacaggtgtggaccgttttttagctaatgttttattttttttgagagatagggttgcactatgttgcccaggctggtcttgaactcctggcctctagtgatcctcccatctcagcctcccatcactgggatttattctttttttttttttttttttttgagatggagtctcactctgttgcccaggctggagagcagtggcgtgatctgagctcactgcaacctccacctccacctgcaagtgattctcctgtctcagcctcccaagtagctgggattacaggcatgcaccaccacgcctggctaattgttttttttttttttttttttttgagatggagtttcgctcttgttgcccaggctggagtacagtggtgtgatctcagctcactgcaacctccacctcctgggttgaagcaattctgcctcagcctcccgagtagctgggattacaggcgcccaccatcacgcccggctaattttttgtattattagtagagacagggttcaccatgttagccaggctggtctcgaactcctgacctcagatgatccgcctgcctgggcctcccaaagtgctaggattacagacgtgagccaccatgcccggccaatattccaagttttttgctagtttttttgtttgtttgtttttttgagatggagtctcactttgtcacccaggctggagtgcagtggtgtgatatcggctcactgcaacctccacctcccgggttcaagtgattctcctgcctcagcctccccagtagcctgcccccatgcccagctaatttttgtatttttagtagagatgggatttcaccatgttggccaggctgctctcaaattccttaccccaggtgatctgcctgcccaggcctcccgaaatgctggggttacagcgtgagccgctgtgcccggcccagccacttcttcttattggagtgtgagcactaggagcagggacctttccatggtgcttgctgtgttataccctgcacccagaacttagtaggcgttcaaacaaaatttttaaaaataaatggaagaacgaattaagaaaccttccgggtgagtcattatactgtccccaaacaggggacatcatcaattttattcctgccaagtagatctggactagaagaatatgtgcttgatctacaacaaaagctgccaggcaaatgcctgatactacgtccatctcacctgttctgctcccaccatgctaattggcttgcacttgaagaggtgggtgatgaatttgggaatgaaggagctgtggataaaaaagaagtgacaaattaggcttattctctcttgaggaaagaaatgcaaaaactttaaggttccacgtatctccatgaaaaaaccttttttaatgaagaatcgaagtggactccactgttgcccattatcttatttttcttctgagtgaagtcctggttttgtttagttacatgaggccctggcaggcccgggaaaaccggatcccatcctagactcccagtgaactctaactattctcagctcgtcagagcacagcattcctttggtgactgttgtttgtcctgagagggaatatgatcgaagctagcccaatcagactggatgtaagggctacaggcaccgcacctggctactttttaatttttttgtagaggcaggatttcgttatgctgcccaggctgggctcaaactcctggcttcaagcagtcctcctcccttgggctccggaagtgctgggattacaagcgtgagccactgggccaggcttccttgattcttcattctctgtctccagcctcatcctgctaagccctggcctccctatgcttcaacccaactgagccacttgcagatcccaggattctgggggctatttaatgcctacactgctccctcgcctggactgcctttcctagaaggggcttgtgggtcagtacacacgcacctctcagatcctgttcaacggcgtctctagaaagcctttcttctgctgccttcgccatactctacatggagtctgcaggcctccaccctcacatctaacctagttcattatgctcatttgcttacatgtctattttgcttcacctgactattaaggcaaacgaagatgggggccatgtttatcaggccaaaacatttaactctgggtctgagacataggagatgctcaagtgaatgcacattgagtaaatcataaacttttttttttttttgagacagagtctcgctctgtcacccaggctggagtacagtggcaccatcttggctcactgcaacctctgcctcctgggttcaagcaattctggtgcctcagcctcctgagtagctgggactacaggcacgcaccagcatacccagctaatttttgtatttttagtagagatagggtttcaccatgttggccaggctggtctcgaactcctggcctcaagtgatcctcttgcctcggccccacaaagcgctgggatgacaggcgtgagccaccgcgcccagccacctaccactttttgaatgtcagcttggtatcagcactttaccaggaagttaatatgtgacttctcattttatcttcccaaccactattatgagatttgtctcattatctccttgattgaagggaggaggatcagctcagtggatgagggaagttgcttgtggttcaactgcagtttcaaccaggctgtggattttgatgtctcaacaggaaaggctgctattgcttaagacagcaaacgaggtaaaaggaaacatctatggttttgcaggggtggggtagaaaggaagctgagggagaggaaactggagtccggagatcggatctggaggtggcttgtgatcaggaaggagagtaaacaaggggctatttggaaggaattcctcagtgctggaaaccagagccagacaagcaacatgaaactgaactcatgaccaatggcagctgtgcacacagcgctttgtaacctaagttgcttcacattagaacatgctccggactgggcatggcagctcatgcctataatcccagcactctgagaggcccaggcaggtggactgcttgagcccaggagtttgagaccagcctgggcaacatggcaaaatctcatctctacaaaaaatagaaaaatgagctaggccgggtggcgagcgcctgtaatcccagctattcaggaggctgaggtgggagaatcacctaagcccaggagatgggggctgcagtgagctgtggttgcaccactgcactccagcctgggtaacagagtgggaccctgtatcaaaaaaaaaaaaaaaaacctttggctgtgcccctgaactggctctctatactagtctacaggtggcgatggggggagtatgaggacctgacacacgtcctgtggggaaaaaaccaagcaatgtgctgggtaactgccaagggcttctctgggccatcagggcggtggtggctgctgcccttgaccagggaagggtctcctcacaagcccacctctgttaagcgggattttagcaggatgagaaggcaccatggatgaaaacagaaaaccacttcctagatcccaggctgaatgattacagatgtgagggggggcatccaattcccagcgcactcaacctgggcttagcaatgaaactcaagggctctgagagaatgtgaggctgatgctgggagatgctgggactggctaagtcaaccgactcctccttcactttaacgtaagctcaatcatatgactgagctgggagacgccgggactggctaagtcaacggactcctccttcgctttaatgtaagctcaatcatatgactgagcagggagacgccgggactggctaagtcaacagactcctccttcactttaatgtaagctcaatcatatgactgagctgggagacgctgggactggctaagtcaacggactcctccttcactttaacgtaagctcaatgagaccccggagcagccaccctggagattttgagtcacagtaaatttttacagagacactgcttctaccagcagttatggggagcgtcacgatgtgatttatcagcaacatttctaacacactaatgagcacccagagagtgagggaatttcacctcctggtccatctgccatctgcaaacattaatgcctccctggagagtccactctatcctttcttgacaaactagaaagtaaagctgacaccacaagccgctccataattgttagtcctgaggggttcatttgtgaggtacagggaaactgggagagattgggggaagacagaaacttggagtcctgaatcaccagctggggcctggatgggaacaacccaaatacagtagcttggcctgggctgaccctcctgaagcccttccctgagaagtctgccaaaatgcttgcttgataactggtcagaggagacactgaccctcaccaccacctggtatcacggaaaatggtgctaagccagatggtgatcggcaaagaactaaactatttcctcgcttcaaaactcagggcagaaatggccacacacaagacacagcaggaagacacacggctcagggtgcactcacctgccttggccagggagctccctggcttgtgcatcccaatttctagtgccttcctcggaccaagagtgtgtccaagtatgaatagataaattctagcagccatggtaaaaaataccagggggagggaggacaagaaggctcaaaagaaacagaaccgatggctcctacccttaagaggcatttattaagccagtcagagaaacaaaatgcatatatgaaatccctgaaaaagaattttaattatccaatcctgggcaaggagagcttatgcctgcacagttcaaaacaacagtaggccccattcatttttgtttgccttgacgtggctggcaattgtactgctgttactgttgcctatgactttaagtagcagatttagttttatgattatgcttcttttgtgtacaaattaaaatcagtactgcaggcaccagaacaaaccgcagctggatggtggggacactcaaattgtgaggatgctggtgggaagtatggttttaaaaacaacccagttgagtatgacactgaaatggcggccacacgtcactgtacatttgtccaaaccgagggaatgtccagcgcgacgtcagagtccgggtgataatgacgtgttgatgcaggttcatccactgtaacgaatgtgccactttgtgtgtggggaggtgtcggtaatgggaagactgtgcatgttgggggggtcaggtacacgggaaatctctgtgcttgctgcttaatttggctgtgaacctgaaactgttctaaaacataaagtctattaaaaagaacaagaacccagagatgagcacgccccaggacttactttgcaaatttaacgcagaactgagtgaagtacttgcgtgtggaagccaggttgtcacggatgatggggacgttctgcttgatgtgcagaatgacagaggtgacgtaggggctctggtcaccaacgtgctccacgttctgccactgcatctgaaagggagaaaggatgaggcgttgaatccctcgcaggagaacggtgtcgcctgttactggggaagggaggggctggagtggaagtcaggtcacagctttggtatcccaggaatcaggcccttttgtcctggggagtttcttattcgttctgtagggactgatactcaggacaaatgcgagtgtgcccagcggacccgacagtgaggtgtgacccagaccctttccttttcctgccttgtccccgacctgcctgaaacagccttcccttctcagctaagctacccactcgtaaaggatcctgttctcctgccgagtgccccacagcaggggactgcagcagaacggggagggacaccgactcccaagctgaccggcagcctgggagatgagagaggtggctggactaagtgacatgcaacctggaggggaattcacagacacctttctctccagtcaactgggaggagtttgggattctttaacacagaaaactagaaatgatatgacacgtggggatgttgcttcaaaataatatgaagttaccgggaagaggtgcagatgaaataagatcgtgaagctgagtgacaggtacatagaggctgaccacactgtttcctctacttttgaatatattcaaaaatttccataataaaacacttgaagaggtatgcgtgtagaatcttacactcctaaaacctttgggattatgtcaggatttcaataaggggaagggaaagagaatctctggcaaacactagggtggaccagagggtaagatggagacgtggggaacaggccaggagccaggcgcaggggagagaacattgctgagagcaccgaggtggtccctgaacaagctgtgaacaaaagtgacagacctgcttcaacctgagccctaacgacaggctctggaagacacctatagcaaactggcgggattcttggactacgtggcacttggcaacattgagtcctgggaacagaaggaggcaatgctgcagtgtgccatcccccaagggtgcatgcaggagatgggtgcagcaccagctcctagcctgccccgggctggcagggaagggcattctaatcccgaagagtgggaatggtctggagggttctgctgagtcagcctttcacagtggagctggacggtctggagggctctgctgagtcagcctctcacaatggagctggatggtctgttaaagagatcctaagccaaacacaaaccatataatatgttcatagaaggaagtcagtagttctgaggccctgatgtctctggcaagaaaacactatttttacagagctcttggggaaaggaaaaaatcaatactgagagagcttgtttaaaagaatcacatcgtacgtggatgattctccagctgtgggaagctcaaatgactcctaatgttttttcaaatcagcggatatttgtattctaaaagctttagggatgtgtacacacagaaccacagaaaagcaggaagggacctccatcttcatttcacagataagaaagccaaggcccagaaacatgaagagtcttatgcaaggtttcataaccaggctccacacaggaaaaagaactctaatttattactgggaaaaaacagaaacaaacaatgaagaaacagtagaaaggtctaatatgaagtgacttaacattctaatgctttggttatgtgaaatgttttcctcattatcttttatcttacgcaagaggcttctttttccatttgattttgaagatttgacccatccaaacaatgagcatcctgggtgattttaaatgagctcatagggtgaggccaaaattgacaggtgctgtcagcatttcctgggctctgcagcaggactcggagcagaatgttctgggtagacacagcgaactgggagggcttgatgcccccaaagccaatcatgtccatagcaatgactgttactttccaagctggcagctttgtatatttcaaaatctcaaaacggtttatcaacaataatctaaacatgacagccctccatgaaagaaggtggcgacgtgctctgtcaccagttacaaagcagctctgaagcaagaccaagcaggggcctgggatttcttcaacttcccactggttattccgcatgctcgtcaccgaactcctcttgatgatcactggccaagtcagtatgtgcccacatttggaatatatgtgaaaagagctgatttgctttaatactctggtcagtcatgactccattggtcaagctaaaagaagtattagcaaaggccaagtggattcatgattttaaacttaagtcagcttagtcaactaagaaagtgatttaaagtactagaaaacaataaaaggtgaccttacctttagtattttttaaaaatgtggcacacgcctatagtctcagctaccagggaggctgaggcaggagggtcactggagcccagaaggttggggctgcagggagctgtgattgtaccactgcactccagcctcagatggctgatgcttgccatcatcccccatgggtgactgaaggtttgggtcacaacctgaactgcccaggatagctacattaagaccgaacttcgcaggtccctttgcatggccctaaacatacgtcgtctcatttactattcatacatgatctcactaagttctcacaacaaccttatagatgaggaaattcaaaaagctcaaagagatttggtatcttgcacaaaatttcacagctgggacaaccacgtctatctaaagcccaaaccaggtctatctaaagcccaaaccaagtctatctaaagcccaaacccggtctatctaaagcccaaccaggtctatctaaagcccaaaccccacaacaaggtgcttgctagacaacttcccccccgacccgcccccgccaccctgcccaaaaaaagaataaaagcacttaactaggccttcgttaaaggtaaggcctgtttctcaaggagacgctaatgaaacatagtgatcaagcaaaggactctttatttttcatttttttttgagacagagtctctgctgcccaggctggagtgcagtggtacaatcatagttcactgcagccttgacttcctgggctccagcaatcctcccagctctgcctcccaagtagctgggaccacaggtgtacactaccatgctcagctaattaaaaaaatatatttttttcttttttactttttgtagagacaggggtctcaccgtgttgcccagactggtcttgaactcctgggttcaagcaatcctcctgcctcagcctcccaaagtgctgggattacaggtgtgagctaccacgcctggcccaaagaactctttcaaaaaaggaaacaaacagtaccttgcattggaagaacaaacatcatgaaaagccatcagtagaaatgagacctcaacttttccaggtaaacttttcatttgacatttagaagttacccctctacacttaaaattgtttcttgttgtgctttttgttttgggggcttgggtagagttgaatacagatggggttcaactggtactactatctaaatgagacacagtttgaagacagtaagaatgatgagtgcctccgggacctagtttaaccaccacaagaagagactgcagggcccagagtgtccccagagcccagcttctgcggcctgggcaggaagtatgtgctctgactgacgctccacagtggggctggggggtcagcactctttctagagagagtctactgtagcaggaactttgaccagagaacagcgctccacaactagcttcagtggatcttgttttttcctattgctataggaagcttggaaagaggtttcttgaaaatgtgaatacttaaattcctacttcttcactggattagagagacacagagcatagactcagacagctgggctctgggaacatttcaggcaactgaagtctcataactgaggctgccggggtgttggcctcaagctgtagactttactcaggcacacacgtacacgctcactctcactctgatgcctggtggggctttcactcccgcagcatctgctatatttataggtaccttcggcaagtgcagcagggcactgagcatcaggtggagaccaaagagatgaaggaatgtttatcaaccgcctgccacacactgaaggaatgtttgtcaagcatctaccatgcaccaggggctgaaggaatgtttatcaagcacctactacgcactgaaggaatgtttatcaagcacctaccatgcaccaggcactgaaggaacgtttatcaagcacctaccatgcaccaggggctgaaagaatgtttatcaagcacctactacgcactgaaggaatgtttatcaagcacctaccacgcactgaaggaatgtttatcaagcacctaccacgcaccaggtgctgaaggaacgtttatcaagcaccgactacgcactgaaggaatgtttatcaaggacctaccacgcaccgggcgctgaaggaatgtttatcaagcacctaccacgcaccaggggctgaaggaatgtttatcaagcaccgactacgcactgaaggaatgtttatcaaggacctaccacgcaccgggcgctgaaggaacgtttatcaagcacctaccacgcactgaaggaacgtttatcaaggacctaccacgcaccaggggctgaaggaatgtttatcaagcacgtactacgcactgaaggaatgtttatcaagcacctaccacgcactgaaggaacgtttatcaagcacctactacgcaccaggcgctgaaggaatgtttatcaagcacctaccatgcaccaggggctgaaggaacgtttatcaagcacctaccacgcaccaggggctgaaggaatgtttatcaagcacctaccacgcactgaaggaacgtttctcaagcacctactacgcactgggcgctgaaggaacgtttatcaagcacctaccacgtaacaggtgctgtgcctgacattttcacatgaccttgctgcctgatgaatgaatcatgtagtgaaagaggtattattactcctctttgtgagtaataataaatgaggatgaaacaggattgaggacagcgagtgacctgcctaaggaagcgtaactgctaagttagcaggaaaggtcattaagatggtacttaagatgctgaaattgagtcagccagtctgacttctgacactgtgcaaccttctaaaggggtgaccgggacaagtcatctaatttctctgagcctcagtattctcgtctataaaattgggatgatggtaacatctataatctattactgaaagataacgcatggaatgctcttaacacagtgtctcgcagcacgtataaattccacagtaaattttagctactgttataattttaagaatacttgcactatcactaaaaatcactaaatttcgataactgataattatcaattaattcagatatgtatcaattaattgaaattatggtgatttaagttttattctttttttcaaaaaaatctgaccgggcgcgatggcaacatgcctgtaatcccagcagtttgggaggccaaggcaggtggatcacttgaggccaggaattcgagaccagcctggccaacactgtgaaaccccgtctctaccaaaaatacaaaattagccgggtgtggtggcaggcacctgcaatcccagctacttgggaggctgaggcaggagaatcacttgaacctgggaggcggaggttgccataagcacaaatcacgccactgcactccagcctgccggatagagcgagactctgtcaaaaaaaaaaaaaaaaaatctgcatttttctaaaatggaagtgatttagttttgtcataatgggaaaaatcttttttatgaaaaagaaagctgtgtcttgattctaggtagaacttgacagtttcttagtcatggctttctgtgggccttctgaaacagatgtgcattttaatgactgaggaaaatgaaaatgagaacagacttgtcttgattcaacgtagaagtgaacttgaggatttcttagctgtggctttccatggtccttctgaaacagatctgcattttaatgactgaggaaaatgagaacagacttgagaactcttctacctgtttcaaagtgtctttgggggattataacgcagcctcctaaatgggtacatgttcacaatcctgaaacctaatataaattatgtgccagacggtaagaaaatttaatttattcagtttctgttttttcctaaaactaccattaataggcaaaacactaggtgtgtttgcttctgaacagagacttggatttatttacctgagtgatgtgagcagccctaggaaaaggcacggagagaggcggggaccatgagaccaacagcccctgctagggagcccacggctctctatcctacgtacaggggcataaccagacatactcatttctaaggatttgtaggatttaaatctaaaagatagaatcctttgtatttccaccaaaacactccaaataactactttttccagaatcaggagaactagttttacttctagcttcactattataagttatatggctttgggcataatatgaagaagagaaggaaggaaggaaggaaggaaggaaggaagggagggagggagggagggagggagggagggagggaaggagggaaggagggagggaaggaggggagtttggagggagggaagggagtctggagggaggggaggggacaggggaagggagggagagaggaaagaaggaaggaagggagagtgggaggaagggaggaacggagagagggaggaagggagggagggagggagtgaggaaggcagggagggagggagggaggaagggaggaaggaaggaaagaagataccagaaggaaagttcattagttttcagggaaaaatattcaacgcagattggaatatgtgggttggctgttcaacacatcttctccactgtagaaaagtcctggtgtcagatcaagaaaagctggagatgaatatacaccatgatgatggtgaatgcttgaagaactcataatcatatcagcatgaacactcgtgtggacccaccaggactgggcacatgctgacagaaatgtatcaactaattgaaattatggtgatttaaattttattccttttttcaaaaacatctggtcgggcacgatggcaacacgcttgcaatcccagcagtttaggaggccgaggctcttccacttttaggcaggttacttaagctgattttgcctcagttgccacatttgccaaaaagacttactcactctctctgtatggcatgccacaatcctgcataaagaggcactgtggtggcgtgatcacagctcactgcaacctctgcctctcaggctcaagtgaccttcccaccttagcctcccaagtagctaaaagatctggagcaggtgatttaatgtctctgtttcagcttctttatctgtgaaaaggggaaatagcatagccatctgatgaatttattgttagaatgaaattaattgggttccaattcctggtaagtgctcagtaaatagtaacttattatcaactcatacaggttatctaagaaaataagcaatatggaggccaggcacagtggctcacacctgtaattccagcattttgggaggccgaggtgggaggatcactagagctcaggagtttgagactggcctgggcaacatagcaagacctcatctctactaaaaatcaagaaaattagccaggtgtggtggtgtgcgccagtagtaccagctatttgggaggctagggtgagaggatcactggaacccaggaggtcaaggctgcagtaagctatgattatgccaccgcacccaagcctgggcaacagagtgaagaaatttttttatgaaagaaagaaaataacactatgggaaggaaacgtggtctagaagttaattttgctgtaactcatcagcaacactactggaatctcaaagtcagagtttcagagggaccacctgactttcatcacattttcctcccccttcttcggcctggcctgcagaaggctgcacctgcatgtgaatctagcaaactaccgctctgcatttccctctccttgtctagcagcaggactcagggccacacccccgcgggctcgtattccttcattcccacatctcttcaatcggctccaggatgccacctgctgaagtcagaagcccttctgctatcaggtgccattgaggagcatcactccatcctcaacagcaccagctatggacctaaaggtttcagggattctatgaccccaccgtctctcacaaagttgtccaagtttcctactctacatctaccagctccacctggctacctctgctcagtagagttatctatgtctcacttgtttaccaatctttggtcaaaagtgtgtttgtggtcctttggttctttctctcccactccctggctccctctttaccttcaaagtcattcagggaatactacagttaagcaagtactgtgccatgccacgggtttccaaaatgaataagacacagccctcaagttgttcaaagtttaatagggaagacaaagacataaaaatgattacataacaaagcagaaaggtagtctaggtactatggtgtcttgaaagagaaataaatatgctctggctgaggcaagaaatgctgacattgtaagggacctagaagagccaaaacagtgttgaaaaagaacaaagttggaagactcatacttcttgatttcaaagattactacaaagctattatagccaaacagtgtggtactggcctgagggtggacatacagatagatggaatagaactgagagtccagaaataatcccacacatctatggttaactgattttttacgagggtatcaagatcatccaatgtgaaaagaatagtcgtttcaacaaatagtgctgggaaagctgagtatcctttcagcaaaagaatgctgctgaatctttgcctcacaccatatgcaaaaattaactcgaaatggattgaagacctacatttttttcctttttttcttttttgtgaagacctaaatttcttagaagaaaccacagagtaaatctttatgattctggatcaggcaatggtatcttagatatctcacacacacacacacacacacacacacacacacacacacacacacacgatataccaacttcagaaaatcaaggacattatcaagaaagtgaaaaggcaacccacccacagaatgggagagaatatttacaaatttcatatctgataaggggtctagtatccagatataaaaagaacttttacaattcaacaacagaaagacaacccaattttaaaatgggcaaaacatttaattctcatttcttcaaagagaatatacaaatcgccagtagcatctgagaaggtgatcaacatattagtcatgcaaggaatgcaaactgtaatcacaatgagataccacttcacacccacgaaaatggctataattaaaaaaggaaaacaagtgtgggagaagatgtggagaaactggattccttacactttgctgtggaaaggtacaacggcacagtcacttcagaaaacagtgtggcactttctcaaaatgttaaacataaattgaccatacggctctttcagttccattccttaggtcccttagatccttttttttttttttttttttttgagacagagtctccctctgtcacccaggctggagtgcagtggtgcaatcttggctcactgcaatctccacctcccaggttcaagccattctcctgtctcagcctcccaagtagctgggattacaggcacgcacgctaccacacccggctaatttttgtatttttattagagacagggtttcgccatgttggccaggctggtcttgaactcctgacctcaggtgatctgcccacctcggcctcccaacgtgctgggattacgggcatgagccaccacgcctggcctttaggtacatattgaagagaactgaaaacatgttcacacgaaaaattgtacatgaatgttcacagcattattcaaaattagaaagtagaaataactcaaacgtccaatagacgaatgaataaacaaaatgtggtctatccatatgatggaatgttactcagccacaaaaaggaatggagtgctgacacatgccccaccatgcacatgccctgaaaacactacgctaagtgaagaaagccaagcacaagatgtcccacatgccatatgattctaggtatgcaaaatgtcaggaggggcaaatctatagagacagaaagtaggctaatggttgtcaggggaatgtagaatgactgctgagaggtacggggtttctttttggggtaatgaagatgttctggaattagatggtggtggtggtttcatgacattgtggatatactaaaaacaactaaattgtacactttatttatttatttataaaatagagtctcactctgtcacccaggctggagtgcagtgctgcaatcttggctcactacaacctcggcctcccaggttcaagagattctcctacctcagcctcctgagtagctgggactataggtgtgtgccatcatgtccagcaaattttttgtgtttttaatagagacagggtcccaccatgctggcctcgaactcctaacctcagatgatttgcactcctcagcctcccaaaggagtgagccactgctcctggccaactgtatactttaaaagggtgaattctgtggtatatgaattatacctcaggtttttaaatggggacagacatttgaacttgatcttaaaggacgtgctccttgggcagacgatagcaggaagaaaattctgggcagaaagaataaaatgagaaaaggcatggaagccgcaaaagagcaatatgcattcagggaagtaaacatggctgcgactggagaacagggcacatactccggagtgagcggcagaaactgacctagcagtggagtaaagagatagataatgaaagctctatatgccaaccaaggaagaggccatgggatgccttccatgagaatgaggtctcccaggaaaatgacttaaccaagttgccaggctcaatccctcttgtcaaggaagtctccttccgtcaactcagaatcatccaatgactacactccactttggccagccaacagtccttctggaatcatccaatgactacactccactttggccagccaacagtccttctggaaatatccaacgactacactccactttggccagccaacagtccttctggaatcatccaacaactacactccactttggccagccaacagtccttctggaatcatccaacgactacactccactttggccagccaacagtccttctggaaatatccaacgactacactccactttggccagccaacagtccttctgacatttataagatacacttatttacagtattggttgttctcagttttcttcccagcagggtatagactccttgaggacagtctcgtttccaatcttaactctgtcagtccaagtacaggagtagcctgaggagcccctgggatgttgaatgagattggcagtttgaaccaagctctttagcttccctaacctctctttactcatgttttcaccctgtttgaactgccctactaatcacaaactcattcagaatttcgccctcatctgtttcaaacaccacttccttacgagggccttctttgcctccccacctggatatgaactcctccctctttaaaaagggtgtattttgtacttttcttatggcactgatttcctcatctcttatattaaagttactgggtattgctgtcatcttacacatctcttgccctcagctactggaatctaaacaccttagccaagggtttatgcctttctgagccttgcagctcccagcactgtgctgggcagggtctgaactgaactgtttaaccagcagcaaaaatgatagaatcagagacagaaataaccattatcacaaaagtttttttaaatcctagaagaaactacacaaaacaggatgcaggcatcaagaacacagaatgtgtgttgaatcaatttgtgaccacttggcttgtttatttccatcacatggattttattttgctagaactccagaagactcagacaaaaagtaatggcctcccagctgctgcgttcccaagtctgtggttttcctatgatataaacaaaggactctggaggcacggtctctgttcgtatttgctggtgtgggcacggggcagaagtggagggtgggacggggcagggtttgagggaaatccaccgaacgaaccgacagttcgtataagcaacacttgcagtgttaaaccccttccaaccgtgattttattgaaaaaaaaaaatcccactcttcctttggtgaatgtgaaaattctttcggcagctgcattccgatctgaagtgtgtggcagttcaggagagatggcagctggcacagatcccactcaggatgtagagaatgcttaccagcagcgaggggatcatgagagctggcaaaacgaatcctctaagcagatggactggcctcactttgcctgctcagagtgttctcctgtgaatgctgagaatactggaagtacccatcagcaccggactgctgaaaagatcagctttttgaataaaactgtgacatcagctattttaggacttgccacttcagttcataaaaccctaaagcctacattttggttttaatcttatttttgttaaatatttacaatctactgcaaaaccaaattcagaccaaatgtctgcttacacaaccttgtgacatggtcattcctcctgacaagagggagagggaactaacatttaatgagcatttactatgtgcctggcactagacccgcccgttccatgtttcatcctcacagcaatgctgggaggcagagatccacagttcacttggggtatgtgggcccagatgatgtcacgttggcccagacaggtgaatcatttgctcaacaccccaaaggaaaccctggaggagttaggtctgtctgactctaaagttagtgttcctcccactgccctctggtactggccagtataacctagataaattgtttctccagaatttgctacaagagcctatgactctagagcagacattggcaaactttttctgtaaagggccagacagtaaatatttaatttttttagctttgtgggctagtctctgttgcaatggctcaattctaccactatattgcaaaaaggcagccatagataatacataaataaaggaacatggctgtattccaataaaactttattttcaaatacaagcagtgggccagatctggttcccaggctctagtttgccaacccctgctctacaaagttctagagttgcagctgcatgttacttgggtttagcataacaaaggcccatttccaacttaattaacaaaaatgaatctcccatattcaagactacaagagagataaaagagggggtgaaagacatggtctgtgcacttacggaattgacattcatttgggaaaaaaaggcataggcacataaaagtcaaaaataggaagatgaggtagcgctcagtaagtgccaaaggaggagacttgagggccaagggctgactgatgggccaccacgatattagaaaaccagagttcacaacctgatcaaatactcttacattggcaccagagctcagaaggagttggaaaaacctctcagtgggcaagaatgaagaatgagtcagaagttactactttaagcactaatgaaaacacccattctggtgagaccacaccaaggtttttagcatgtgtcagatactaatcaaagataatacgtaaataaaggacatggctgattggtttttaattaacaaaaatgaatctcccatattcaagactacatgagagataaaagaggggtgaaagacatggtctgtgcacttacggaattgacattcatttgggaaaaaaaggcataggcacataaaagccaaaaataggaacatgagaggaacatgaggtagcgctcagtaattaaaaatgatccatctcagctgggcactgtggctcatgcctgtaatcccagcacttggggaggactcggtgggaagactgcttgacgccaggagttcaggaccagcctgggcaacatagcaagactcttagctctacaaaaaatttaaaaagtagttggacacagtggcatgcacctgtggtctcagctacttgggaggctgaggcaggaggactgatgagcccagagggtcaaggctgcagggagtcatggtggcaccactgcactccagcctgagtgacagagagagaccctgtctctaaaaaaatataaataaaccacagacaacatctcctttagactcatcaaacacatttacttcgtctcttttttttttgccatcctccaatactgtgatgctctgtctcattctaaaaggacaagcaactgaactgacgcaggtgcgacactaactgagtgctttcaggaactccggggcctctccattctcctcagctgatcctttacgctccgatgagcctggagaagctacagacaagggccagtagaagccaccttgggctgctctcgttagtttgtaggatgccatttcccaagaccttaccttgctcatggcagtcagggcaggatcacaggcagcatccagatcctgaaccagcagctgaatactgctggagatgacgctgcaaatcaaacaaatcactgtggtcaccctttcaaacaacggccgtctgaatgactgacactcaggcccctgtgtaaaaatcagattcatcatttcactggcaaagtttgagctttaattaatgacagcggaggaacagcttggctctttcttcatgtcctggttttatctgggtgtgtcctcacccagtcaggatatagaatcccacggtcagtctccctaatcaccaccccagtatccctgttcacatcttcctcccaaagaacctgcttcccaaaaatgtttaagtcagaactgaagaaaataaaaagctaagaaaagtggaggaaataaactaagaagagaattttgattcttcgtcaataagtggttgatgtgaaagctgagaattttgattcttcgtcaataagtggttgatgtgaaagctgagaattttgattcttcgtcaataagtggttgatgtgaaagctgaggcctggcccatgcctgtctcatttaatggcagtggaacagaaactgaccacaacaaaaataccacaaggtcctaacagggaaagaagactttactgttagaacttcctggacggacctcccctgccactcccacactcttattccctcggtggctaaatttaagccatttatactttatactttaaaacactgaaggtaggcctggccttctgtgggtttaggtgggggcagatcagcaatggccaagggagaatgtcttctctgtggttattcttcacagtgagacaatgaagaccccataagctaaaagagcaactgcatctgaggaggtacaatggcagcccagttctgaagcttcttcttagtggccagtagggactcattctgacccaacagaaacctcttaggttctgtagtgactaaagccaacagcctgaggcacgctgctgtgtagtggagaaagggcaggcagcgagcaagtgtgtacaaggtatatacgtgccgcacgctgctgtgtagtggagaaagggcaggcagtgagcaagcgtgtacaaggtatatacgtgccgcacgctgctgtgtagtggagaaagggcaggcagtgagcaagcgtgtacaaggtatatacgtgccacatgctgctgtgtagtggagaaagggcaggcagcgagcaagtgtgtacaaggtatatacgtgccacatgctgctgtgtagtggagaaagggcaggcagtgagcaagcgtgtacaaggtatatacgtgccgcacgctgctgtgtagtggagaaagggcaggcagtgagcaagcgtgtacaaggtatatacgtgccacatgctgctgtgtagtggagaaagggcaggcagcgagcaagcgtgtgcagggtacatacgtgctgcacgctgctgtgtagtggagaaagggcaggcagccagtaagtgtgtgcagggtacatacgtgctgaacgtgtccatctctccagtcagattgattcgttcaatcagacttacatccactttttctttgagtttttcttctagctgttgaaaaacagaagaaatggatgcacggttaatgattatccaaagaagtaccatcacaataatagttaacatttactgcgtttgatgattcaggcataattccatacactttttttttttttttttttgagactcgctcttgttgcctaggctggagtgcagtggtgcgacctcggctcactgcatcctctgcctcctgggttcaagcaattctcctgcctcagcctcccgagtagctgggactacaggcgtgcgctaccacacccggctaattttatatttttagtagagatggggtttcaccatgttggtcaggccggtctcaaactcccaacctcaggtgacctgcctgccttggcctcccaaagtgctgagattacaagtgtgagccactgtgcctggccaatcttacaaccttatgaggaagattctattattatcatcgtcattttacagatcagaaaaatagagggggggcctacccaagatagaagtggtagggccaggaatcaaacttcctccagagcctgtgccctttagcactgtgcagtacttgtttcttaccacacatcaataattcacatcaactcattctgaaaagacgctgattttaagatactccctgccccatgaactacagacttgcccacccacaatggaaacctttggtgttgagtagcagtaaaaccagctaaaatagtcagtgaatgctactacgggccaagcacctcattaaggcattggggatacagtggtaaacaaaagaaatgtggtccctgccatcatcagccgacagccggggacagaaacactcaacacgctcctggcgctcaaagaaaaataacgggaccaagacttgtaaatacttggagatatccctgggagttgattaatctagcactgtaaacctattacacaaactctaagaatagctaatgttttggcctttttttttgagacggagtttcactcttgttgcccaggctggagtgcaatggtacgatcttggctcactgcaacctctgcctccagggtttaagtgattctcctgcctcagcctcccgagtagctgggactacaggcgtgcatcaccatgtccggctaatttcgtatttttagtagagacggggtttcaccatatcagccaggatggtcttgaactcctgacctcaggtgatccacccacctccgtgtcccaaagcactgagtagctgggactacagctgggattacaggtgtgagccaccgtgccaggacagaataaccaatgttttgtcttaaatttgaaaatgctgttggggtgcataaattagcataaactttttggaaggcaatttattcaaaaagcaaaactttaaatacacatattgcctaaaccagcaatttcacaactagaaatgcatttcaatgaaataaggagaataacatacaaagatatgcaagtattttttgcagcattcattaattcaaccaatatttaatgagagcccgctttgttcaggctgtgtaacagaataagagagttatttagtgaacaaaacagatcaatactgttctcataaagctggaaacaatctacatgtgtatttacaaaggataaaacaaattatggcacaggcttatcatgcttaaactcttcagcagcctcttcctatgacaccgaaaataaaatccaaattcctaaccatgaattgggtcctgcccagctttctggccccgtcttgccactttccaccttgcctgctaggcttcagttacactggccttttaaatttctgggagacaccagggtccttcgccctcaggaccttcatacttcacacttccttattcctctccctgaaacatggcctgctcagccctgctgacccactgccttgctttgccgcacccccactttctaagccctccaggctcctcactttttggccacatgttggccatgctggtctcaaactcctgacctcgtgatctacccgcctcagcctcccaaagtgctgggattacagacgtgagccaccacgcccggccctaatttttgtatttttagtagagacgggggttttactatgttggccaggctggtctcgaactcctgacctcaggtgatccacccacctcggcctcccaaagtgctgggattacaggcgtgagcccctgcactcggccagagtatcattctttatacctcctaatggaataatggatctgggctttgagcatcagaggctgctgacatcacacaaagagcaaccaaacattatgtatcttgatgacagacgtacaaaacatcattatgatgtagttttctgtaaaaaagaatctgaatcagctcaggcttctacatctaactaccaatttatgggaaatacgagacaaagtaaaatgtccattaatactcgtgggtgcaatcaggaaaatccaaaacttgggaaaatctacagggcaaacaacacagtttctttaagaaaagattgcagagggggcaaagggaaatggaagaagaaaccagagacttaataatctgagcaggctggacccagtggctcacccggtaatcccaactctttgggggctgaggcaagaagatcacttgagcccaggagctcaagaccagcctgagcaacacagtgagaccctatctctacaaaaaataaaaaaatactggccaggcatggtggcaggtgcctgaagtcccagtgtagtcccagccacttgggaggctgagggtaggatcgctttcgttccaggtttcagtgagctgtgatcaaaccaccgcactccagcctgggcaacagattgagaccccatattaaacaaaaagaatctgagcaacaaggaattggaaaataaaatttaaaagcaacaccaataatacatcattattggttcattaattgtaacaaatatttcatatcaatgttaataatatgggaaactgggtaagtggtatatgggaaccatacaaacgatctttgcaatttttctgtaaatgtaaaagtatccttaaaagtgtagtttatgttttttaaaaactatttacaatagcaattcataacatcgttctgtggtttgattgtgttctccaaagtttatgggttataagcttaatccctgaagccacagtgttgagaggtatgaggtcatgagggctctggcatcatcatgggttaatgccattatctcaggagtgggctcttttattccttcaagagatctttattaagcacttattacgtaccaggcattgtatttggtgctaatgaacagaggtgaacaaagtagactttctggcatgtaacttaaaactaatgggggcgccagataataaggaagtaagccagccgagacgtaacttcggttttgtggtgttaggaaataaatttggcagtgctggaataagggagctacctactgaaggggggtggccaggagggcctctctgctgaaggggggtggccaggaggggctctctgaggaggtgatactgaagcggggacctgaggcttggggaatgagactgccaagtgagaagccaccacacccggctaatttttgtattcttttagtagagacggggttttgccatgttgacgagactggtcttaaactcctgacctcaagtgatccaccctcctcagcctcccaaagtgctgggattataggcatgagccaccgcgcccccactcttctggaagctctgaggaaaaaactatttacacctctcttctagctttgggtgtttgctggcaatccttgatgttccttggctcatagaagtctgactccagcctctgcctccttctcacggccttcttccctgtatctctgtgtgttcaatctctctctcctttctaaggacaacagtcattagataaggccccccaccaatcctaaatccaggaccatctcatcttgagatacttaattacatttaccaagataaagtcacatttacatgtcccaaggcctaggacttggacatattttggggttggggggacacttcaacccactatatctccctgggtcctcttgagatgacactaatagtctttgatatttttcttgctttttgtgtaacatgatgttctgattcatcttgtagatttcctgcccttgacctggaattagtcatttctccaggaatctctggtttcttttagtggaaaattgtatttagagatcacaataaaggtgctaagaatgtattacttttgtaatcaataaaaacaattttcactaaataaaaaataattggccacttgtatcatcagtcatcaaaatggtcttcaacttatttctagaacttctaagagtctgttctagaaaactaatgcaaaacatttaagatgctatattcagaaagacattctttgtaaggattatctttttttttttttttttttttagagacagggtctcactctgtcacccaggctggagtgcagtggtgtgatcatagctcactgcagctttgacctcccaggctcaagcgatcctccaacctcagcttcccaagtagctgagaccacaggcatgtaccaccacactcaactaacttttaaattttttgtaaagaccaggtctcactatgttacccaggctggtcttggactattggcctcaagcgatccttccaccttggcttcccaatatgctaggattacaggcgtgagccactgtaccctgccaggattatctataaaagcaaaattttggctgggcatggtggctcacgcctataatcccagcactttggaaggccaaggtgagtggatcacgaggtcaggagattgagaccatcctggctaacacagtgaaaccccgtctctactaaaaatacaaaaaattagctgtgtgtggtagcgggtgcctgtagtcccagctactcacagtggctcacgtctgtaatcccagcactttgggaggccaagacgggcagatcacaagatcaggagatcgagactatcctggctaacacagtgaaacccggcctctactaaaaataaaaaaaaattagccaggcgtggtgatgggaacccgtagtcccagctactcgcgaggctgaggcaggagaatggcgagaacccggcagggggagcttgcagtgagccgagatcgtgccactgcactccagcctgggtgacagagagagactctgtttcaaaaaaaaagcaaaatttgaagcactataaacaacgatcagggatgcttgctaaataagttatggtacaaggccgggcacaggggctcacacctgtaatcccagcactttgggaggccaaggcaggtggatcacaaggtcaagagttggagatcagcctggccaagatggtgaaaccccatctctactaaaaaaaaaaaaaaaatacaaaaattagccggggatggtgatgggcatctataatcccagctactcaggaggctgaggcagaagaattgcttgaacctgggaggtggaggctgcaatgagccaagatcatggccactgcactccagcctggaagacagagcaagactctgtctcaaaataaataaataaataaataatttatggtatagtcccttaaagagaaatattatgtggccataaacaatgatagtaataatgaccctgtaatgatagttatgattattactatcattataatgacaggagaaatgctaatgctatgtatgacactaacaataaaaggatataacagtgaattaagattgtaacattcaaaactatgtctatgaataacaattgaaaaaataccccaaattgctaatatgattatttgaggatgatgggattaaaagggatctttatttttttaaatactacggttattttacctttaaaatagcatatttacatgtatcgtatttctttctgtgcacacccaaaatagttaaacagtgtttcttcatgaaagaactctggaacccctgccttggaggtccttacagatagtgccatcttacctggggagtggcctggggctaaacggactgctctgtggctccaaggccaaaccctggaaggtcatgaccttcgcaactcaacatgaccaggtccccaggcagagtgtgctgctgcctctgcctctggctggcttatgtgccactgaggggccttggtagacacacttcctatttgacctgctatattgctgccctggcacacaggagctccaagctgggctgtctgaactatcatttatgactgtcttcttgtggtctaggcatctgtaaattataaatacaaagtgggtagaagagcagaacctttccaaattactttctttctcttggcctcaggggaatcccagaccaagtgtgaaaaggacttctaattccatgtttaaggctgaatcaaaggttattctgggtcttccttctgctccatcagttgctgaactatggccatgtgggggcctccagcagaggcatcaccctttcctgtcccccagttcctaaacgtcagcatcccaaacaatggctatttgttgaggcagattgaaaatgccatgtaaatttcagaagacacataaaagcccaaaggattctgcttaacttagtaacacttctgagcatggaataactggctgtgactcatcatcaccaaaggctgggtcctagcacagacaagcttgttactgcttttctcatatgggttggagtgctactgacctacttttaacaggtcatgccctttgaggagcttacacaactccagggaggtgaccagtcatactttcttgcccagtcttcttttaacaaggcctttctgtaagacagctgcctgggcagccttatggctggacactgagctttcctctgtggcaggccaactggtctgacccaaggttgtctgtggccatgttaggacgtatattcttactcgccgagcgacgcagcccagagggttcaggaaaaggaggtggtgagtgggcagccaggatggctcacctgctgggtggtggccagacagtactctgccgtgctcaggatgttacagatgaggcagagctcctccagagtgaacttggctacttctgagccctccttttccttgaggaggctgctgatagtcagtcctccactgctggttgtggttctgaagaaaaggaacaggaacaagtcagcatggaatttctaatttgcttcctgaactggaaactacattattttaagatacagaaaagggggaagtaaaggctggacatggcccaaatcaattcacatacaatgagtccttttcctactgaccttaccttgacaccgtcagaaataggaagagatgattcctattttagttaatctgaatcatcagcaggccattagtcacattaactaggatggtctaatatccaaagggaaggctgctgagctgtcctctctttagcttggaatctcctgatgtgcagaactcatttaggaccgtgtggagcacgaaagatggttacctaccctgtttctttcagttaagaaaagtctgcactgggactcatgtgtgctggtggaggaggacataagcgcatgttaagagaagtctgcactggaactcatgtgtgtttgtggaggaggacataagtgaatgttaagaaaagtctgcactgggactcgtgtgtgctggtggaggaggatataagcgaatgttaagagaagtctgcaaggggactcatgtgtgcttgtggaggaggacataagcgaatgttaagacatgcttcctgcccaaggccctaagtgtctcaagaggccaacacccatcacacatcctcctgtgactacaggttttggggcagccccagctactgagtgagttctatggtagtaaccactacccactcatatctggatgctttggaatcctctgttggctcctttcaccttgcccccacttctgtgaacagtctctctactgacataatcccagctgagtatgccatttttttctgctgagatgctgactaatacacgtgggaaaatgctcccacgatgaagttaaacggtagctgcagggaataaagctataagcagtatagccccaattccgtgacacaaacaaacaaaagcacacagatcacacacattaggtatctatcaagaacggaaaaatatatacaaaaagttacgttctctttgggtagtgggattatacataatttatttatttatttatttattttttagggcggagtctccctgcaatgcccaggctggagtgcaatggcacaatctcggctcagcgcaacctccgcctcccgggttcaagtgattctcctgcctcagcctcccgagcagccgggactacaggcatgcaccaccacacccagctgatttttgtatttttagtagagatggggtttcaccatattagccaggctggtctcaaactcctgacctcaagtgatcctcctgcctcggctgcccccaatcctaccgcatcttcaaacattaggctatgtccagttctaatgcctcaggataacacaatagtccccataattaggagctatgcagtagctgacccccaatcctaccgcatctgaaacattaggctctgtccagcatggcaggaagtgtgcaccacaagagggacttggaacctactgggaatgaggaaaaagcagattcattcctccaacccatcactccggggcatcatctcaccaaaagaggcttgggtgaaactgcttaagctatttatcagttatttccaccacaacctcactttttttgtatgtgccaagtatctatagctgaatccatgaaaattaaataggcatacaatgggattggttctcgagtccaccgtggtaagatttgcccacgtgggcagtcagtgtggacatttcctctgatggtcttgatcagctgtggaatgtcagagaggaaatagcttcaggccctcgggaactcaggaagcgtgctttcctccttgatactcttggtggtttagtaaacaacttcagagtggatttccttaagattcccatatttaggtctatttgccaccactcagactatgaagaacaggactcacttgggcaggttgccagagaggattttccaggcgtattctcggaggtacttctggaaaatggtggtcagggcgatcatgggctccccagtactgagctgagagcattgcaccatgcacttcttgtagtagacaaagaggtcggcgcagctggggagcacggcacccccttcatcagtgttgggcttaggtggcccctgggctttgaaatcagccacaaaccgatctatcagctctccgaggttcctaggaggaaaaaaaaaaaccaaaaatgttattttacttcaagaaaagtaaagcaaatgtgctcgtttgcaatgtacataaactactgccacaagtaatcattcctactgcatttaaaacttaaaatcggatcgattttaatcaatatcatcattcactaccaccaccactcctacaacagcagtaataaaatctgacatatgagattctaatctctaagtcgattgacatttgtgctttatacttttcaaggcatttcattatcatattggactccaaacccctgtaagcaagatagggtattactggtcccgctaaaagatgagaaaattaagtcctagaaagtttctcacaaagtctgtggcagagctgagcctagactccaatactaaagtaagaaactaatccttctatcatattagtactgtttacccctccaaaaaggaaaaccctaaatcatgatagtgatcgttttctgaacacttgagatgcaccaggtattatgtccatgctttatacccatctcactgaacttcatttcctttttttttttttttttttttttttgagacagagtcttgctctgttggcccaggctggagtgcagcggcatgatcttggcccactgcaacctccatcttcagggttcaagcaattctcctgcgtcagcctcccatgtagctgggactacaggcacacgccaccatgcccagctaacttttattttcagtagagacagggtttcaccatgttgcccaggctggtctcgacatcctgacctcaggtgatccacccaccttggcctcccaaagtgctgggattacaggtgtgagccactcactgcgcccagctcatttactttttacaataaacttacatagtatgtattattactatcctcattttcaaagagttaagtacagaaaagttgagtaccttgtccagagtaatacagcaagaaaacaggagagccacgattaaaaactaagcagcctggctctaagcttcaagcctttaagcactctacttcctaaaaacaaaaaggttatgatgtcagcacatatttagacatcacgaacctaaatgtgcccaagagacagatgcctaaacaaagagaaactgtgaaatgtgttataatggtttctttctcctccgatttagttttttcttagaacttccagaatcaaaggtttaaaaaaatcttaggaaaagagagggtacgggcagagtgtggtggctcaagcctgtaatcccagcactgtgggaggccgaggcgggcagatcacttgaggacaggagttcgagaccagcctggccaacatggcaaaaccccgtctctactaaaaatacaaaaattagccgggtgtgggccgggtgcggtggctcatgcctgtaatcccaacactttgggaggcccaggcggcggatcacttgaggccaggagttcgagaccagcctggccaacatggcaaaaccccgtctctactaaaaatacaaaaattagcgtggtgtgggccaggcacagtggctcatgcctgtaatcccagcactttgggaggccaaggcaggcggatcacaaggtcaggagatcaagaccatcctaacacgttgaaaccccgtctctactaaaaatacaaaaaaaaaattagccgggcatgatggcgggtgcccgtagtcccagctacttcagaggctgaggcaggagaatggcatgaacccgggaggcggagcttgcagtgagctgagactgcaccactgccctccagcctgggcaacaaagtgagactctgtctcagaaaaaaaaaaaaaaaaaaaattagctgggggtggtggcgcatgcctgtaatcccagctacttggaaggctgagacctgaggcagagaatcacttgaactcaggaggcggaggttgctgtgagcccagctcacaccactgcattccagcctgggcaacagagcaagacttgatatctggaaaaaaaaaacaaaaaccaaaacagggtatgagcagctccagacttgcctcaggccacagtggggatgagagttgcaatttttctccgatttcccattcaaacatccctgtaattgttccgttgaattgtgtcatcacctgtgaggatccagcagagctgcagtaactgctgcctgcacagctgtgctgtgtgaagaatgggaagggttcccaccactcctgacatgttgcatctttttaggttgccgtttaaggctataggaatccagctgtgttttaaaaatgtatttatataatggtaaggaagaaaaagacaagaaccacacataccaccaattagcaggaataggagaaaattgacattttactcaaaggcttttgttattgaaagtctattataggcccaacgtgggggctcacacctgtaatcccagcactttgggaagccggggcgggtggatcacctgtggtcgggagtttgagaccagcctgaccaacatagagaaaccccgtcttcactaaaaacacaaaaaattagccaggcgtggtggcgggtgcctgtaatcccagctactcgggaggctgaggtaggagaatcacttgaacctgggaggcggaagttgcagtgagccgagatcgtaccattgcactacagcctgggcaacaagagcgaaaccccatctcaaaaaaaaaaaaaaaaaaaaaaagaaagaaaagaaaaagaaagtctattatatccagatacaaccactctgccctcaaagagcttctggcctaggctaagtctctgtctgtggtgatagtgagaaagcagggaaggatctcgttggttgacctcggaaagcttcatggccaccactcttgttcctcataacctctcttgcctcactttcccactgaatctcccacctctcctccacagctgacccaacactccagccagaggttcctcgcaacagctcccctgctggcctactcccggtcagtgggcctcgcaacggctcccctgctggcctactcccggtcactgggcctgtgtgacgtcctggccaaaacgctctcccaccacctgtccactcccctttcaagctcatccaggtctcacccgcagcagctgcaacttctgtcatctgccacccaccaacactttatttaacactttattagacagtgcgaggatgccatatattcaagaaataaccggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccaggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaagaaagaaataacctatcttctcccatcctgggccacggtaggcaatgctaatcaacaaggagccctttcttcactgatctctcttgtgattccagaatccttcttgagacagcactccagccagtcacctctatcaactgaagttggtacaaaaggcgaaggaggtagaatcatctgtttcgtgcctgttaacacaagctccctgagaggaggaatgacgtttatgctggttctgctgcccccggcccgcccgtcatgccaatgagtggagtgaagcttcatgctagtgctcgatacatacttacctgatcaacctccacactttgttcctaggggatgggaatggagggtgggaaggtggaaacgggatggaggccggtgcagtggaggagaacatggaacagaaggcaaaagattcccctggggtcttcttatgagattctaatctctaaattgatagtgccaaccaaatcagggaccagagctctgacatgggtgttttttttgtttttttttgtttttgttttttgctttttttggagacggagtctcactcagttgtccaggctggagtgcagtggtttgatctcagctcactgcaacctctgcctcccgggttcaagtgattctactgcctcagcttcctgagtagctgggactaccggcacacaccaccacaaccggctaatttttgcttttttttttagtagagatggggtttcaccatcttggccaggctggtcttgaactcctgacctagtgatcgcccgcctcagcctcccaaagtgctgggattacaggcgtgagccactgcgcccagccgactctgatgtgcttccaggcgtgagccaacgcgccagccaactctgatgtgattctattttcatcactcacctgttcccctagaagatggatacttacttacttgcttcctatttcagagccaccccaatgagtaagattataaactaattatgatcatacagcataaagaaaatgttcacttcaaaaagctctaaagatctatactttgtagaatgtctacaggatgtctactcggttacttctgacattgttctttcaagtggatgagaaataaaccagttggggaaaccttcccctgccttccatctttcaccctgcatcagcatgctttgatgccacatgagacattagaaaatcagtagccagtatttcacagaacagaagaatgtaagttaccccaatgggaatgcgtaaggctcattagttttgaatacatgatccaatctgatcacatttcttttttttttttttgagacagagtattgctttgtcacccaggacaaagtgcagtggcatgatcatggctcactgcagcctcaacctcccaggctcaagcaattctcctgcctcagcctcccaagtagctgggactacaggcgtccatcaccatgcatggctaggaggaggccaggagtttgagaatagtgtgggcaacaaagtaagatccctatctctaaaaaaaaataaacaaattagttaggcatggtggtgtgtgcttgtagttacagttacttgggaggctgagggaggacgatcatttgagcccaggagtttgaggttacagtgagctataatgccaccactgcactccagcctggacaacagagcaagacattgtcgaaggggaggggaggggaggggaggggaagggagaaggaaggaaatacctccttcccgaaatactgctgggagttccactgataaattacatgccctaggaatgaagacagttgcagagtggtatcagtagagggaaaaactaaagtgaggagaaaaaatatgccattgcagactgggtttatccatggatggccaaggccatttctctggtgggcctgcagtcagcattcacagaaacaatattctaattggaatgtcaagcagtgaggcacagggagagaaagacagtagccagaagatggcaacgcaggtgagcaaggtcaaggcagctgaagatccccattaagttagataacttatttatttatttttttatttttttgagacagggtcacccaggctggagtgcagtggcatgaccacagcttactgcaacttctgcctcccaggctccagcaatcctcccaccccagcctcctgagtagctgggactacaggtgcacaccaccacacctggttaatttttgtgggcttttttttgtagagacagggttttgtcatgtcacccaggctggtctcgaactcctgagctcaagccatccacctgcctcagcctcccagggtgctgggattacaggcacgagcaaccatgcccgaccctagagcttcttaattcaagggtactcccactaatttgcatcccttcctcttcctttttgctggggctgaggatgttgctctggtgtggccagtggggctggggagccaaggtgtggcttgagcacagctgggagatgggttacatacaggcaaactgagcaaataggtaaatatactgagcatgctaggacccaaatttctcactgttgtagaaggcagttgccaacgttgaatgggagaggctaaaataaaccctgtggtgtgagattagaattgaaggcatcagcatcaaatgcacaggttctaatatagaagcaggtgcacacacagctatagaggcatatatgtagaagcaggtgcacacacagctatagagacatatacacgtatgtttatacacacatacatttcttagctctctcagccaaggcaatctggaagcaatgacaccgagcagcaatgagcatacttggtttctaaatgtcatcctccaccaaaggaacaagaaatgcctggggaaatggacgactccagggctgggatacaaaagtacaggataagcctagtatattttattgtgccagagaggaaggaggtgctcaaaaaatgatagtggcatgtaaaaaggatgaagagccagctttaagaggctcccactggccaagtcagggacaatttgagtactaaaataacaacgacaaatcctggaaggaaaaacagacactaatggaaaaactggtgaagttcaaacacggtgtgcaggttattaaatagtaatgtaccaatgttaacttgccagttttgacaactctgctgtggttatataagatgtcaacatcaggggaagttgggtgaaggggaacataagaaatctgtactatttgtgaaattttcctataggtatacatttattccaaaatacagtaaaaataaaagagatagtgatgcctacaacctactgaataaaatataaaaatccatgagtccatgctgacatagacataagggggagaagtgacagcttttcttaaagtagaatgccaactgataaacgcagaagaaatgatgtagctagaaaaatcaccatttgactgggcgcggcagctcatgcctgtaatctcaacatctagggaggccgaggtgggcagatcacttgaggtcaggagttccaaaccagcctggccaacatggtgaaaccccgtctctactaaaaatacaaaaaaattagctgggcatggtggcgagcatctataatcccagctacttgggaggctgaggcaggagaatcacttgaacccaggagccgagattatgtcactgcactccagcctgggcgacagagcaagactctgcctcaaaaaaaaaaaaaagaagaaaaatcatcattgtcaatcatcttagtaataaattacatgataagtgaaagatgaggaaaaggatattgataaagtttcaaggtttctcccaacacttattaataaatagagatacccagtagagacaacatctacaccaagtaataaaaacgaacatcataggctggccgtggtagctcacgcctgtaatctcagcactttgggaggccaaggcgggtggatcacctgaagtcaggagttcaagaccatcctgaccaacatggcaaaaccctgtctctactaaaaaaaagacaaaaattagctgggtgcagtggcgggtacctgtaatcccagctactcaggaggctgaggcaggagaattgcttgagcccaggaggtggaggttgcagtgagtggagatcgcaccactgcactccagcctggggaatagagtgaaacgactctgtctcaaaaaaaaaaaaaaaaaaaaaaagaacatcacatcacaagttttgggataaactggcattctgtgcctcctgatatgaattcctaggaacacaggaccacttctgcataaatcataaataatgaggaaacatcagacaaacccaaactgagggaaattccagaaagtaattggccaatcctcttcaaaaatgtcaaggtcatgaaagacaaagaaagactcaattagtcttctgggttgaaggagaccaaagagacatgacaactaaatgcaacctgtgatcctagagctatttaaacaaacaaacaacctgcgatctgagagctattcaaacaaataaactaacaacctgtgatcctagggctattcaaacaggccaacaaacaagcagattgggacaactgctgaaatgtgaggaggagagcatggatgaagcagtaatactgtatcactgtgaattccctgatgttgatagctgtactgtggttatgtgaggggtctgggattaagcagtaatgttgtatcaacgttaatttcctgatgtggacagttgtactgtggttatgtagaaaccttgtttctaagaaatatatattgaagtattaaggagtagtggcgaatcttgtctgcaacttgagaattcaaaggttcaggaaaaaagtacaggttgggcacagtggttcacgtctgtaatctcaacactttgggaggccagcagatcacttgagcccaggagtttgagaccagcccgagcaacatggtgagaccctgtctctacaaaaaaacaaaaattagactgatgtgatggcctgtgcctgtagtctcagttactctagaggctgaagtaggaggaggggaagggagaggaagggaggggaggggtggggaggggagggagaagagaaagggaaagagagaaaaagaaaaagaaggaagagaaaaaagaaaaggaaaatgcatgcagtgtctgtgcattacgtgtgtgggggagataactattaatgaggaatctggatgaaggctatacaagggctctttgtataattcttataattcttctgtaagcttgaaattaattcaaaataaacaacaatgggctctccctctccctctccttctccctctccctctccctacagtctccctctccctctccctacggtctccctctccccacggtctccctctccctctctttccacggtctccctctgatgccgagccgaagctggactgtgctgctgccatcttggctcactgcaacctccctgcctgattctcctgcctcagcctgccgagtgcctgcgattgcaggcgcgcgctgccatgcctgactggttttcgtatttttttggtggagacggggtttcgctgtgttggccgggctggtctccagctcctaaccgcgagtgatccgccagcctcggcctcccgaggtgccgggattgcagacggtgtctggttcactcagtgctcaatggtgcccaggctggagtgcaggggcgtgatctcggctcgctacaacctccacctcccagccgcctgccttggcctcccaaagtgcccagagtgcagcctctgcccggccgccaccccgtctaggaagtgaggagcgtctctgcctggccgcccatcgtctgggatgtgaggagcccctctgcctggctgcccagtccggaaagtgaggagcgtctctgcccggcccccatcccatctaggaagtgaggagcgcctcttcccggccgccatcccatctaggaagtgaggagcgtctctgcccggccgcccatcgtctgagatgtggggagcgcctttgccccgccgccccgtctgggatgtgaggagcgcctctgcccggccgcgaccccgtctgggaggtgaggagcgtctctgcccagccgccccatctgagaagggaggagaccctctgcccggcaaccgccccgtctgagaagtgaggagcccctccgcccggcagccgccccgtctgagaagtgaggagcgtctccgccgggcagccaccccgtccgggagggaggtgggggggtcagccccccgcccggccagccgccccatccgggaggtgaggggcgcctctgcccggccgcccctactgggaagtgaggagcccctctgcccagcgcgtctgggacgtgtgcccaagagcttattgagaacgggccatgatgacaatggcggttttgtggaatagaaaggcgggaaaggtggggaaaagattgagaaatcggatggttgccgtgtctgtgtggaaagaagtagacatgggaaacttttcattttgttctgtaccaagaaaaattcttctgccttgggatcctgttgatctgtgaccttacccccaaccctgtgctctctgaagcatgtgctgtgaccactcagggttaaatggattaagggcagtgcaagatgtgctttgttaaacagatgcttgaaggcagcatgctcgttaagagtcatcaccactccctaatctcaagtacccagggacacaaacactgcggaaggcctcagggtcctctgcctaggaaaaccagagacctttgttcacttgtttatctgctgaccttccctccactattgtcctatgaccctgccaaatccccctctgtgagaaacacccaagaatgatcaataaaaataaaaataaaaataaaataaaataatcaacaatggtaattagtttacagacagatgctaggctctagaaaagcatgagttctagtctaacaaaagttattagagggaactcaggagaatgggcagatatggagtcaccagtaacttccctgatggagaacgccatagaatggggtaaagaaagtgcctatgtagaaatttcttttgcaagagtcagccagaggaaatcactaaatgccaagggtagaagacagactaacctcctctttgaacataaataaaaattgagaaagccatttaaaggatgtaaggacggcttagcccaacctgctagtggccatccccacttcctgcctcctccctgagtactggctctgcagtcctcctactgctacttggcttttggctggggcagatgctgccggaactttcccttggcaggtgggaggctggggagatgagaaggtggaccccatgccaggctcaagagaaatctggccacactgacaaggccacccacccacataggagtcctgaaaaagatgagagggatggcagggcaggcactgttcctgagcaccatttactgtgtgctgaaggtgaaaatgccacctcttctcctcctcgccacaaagtccatgaggtcggccttatgatcctcacagtgtagaggggctagctaggagcatgctcaaggtcccagcctagcaagcgcgaagcctcacatctaggtatgtctgggatcaggcccacgctctttccaccacactgtgttgcgtctctgtcatctgggaagttatgaatggtctcatgctttctgagttagagctacagcaaaagtagtaatgtgcacaaaaccagtccccacctgagttccttctccagcctcaggattctttgaagggaagaagcagttcctagaactccttgaaattacactcaaaatagtgtgtgcatgatatggatttttttgacaagagcgtcgatgctttccattgggttcttaaaaaggatctatgactttaaaatggttaataacgagtgcgttgggcattattttgtctgactatctctcttgacagataaggaaatggagttctttgaactctattttctactttgagttacagtgtttattctgcaggaacagcagcacagcctgcgcagtatctgctccttccttagtgctgcggaaacttcctagtgaggccaaacagcagggtaagtggccagcacttcatttttcacaggaaaatggagagtccccaaggaagggaggcctggctccttgcccaaagtatcatgaacaatgagtatactttgtataaatcaaggccatgtgaaaagagtggatgccagaattacaataactcagaaaaatgaccctttaaaccaggtaggttttgggaaaggatgtggctacctcagacatgtgctttaaaccctgggccttggctgggcgcggtggctcatgcctgtaatcccagcactttgggaggtggaggtgggctgacctcttaagcccaggagttcgagaccagcctgggcaacatggcaaaactgcgtctctacaaaaaatacaaaaattagccaggtgtggtggtgtgtgcctgtagtctcagctacttgagaggctgagtaggaaagactgctgaaacccaggaggttgaggctacagtgagtcctgatcacgcctctgtactccatcttagctgacactgagaccccgtctcaaaaataaataaataaaaataaaccctggacccagtaacttttaagccttttaaaacgaaaaatttgggttaagagaagatggggctttggctgaaaagagtcatccaggggggttcctcaaagacctgtgactctaataggcaaataaccaatcctttttcctgcccctcaggggtgtcttagtaacttcctggaggcaaactgtgaatgtagaagacagggtgctctcaaggacaaagaggcagaagtccccactgtacctcggtgtgcctgctgggcacgtgcccactgggcaagagcaagggcactactgggtctttgcaaggcaaatgacggcaaggcaacttgcctttggtggtgggctgatggggagacttccatttgatgatggagaagctactgggcaagttcattttctgagattttaatatgaagtactttgtaatcgggcatgaaaagcatagaagcagtccataaaatcacgtgagtgaataatacagttccatgtgaagtttctaattgaaacattgtcttactgttacggtttaagaaacatgtttgaaactaagaatgtgctcacccatgatagaagcattaaaaacaaggggaggggtgaagtgcaatcagacctaaatgcgtaaatgcaaccccagagagcctccctaaaaacctaatacgttcccagagaacttccctcagaacctaacgcgttcccagagaacttccctcagaacctcaatgcgttcccagagaatgtccctcagaacctaatgtgttcccagagaatctccctcagaacctaatgcgttcccagagaaccttcctcagaacctcaatgcattcccagagaacttccctcagaacctaatgcattcccagagaaattccctcaggatctaatgtgttccagggaacctccctcagaacctcaatgcgttcccagagaacctcccccagaatctaatgctttcccagagaacctccctcaggacctagtgcgtcccagagaccttccctcagaacctaatgcggtcccagaagacttccctcaggacctaatgcgttcctagaaaactctcagaacctaatgcgttcccagagaacttccctcagaacctaatgcattcgcagcgaacctccctgagaccctaatgcgttcccagagaaattcccttaggacctaaatgtgttcccagagaacttcactcagaacctaatgcattcgcagagaacctccctcagaacctaatgcgttcccagaaaacctccctcacaacctaacgcgttctcagagaacttcactcaggaccaaatgagttccgaaaaaccaccccagaacctcaatgtgttcccagagaacctccctcagaacctaatgagtttccaaagaacctccctcagaacctaatgtgttcacagagaacctccctcaaacctaaatggttcccagagaacctctctcagaacctaatgtgttcccagacaatctgcctcataacctaatgcgttctcagataacttccctgagaacctcaatgcattcccaaagaacttccctcagaacctaacgctttcccagacaacctccctcaggacctaatgcattcccagagaatctccctcagaacctaatgcattgccagagaacctccctcagaacctcaatgcattcccagaaaacatacctcagaacctaatgcattcccagagaatctccctcagcacctaatgtgttcccagagaacctccctcaggagctaatgcattcccacagaacctcctccagcacctaatgcgttcccagagaacctcccacagacctcaatgcattcccagagaacttcccacagaacctaatgtggtcccaaagatcctccctcagaatctaatgcgttcccagaaaaatttcttcagaacctaatgcattcccagagaacctccctcaggacctccatgcgttcccacagaacctccctcagaacccaatacgtgcccagagaacctccctcagaacctcagtgcatttccagagaacctccctcagaacccaatatgtgcccagagaacctccctcagaacctcagtgcattcccagagaacctccctcagaacctaaagcgttcacagagaacctccctcagaacctaatgcgttcccagaaaacctccctcagaacctcaatgctttcctagagaacctccctcagaacctcaatgacttagcagagaacctccctcaggacctcaatgcattcccagaaacctcgctcaggatctagtgcgttcccagagaacctctcagagaacctaaagcattcccagagaacctccctcagaacctaatgtgttcccaaagaacttccctcagacctaatgctttcccagaaaacctccttcagaacctaatgcatttccagagaacttccctcaggacgtcaatgcgttcccagagaacctccctcagaacctaatctttcccagagaacctctgtcagaactcagtgagttcccagagaacctccctcagaaccacaatgcattcctagagaatctcccacagaacctcaatgagttaccacagaacctccctcaggacctcaatgcgttcccagagaacatccctccaaacctaatgcgttaccacagagcctccctcagaacctaatgcgttcccagagaacccccaacagaatctcagtgcattaccagaaaacctccgtcaggacctaatgcggtcccagagaacatccctcagaacctaatgcgttcccagagatcctccctcagaatctaatacgttcgcagagaaactccctcagaacctaatgcattcccaaagaacttcctttaggacctcaatgcgttcccagagaatctccctcacaaagtaatgcatttcgaggcaacctccctcagaacctcagtgcattaccagagaaccttcctaagcacgtaattcattcccagagaacttcccccagaacctaatgcgttcccagagatcctccctcagaatttaatgcgttcccagagaaattccctcagaacctaatgcattcccagagaacctccctcagaatctcagtgcattaccagagaaccaccctcaggacctaatgtggtcccagagaacatccctcagaacctaatgcgttcccaaagatcctccctcaggacctaatgcgttcccaaagatcctccttcagaatctaacacactcacagagaaattccctcagaacataatgcgttcccaaagaacttcccttaggacctcaatgcgttttcagagaacctccctcagaacctaatgcgttcccaggcaacctccctcagaacctcactgcattaccagaaaaccttcctaagcaggtaattctttcccagagaaattccctcagaacctaatgcgttcccaaagaatctccctcagaatctaatgcattcctagagaacatccctcagaacctgatgcgttcccagagatcctccctcagaatttaatgcgttcccagagaaattctctcagaacctaatgcgttcccagagatgctccctcagaatttaatgcgttcccagagaaattctctcagaacctaatgcgttcctagagaacctccctcagaacctcagtgcgtttccagagaagctccctcagaacgtaatgcattcccagacaacttccctcagaacctaattccttcccagagaacctctctcagaacctaatgcattcctagagaacttccctcagaacctaatgcgttcccagagatcctccctcagaatttaatgcgttcccagagaaattccctcagaacctcagtgcgttcccagagaacctccctcagaacctcagtgcgtttccagagaagctccctcagaagccaatgcattcccagacaacttccctgagaacctaattccttcccagagaacctccctcagaacctcagtcaattaccagagaacctccctcagaacctaatgcgatcccagagaacatccctcagaacctaatgcgttcctagagaacccccaacagaatctcagtgcattaccagaaaacctcccgcaggacctaatgcggtcccagagaacatccctcagaacctaatgcgttcccagagaacctccctcagaatggaatgcgtttgtagagaacttccttcagaacctaaggcgttcccaaagatcctccctcagaacctaatgcgttcccagagaacccccaacagaatctcagtgggttaccagaaaacctccctcaggacctaatgcggtcccagagaacctccctcagaacctcagtgcattaccagagaaccttcctcaggacctaatgcggtcccagagaacatccctcagaacctaatgcgttcccagagaacctccctcagaacctaatgcgttcccagagaatctccctcagaacctaatgcgttcccagagaacctccctcagaacctaatgcgttcccagagaacctccctcagaacctaatgtattcctagagaacttccctcagaacctaatgcgttcccagagatcctccctcagaatttaatgcgttcccagagaaattccctcagaacctaatgccttcccagagaacctccctcagaatctcagtgcattaccggagaaccaccctcaggacctaatgtggtcccagagaacatccctcagaacctaatgcgttcccacagaacttccctcagaacctcagtgcgtttccagagaacctccctcacaatctcagtgcattcccagagaacttccctcaggacctcaatgtgttctcagagatcctccctcatgacctaatgtgttcccagagaacctccctcagaacctaatgcattccgagagaacttccctcagaacctaattccttcccagagaacctccctcagaacctcagtgcattaccagagaaccaccctcaggacctaatgcgttctcagagaacctccctcagaacctaattccttcccagagaacctccgtcagaacctgagtgcattaacagagaaccaccctcaggacctaatgcgttcccagggaacctccctcataacctaattccttgccagagaacctccctcagaacctcagtgcattaccagagaaccaccgtcaggacctaatgtggtcccagagaacatccctcagaatctaatgcattcccagagaacccccaacagaatctcagtgggttaccagaaaacctccctcaggacctaatgcggtcccagagaacctccctcagaacctcagtgcattaccagaaaacctccctcaggacctaatgcggtcccagagaacatccctcagaacctaatgcgttcccagagaacctccctcagaacctaatgtgttcccagagaacctccctcagaacctaattccttcccagagaagctccctcaaaacctaatgcattcccagacaacttccctcagaaactaatgcgttcccagagatcctccctcagaatttaatgcgttcccagagaaattccctcagaacctaatgcgttcccagagaacctccctcagaacctcagtgcgtttccagagaacctccctcacaatctcagtgaattcccagagaacttccctcaggacctcaatctgttcccagagatcctccctcaggacctaaggtgttcccagagatcctccctcagaacctaatgcgttcccagagaacctccctcagaacctaatgcattcccagagaacttccctcagaacctaattccttcccagagaacctccctcagaacctcagtgcattgccagagaacctccctcaggacctaatgtgttcccagggaacctccctcagaacctaatgtgttcccagagaacctccctcaggacagaatgcgttcctagagaacttccctcagaacctaatgcgttcccagagatcctccctcagaatctaatgcgttcgcagagaaattccctcagaacctgatgcattaccagagaacttcccttaggacctcaatgcgttcccagagaacctccctcagaacctaatgcattccaagagaacctccctcagaacctaatgcattccaagagaacctccctcagaacctcaacgcattcgcagagatcaagacctctacgcgttcccagagaccctccctcaagacctaatgggtacccagagaacctcccacagaacctaatgcgttcccagataacctccctcagaacttaatgcattcccagagaccttccctcacaacctaatgcgttcccacaggacttcactcaagacctaatgtgttcccagagaacttccctcaggacctaatgcattcccagagaacctccctcaggacctaatgcgtttccagagaacctcccttaaaagctagtgcgttcgcagagaacctccctcagaacctaatgcattcccacagatcttcactcaggacctgatgcgttcccagagaacttccctcaggatctcaattcgtttccagagaacctccctcaggacctcaatgcgttcccagagaacccctctcagaacctaatgggttcccagagaacttccctaagaacctaattcgttcccagagaacctccctgagaaccctgaggtcacagaggaccttcctcagaacctaatgcattcccagagaacttccctcaaaacctaatgcattccctgagaatctccctcagaacataatgcgttcccaaagaagctcccacacaacctactgcgttcccagagaacctccctcagaacctgaatgcattcccagagaacttccctcagaacctaaggcattcccagagaacttccctcagaacctaatgcgttcccagagaacctccctaaggacgtaatgcattcacagaggacttccctcagaacctaatgcatccccggaaaaccttcctcagaacctaatgcgttcctagagaactttcctcagaacttaaatgcgttcccagagatcctccctcagaatctaatgcgttcccacagaaattccctcagaacctactgcgttcccagagaacttcccttaggacctcaatgcgttcccagagaacctccctcagaacctcagtacattcgcagacaacctcccttggaacctcagtgcattcccagataacctccctgaggacctcaatgtgttcccagagaccctccctcagaacctaatgtgttcccagagaacctccttcagaacctaatgcgttcccagagaacctccctcagaatctaatgcattcccagagaacctccctcagaacctcagtgcaatcccagagaacctgccttcaaacctaatgcgttcccagaaaacatccctcaggaactaatgagttccaggagaacttccctcagaacctaatgtgttcccagagaacctccctcagaacctaatgcatcccagagaacatcactcagaacctaatgtgttcccagagaacctccctcagaacctcagtgcattctgagaacctccctcaaaacctcagtgtgttcccagagaacctccctgaggacctaatgcattcccagagaacctccctcagaacccaatgtgtccccagagaacctccctcacaacccagtgcgttcccagagaacctccctcaggacctcaatgcgttcccacagaacttccctcatcatctaatgcattcccaaagaacctccctcagaacctagtgcattcccagagaacatcactcaggacccaatgtgttcccagagaacctccacagaagctcaatgcgttcccagagaacctccttcagacgctaatgtgttcccagggaacttccctcagaacctcaacgcagtcccagagaaactccctcagaccctaacgtgttcccagagaacctcccttagaacccaatgcgttcccagagaacctccctcagaacctaatgcgttccgagataacctccctcagaatctcaatgcgttcccagagaacttctcttagaacctaatgcgtttccagagaacctccctcagaatctccatgcattctcagaggacttccctcagaacctaatgtgttcccagagaacttccctcaggacctaatgcgttcccagagaacttccctcaggacctaatgcgttcccagagaacctccctcaggacctaatgtgtttccagagaacctcccttagaacctaatgcgttcctagagaacttccctcagaatctaaagtgttcccagagaacctccctcagaacctcagtgcattagcagagaacctccctcagaacctaatgcgttcccacagaacttccctcacaacctaatgcgttcccaaagaacttccctcaggacctcaatgcgttcccagagaatctccctcagaacctaatgcgttcccaaagaacttccctcagaacctaatatgttcccagagaacctccctcagaacctcagtgagttcccagagaacctccttcggaacctcagtgcattcccagagaacctccctcagaacctcagtgtgttcccagagaacctccctgaggacataatgcattcccacagaacctccctcagaacctcaatgcgttcccagagaccttccctcacgacctaatgcgttcccagagaacttcccccaggacctaatgcattcccagagacctctctcagaacctcaatgcgttcccagagaaccttcctcaggacctaatgcgttcccagagaacctccctcagaacttcaatacattcccagagaactttcctcagaacctaatgcgttcccagggaacttccatcagaacctaatgcattcccagataacctccctcagaacctgaatgcgttcccaaagaacctccctcagaacctaatgtgttcccggagaacctcactcaggacctcaatgcgttcccagagaactcccttctgaaccaaatgcgttcccagagaatctccctcagaacctaatgggttcccatagaacctccctcagaatctaatgtgttcccagagaacttccctcaggacctcaatgcattcccagagaacctccttcagaacctcaatgcgttcccagagaacttccctcagaacctcaatgcgttcccagagaacctccatcaggacctcatgcgttcccagggaacctccctcagaacctcaatgcattcccagagaacttccctcagtacctaatgcgttcccagggaacctccctcaggacctaatatgttcccagataacttccctcagtacctaatgcattccccaagaagctccctcagaacccaatgtgtttccagagatcttccctcagaacctcagtgtgttcctgaagaacttccctcaggactttcctgcagccgctgttgctctccccatgggagccaccttctggtcccttccgagtgcgttctttagactgtgaggcttcctctgggagcccaggccagtctgtctccagtcatctcgttacaatcatcttgacctttccaaaacctgccttccaacgtggaagggcttggctgcggacaaggacgcagggatgaggaggagtcttcctccttttctaatgccccctcacgcacacaacggacactggagcacgaacacagtcttcggctgttagtttggaagtctttgggatttttttaaaaacagggtgggagggaagaaacctggccgcagtgagatgctttataaaaatatttggaggctacaagtttgtgaaaagcatatagtatattttgtttgcttttcttttctttttttcttttgagacgaagtctctgtcaccaagctgggtggcatagtgacggctaattgcagcctctgcctcctgggctccagtgattttcccacctcagcctctcgagtagctgggactacaggtgtgcatcaccacacctgactagtttttttaaaaaaattatttataaagatgaggtttcagcatgttgcccaggctggtcttgaatcctgggctcaagagctcctcctaccttggcctcccaaagtgctgggattacaggtgtgacccactgtacctggccacgtgaaaagcatatactgtattatatagatgatccataaaataaaatcagaatccatgagttcatactgatatataaacaaataggggagagggaaaattcttccatatagtagaactccaattagtaaatgtagaagaaatgatgaaaatagacaatcgacatttggcaaatgccacagaaacaacgcttccgtcaggaatcaatcaagggatgcgaaatgagtgggcaaaagtttgatgagagcaggatatttacaaagtatcatcccataagatacttattaattaccaggagaaaaatagtaacttcacattgaagacagttggcaggtaccacctaaagcaagtaatcgaagtccccaataatgggacaaatcaatgtgatgtgcctcttgacacaatgcactggggatacaatgccacttttatggtgttcttgcccaaaattgatttcatcaagaaaaaacaaacaaaaactgaggacattgtacaaaatacctggccagtacacactgaggtcgtgaaagacaaagaaaacttgaggaatggctgggcaaggtggctcatgcctgtaattccagcactttgggaggctcaagtgggtggatcatttgagcccaggagttccagaccagcctgggcaacacagggagacagaatctctactaaaaatagagggtggcatgtgcctgtggtcccagctacttgggagactgcagtgggaggattgcttgagcccaggagatggaggatgcagtaagtcataatctcaccactgcaccccagcctgggggacagcgtgagactctgtctcaaaaaaggaggggaggggagggaataaaaagatgaggaactactcaagattaaaggagaccaagatcaaagagatctgacaacgaaatgcatgattattgggtcctggaccagaaaaaggggcattaatgggacagtattaccttctcgattttggtaactctggttgttatgtaagatgttaacattctctgaggagggcatgtgaaaattttttgtcctatttttgtaacttttttataagtctaaattatttcaaaataaaaggataaattatacttgaaaacatatatattagagactaggctttcttccaatacccagtgcctgacactgtaaagctttgtgggctgatatatgtcagggctcaacacccacataggaagggatcccaatgtagggatccactggggaccttattaggggcaaactcaggctctgagatttatagacacaattaatgataacattcaaaagatgtaaaaatacccctaatgggtttctagggagggtcacaggcatgccacaaccatctttcagccccggaaggagctgtgcgctcctaagacccagtcatgaccagagcggcgagaaatgcaggcagaaaacagcgaatgttcctcactcacttgtcttgggattcgatatacacgtagagatgaggctcaaaacacttggaaacaatgccatgaaatggattgtctggggctttaggcttctttggctgtaaaaacaaagaaaaataaaccccatacttgagtgatctttgcaaatgttcaagaatttttttaaaaacatcatttcaaagttcattcctaagtcacagataagagagtactcaatgtaacccaatacgatggtttcaccattcaccctggcaggtgaagaaaaaccagctttgttagcataactcacttgctctggacgatgaaagacatactgctacctggataacatatgtgttttgaatctggaagcaagtcatcatctatctgactggtgttttccagaatttaaatcccagctaataatagcaccttgtatttacacagtgctttagaatttaaaaagtgctttcacacaatccaatttttgatagcactttgataccaactaatatgtcacctgctcctcacaataatccttcatgtaggtatgactactactattttacacctcaagaaatgaggactcagaggttctctaacctgccccaacacatatgtagacgtctgcttttcttaaactagaactctttctgttataccattattttcctgcaatggttcccagaattttttgaattccatcagtaagaaaatgtaagaaaaagaagaatggacaaccaatagaggattgttaactttattttgctactttctattcttaccacgagttcctaaaaaaaaaacaaataaagggtttttttgtttgctttttgagacagagtctccctctgtcacccaggctaaagtgcagtggcgccatctcagctcactgcaacctgcaccttctggactcaagtgattcttgtgtctcagcctcctaagtagctgggactataggcacacgccaccacaccgagctaatttttgtattttaagtagaggtggggttttgccatgttggccaggctagtctcgaactcttggcctcaagtgatccacccacctctacctcccaaagtgctgggcttataggcatgaggcatggcgcccagccagaaaattgtattttatacccccaaattttataagaataaaatagcagcatataggcagtactttctaagaaaggacagttggtaaccttacatcagatagatagagagagagacaggcaggcaggcaggcagactatattgtctttattttttgctttaggccactgcaacactagatgagcgctggttcccaggctgttacttggaagccactgataaagaagtcatatgacaggcaagtattttaaaacaatatttgccacttaattcctttccaaacatctaaaaaataagcaaagattttcctatgtattacttctattcctaacaaatgtgaattctgtctattgccaaatgtctacaaaatgaccctgagccaaacacaccatgctggggttgatactaaatcataatttgcatgtaaattggcacccacaacatacttgttaaattgaactactcatatcttattttttaaaaacccactttattgaggtatgattgacattttaaaagccctacataattaatgtatacatcttgatgcgtttgaggataagtacacacccacaaagccctcaccaccatcaaggcagtaagtgtatccaccacctccccaagcctcctcccacccctgttgttacgattattattacttgtggtaagaatgcttgctgggcacggtggctcacgcctgtaatcccagcactttgggaggccaaggtgggcggatcacaaggtcaggagttcaagaccagcatggccaatatggtgaaaccctgtctctactaaaaaaatacaaaaattagcaggttgtggtggtgtgcgcctgtagtcccagctacttgagaggctgaggtagaaaaattgcttgaacccaggaggtggagatggcagtgagccgagattgcaccactgtactccagcctggcgacagagtgagactccatttcaaaaacaaacaaacaaacaaacaaaaaagaatacttaacataagatctaccctcttgaactgcttatatattttaataaatactggaagagataagccctaatgacagaaatgataactacctatttctggcctttaaaaaaatttttttttaaataacacgttgcaatggttaaaaacatctgtaaaaactgatttgtaaaaaatgatcactaaaaattaaatgtcaactttagacacatctactcaatcttgtacttaaccctcttccctttttacctttcaggagttccatgtctttcattttttggcaaggtttctagaaactttggtccttcctaagaataaatacaatctgcactgtttttactcttatcatctggaagtcactgccaaagccaggccttggactgagcccacaaccacacaagcctggctgattgagcttgaatctgccggatctagaattccacttgagtgcacagatgtcctgggagtttttctgcatttccattagtttaagatgaaggatctatgatggaggatgaggattgtgaggggtgtcctcacccacttgtcctgtttattccaagtcagtatcttttattattgattcaataagatgacttaagtgaatagaaaaatgtgatttaatttgtctaactctataggactagatatcatggattcagatttggaaaacatggctactacaaacagatatctttttattaattaaataataatgataagtattatagctattctttttatttaatttttttcttcttttgaagaaaatattcacactctgcaggataacttctggtaattatacatgtgaatttacataatacagaatgttaacatttaaaaaaatcaacgtgtatattttgctttttttttaaattttgaacatgtatattttgtattcagctttactgacttactaatttatgtgtactttcccaactactgacaatattttatcactttaaaatggctacattatgaaaatctttaaaagcctatatattatagattactgtatggatgttaaattttctgattttgatctatggtaatagaattgaatgccctttttcttaagaaatatatactaaaatatttaggggtaaaggacattatgtctacaacttacaaattgttctaaaggtcgggggggagtggggaggaaataataaagttatatagcaaaatgttaacaattgctgaatccagaagaaagatatttaggagctccttgtaacttttctcttagtttgacattattttaaaaagaaaaaaagtaaaggataacgtcagaaaacttggaaaatgggtacagtggcctggtggaaaattccagagacctcaatggagccatcttaagaatggcatattgtcccattgatctatatctcttgttttggtaccagtaccatgctgttttggttactgtagccttgtagtatagtttgaagtcaggtagtgtgatgcctccagctttgttcttttggctcaggattgacttggcgatgtgggctcttttttggttccatatgaactttaaagtagttttttccaattctgtgaagaaagtcattggtagcttgatggggatggcattgaatctgtaaattaccttgggcagtatggccattttcacgatattgattcttcctactcatgagaatggaatgttctcccatttgtttgtatcctcttttatttcactgagcagtggttcgtagttctccttgaagaggaccttcacatcccttgtaagttggattcctaggtattttattctctttgaagcaattgtgaatgggagttcactcatgatttggctctctgtttgtctgttgttggtgtataagaatgctcgtgatttttgtacattgattttgtatcctgagactttgctgaagttgcttatcagcttaaggagattttgggctgagataatggggttttctagatatacaatcatgtcgtctgcaaacagggacaatttgacttcctcttctcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagcgcttatgattttgagatacgtcccatcaatacctaatttattgagagtttttagcatgaagagttgttgaattttgtcaaaggccttttctgcatctattgagataatcatgtggtttttgtctttggttctgtttatgtgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtctaaaattctcttttttggttgtgtctctgcccggctttggtatcaggatgatgctggcctcataaaatgagttagagaggattccctctttttctattgattggaatagtttcagaaggaatggtaccagttcctccttgtacctctggtagaatttggctgtgaatccatctggtcctggactctttttcgttggtaagctattgattattgccacaatttcagctcctgttattggtctattcagagattcaacttcttcctggtttagttttgggagagtgtatgtgtcgaggaatttatccatttcttctagattttctggtttatttgcatagaggtgtttgtagtattctctgatggtagtttgtatttctgtgggatcggtggtgatatcccctttgtcattttttattgcatctatttgattcttctctctttttttctttattagtcttgctagcagtctatcaattttgttgatcctttcaaaaaaccagctcctggatttgttaattttttgaagggttttttgtgtctctatttccttcagttctgctctgattttcgttatttcttgccttctgctagcttttgaatgtgtttgctcttgcttttctagttcttttaattgtgatgttagggtgtcaattttggatctttcctgctttctcttgtgggcatttagtgctacaaatttccctctacacactgctttgaatgtgtcccagagattctggtatgttgcgtctttgttctcgttggtttcaaagaacatctttatttctgccttcatttcgttatgtacccagtagtcattcaggagcaggttgttcagtttccatgtagttgagcggttttgagtgagattcttaatccagagttctagtttgattgcactgtggtctgagagatagtttgttataatttcttttacatttgctgaggagagctttacttccaactatgtggtcaattttggaatagatgtggtgtggtgctgaaaaaaatgtatattctgttgatttggggtggagagttgatttggggtggagagttctgtagatgtctattaggtccgcttggtgcagagctgagttccattcctgagtatccttgttgactttctgtctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttgttgaattgatccctttaccattaagtaatggccttctttgtctcttttgatctttgttggtttaaagtctgttttatgagagactaggattgcaacccctgcctttttttgttttccatttgcttggtagatcttcctccatcctttcattttgagcctatgtggtgtctctgcccgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcgtagtcttgatggtctttacattttggcatgattttgcagtggctggtaccggttgttcctttccatgtttagcgcttccttcaggagctcttttagggcaggtctggtggtgacaaaatctctcagcagttgcctgtctgtgaagtattttatttctccttcacttatgaagcttagtttggctggatatcaaattctgggttgaaaattcttttaagaatgttgaatattggccaccactctcttctggcttgtagagtttctgccgagagatctgctgttagtctgatgggcttccctttgaggataacccgacctttctctctggctgcccctgacattttttccttcatttcaaccttggtgaatctgacaattatgtgtcttggtgttgctcttctcgaggagtatctttgtggcgttctctgtatttcctgaatctgaatgttggcctgccttgctagattggggaagttctcctggatagatcaatggaacagaacagagccctcagaaataatgccgcatatctacaactatctgatctttgacaaacctgagaaaaacaagaaatggggaaaggattccctatttaataaatggtgctgggaaaactggctagccatatgtagaaagctgaaactggatcccttccttacactttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgaccaatgggatctaattaaactaaagagcttctgcacagcaaaagaaactaccatcagagtgaacaggcaactacaaaatgggagaaaattttcgcaacctactcatctgacaaagggctaatatccagaatctacaatgaactcaaacaaatttacaagaaaaaaacaaacagccccatcaaaaagtgggcaaaggacatgaacagacacttctcaaaagaagacatttatgcagccaaaaaacacatgaaaaaatgctcaccatcactggccatcagagaaatgcaaatcaaaaccacgatgagataccatttcacaccagttagaatggcgatcattaaaaagtcaggaaacaaccggtgctggagaggatgtggagaaacaggaacacttttacactgttggtgggactgtaaactagttcaaccattgtggaagtcagtgtggcgattcctcagggatctagaactagaaataccatttgacccagcaatcccattactgggtatatacccaaaggactataaatcatgctgctataaagacacatgcacacgtatgtttattgcagcattattcacgatagcaaagacttggaaccaacccaaatgtccaacaatgatagactggattaagaaaatgtggcacatatacaccatggaatactacacagccataaaaaatgatgagttcgcgtcctttgtagggacatggatgaaattggaaatcatcattctcagtaaactatcgcaagaacaaaaaaccaaacaccgcatattctcactcacaggtgggaattgaacaatgagaacacaaggacacaggaaggggaacatcacactctggggactgttgtggggtgggaggaggggggagggatagcactgggagatatacctaatgccctaatgctagctgacgagtttgtgggtgcagcgcaccagcatggcacatgtatacatatgtaactaacctgcacattgtgcacatgtaccctaaaacttaaagtataataataaataaataaataaagaatggcacattgtcaacaccgcatgggctggagggcaacactgtgtgggaggcaaaggcactcctgcctcagcgaaataggggtgtggatcaatttcctggtttgatgatgcactctagtgccccccctggaggaagctgggagatgggaaggggtctggatcaatttcctggtttaatgatgcactctagtgtcccccctggaggaagctgggagatgggaaggggtctggatcaatttcctcgtttgatgatgcactctagtgccccgccctggaggaagctgggagatgggaaggggtctggatcaatttcctgatttgatgatgcactctagtgtccccctggaggaagctgggagatgggaaggggtctggatcaatttcctggtttgatgatgcactctagtgtcccccctggaggaagctgggagatgggaaggggtctggatcaatttcctggtttgatgatgcactctagtgccctgccctcgaggaagctgggagatgggaaggggtctggatcaatttcctgatttgatgatgcactctagtgtccccctggaggaagctgggagatgggaaggggtctggatcaatttcctggtttgatgatgcactctagtgccccaccctggaggaagctgggagatgggaaggggtctggatcaatttcctggtttgatgatgcactctagtgtccccctggaggaagctgggagatgggaaggggtctggatcaatttcctcgtttgatgatgcactctagtgtccccctggaggaagctgggagatgggaaggggtctggaccaatttcctcgtttgatgatgcactctagtgtccccctggaggaagctgggagatgggaaggggtctggatcaatttcctcgtttgatgatgcactctagtgccctgccctggaggaagctgggagatgggaaggggtctggatcaatttcctgatttgatgatgcactctagtgtccccctggaggaagctgggagatgggaaggggtctggatcaatttcctggtttgatgatgcactctagtgtcccccctggaggaagctgggagatgggaaggggtctggatcaatttcctggtttgatgatgcactctagtgccctgccctcgaggaagctgggagatgggaaggggtctggatcaatttcctgatttgatgatgcactctagtgcccccccggaggaagctgggagatgggaaggggtctggatcaatttcctggtttgatgatgcactctagtgtcccccctggaggaagctgggagatgggaaggggtctggatcaatttcctggtttgatgatgcactctagtgccccccctggaggaagctgggagatgggaaggggtctggatcaatttcctggtttgatgatgcactctagtgtccccctggaggaagctgggagatgggaaggggtctggatcaatttcctgatttgatgatgcactctagtgtccccctggaggaagctgggagatgggaaggggtctggatcaatttcctcgtttgatgatgcactctagtgtccccctggaggaagctgggagatgggaaggggtctggatcaatttcctcgtttgatgatgcactctagtgtccccctggaggaagctgggagatgggaaggggtctggatcaatttcctggtttgatgatggactctactatgttagctgtcccctggaggacgctgggagatcagtacactgtacctcgctgtactaggtttataatttatgagcccataattatttcaaaatataaagttttttaaaaagtggttcagaagatgtggacctgcatgtgaagaagttttagaaatatctttatttattttgcctatagtttcctttttatgtatgcacaaaagtgatatatgatttgaaagaaactatgttggagtaagtgtgaagagctcatctcttaggtataaaatacagattccaagtgagtaaagaaaatggctacataattccaacgaactcatcttgttcagtctgccacaggccctgcccttgatgacgtcccacaggtcctgcccttgatgaggccccacaggacactcagaaagctgcatgaccaggcagtgccagggttccacctctatctgcagatgacgctgccctgccctgccctccccaccaacagcactcttctgcagtgaggagggacccttgaccctgccaccacagcacccgggtcctcttgcagcacttctagtgagctgaagcaagagaggaataatgggagagactgcctgaagtttccttttttcttacttttttcctgcagggctgcctcctgcctatggctacgttatgaacgtgctcagtttagatagtaggtgctggaattttggctaactggcatttccctttgcaccaagcaactgcccaaagggttgattctcagcttaaacactacactaagtcatttagcagtaatgtttgggccgggttctgagtgtgtgaattctgtccaaaagctgaagatgtttaagctatttcctcctggagtttggtggaataataaaaggttactgttgtcacagtgaggaggtctgcagctggtcccacttcctttcattactacccaatgtaaacagattaaatcgaaccgctcggatcaccagaagggacattccttatttctgctcctttctgttatgctttcagtgtccctcaggctcctttcagatgtcagtttttatcattgggaatatcttggcaactgattgctcaggccctcttgtaaacgaaataccttctttcaggttccctctctcttctcagcagcgaggcgtaaactgcagtagtgagcagggtgtgacccttaccttgagggccacatggctactgactgcagccatgaaatgggttaggtcacccacagagccggcagagaccttccctccaaccacctctggctgatttcaccactaacacctggtggggtccctcccccaccccaagaggtctgcttttgttgtgcaccccactctgggaagagggagatcctggggcgcccacctaatcagccaccagcaaggccagggctggtgacgcagcaggaggtaagggatggcgtgggtggaggcattagtcactggcatgtaagtgttattactaatcagtaatagcccatgaaatggtgggtggatcagctagattagggggtttagttgtttcttttgagatggagtctcactctgtcacccaggctatagtgcaatggcgtgatctcggctcactgtaacctccgcctcccaagttcacacgattctcctgcctcagcctcctgagtagctgggattacaggcatgcaccaccacgcccggctaattttgtatttttagtatggtttcaccatgttgtttagtatggtttcaacatagtttcaccatgttggtcaggctggttttgaactcctgacctcaggtgatcggcctgcctcagcctcccaaagtgctgggattacaggcatgagccaccattcccggccattttttttttaaattacataaaacctctggttcaaaaaaaaatttcatctgaaagcccacaatacaaaatgacttgcagctctccctctccctctccctctccccacggtctccctctccctctctttccacggtctccctctcatgctgagccgaagctggactgtactgctgccatctcggctcactgcaacctccctgcctgattctcctgactcagcctgccgagtgcctgcgattgcaggctcgcgccgccacacctgactggttttggtggagacggggtttcgctgggttggccaggccggtctccagcccctaaccgcaagtgatccgccagcctcggcctcccgaggtgccgggattgcagacggagtctcgttcactcagtgctcaatggtgcccaggctggagtgcaggggcgtgatctcagctcgctacaacctccacctcccagccgcctgccttggcctcccaaagtgccgagattgcagcctctgcccggccaccaccccgtctgggaagtgagaagcgtctctgcctggccgcccatcatctgggatgtgaggagcccctctgcctggctgcccagtctggaaagtgaggagcgtctccgcccggccgccatcccacctaggaagtgaggagcacctcttcccggccgccatcacatctaggaagtgaggagcgtctctgcccggctgcccattgtctgagatgtggggagcgcctctgccctgccgccccgtctgggatgtgaggagcacctctgcccggccgcgacccggtctgggaggtgaggagcatttctgcccggccgccccgtctgagaagtgaggagaccctctgcccggcaaccgccccgtctgagaagtgaggagcccctccgcccggcagccgccccgtctgagaagtgaggagcctctctgcccggcagccaccccgtctgggaagtgaggagcgtctccgcccggcagccaccccgtccgggagggaggtgggggggtcagccccatgcccggccagccgccccgtccgggaggtgaggggcgcctctgcccagccgcccctactgggaagtgaggagcccctctgccaggccagccgccccgtccgggagggaggtgggggggggggtcagcccccaacccggccagccgccccatccgggaggtgaggggcgcctctgcccagccacccctactgggaagtgaggagcccctctgccaggccagccgccccgtccgggagggaggtgggggggtcagccccccgcccggccagccgccccgcccgggaggtgaggggcgcctctgcccggccgcccctactgggaagtgaggagcccctctgcccggccaccaccctgtctgggaggtgtacccaacagctcattgagaacgggccatgatgacaatggcggctttgtggaatagaaagtggggaaaggtggggaaaagattgagaaatcggatggttgccgtgtctgtgtagagagaagtagacatgggagacttttcattttgttctgtactaagaaaacttcttctgccttgggatcctgttgatctgtgaccttacccccaaccctgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggcctcagggtcctctgcctaggaaaaccagagacctttgttcacttgtttatctgctgaccttccctccactattgtcctatgaccctgccaaatccccctctgtgagaaacacccaagaattatcaataaaaaataaataaattaaaaaaaaaaacaaaaacaaaatgacttgcgataaaactgctctgatcgcagggatctaggtctctggcctcctcctaacttccacagtgacatctgatggggcaccaaggaatacagtttgaaaaccattagctctcactaaagacaagctagggaagtctaaagagagaataacctactgaaggtcacatggtcagtcggttaatggccgacaagagtccagcattttcccagcacctgactctgctttaccccatgtactggtcagatgtcagtgttctgtgttcttagaatgagcaggtcttggtccttacaacagtaacttcaagctttcataggaggaaaaagttccaagaaaaaggaaaattacattttacctggcaaaactgattttgtaggtaatggggcctatcttaatccaatttaataacatccagagatgactagcgaaaagaataacttttcctggcaacactgcaagcatctgagtgtttaactgcacaatttcggacatgaccatggcagctactagcattcgtgagacatcagggctctgcaaatggctctcctgcgcaaagcatgctcacagggcagaggtggccctgtgtgggtggaggacatgccagaagcatgggctctacacccagagccttctttccaccctagtccctgctcccaaaatgcaattgagaactgcatttaattagttacaagaaactgtttgttttcttccatgccagtcaatactatgacggctttaaatcaactgcatctaatcctataaatacatctccgggatggagcctcctcaagatgtcccatcagttttgttcatttacttctattcctgagattcagttctatgtcctctactcttcaatgagacatgagtccatcaacaaaatagcactgggaaaggaattctagtttctgacattgagacctggcttccagtttaagctcctccacttccaagctgtgcaaccctgggccaaccacttaacctctctgagctgcagtttcatcacctataaagcaagaggcaggaattgtgacgataacataaagcatgtaaaagaatttaaaagtgcaaaggactataaaagtgtgagtatccattctattacaatcatttaatcaagggaccagacacatttgattgcatcatttcagaactgctcctggaagctctgctctcttggctcctgcccttgtggtgctgggaaagaatgaatgcagggctagctgcaaagtacatggttacaggtttctcagagctggtcctcccagccagcctcccttttggtggtgtctggagcaaaacaataccgtaaaataatcctccagcagccaagtgtagacaattaaaaacagggatcactaatctagaagggaaacgttctgatttattgctctaacctcccttgtcataacatggcagttaaccaaaaacaccattctgtaggatgaagggagaggaaatttagacttggacagaaaaatccaaaggaaattaaagtgttagtgtgctctgaaaagtaactcttcaaatatgccactggccaccttgacatttccaggcctccccaatggcttccagacctaaagtgatcagcttacactgcatggaggcctctcctagccgagggtgctgctggcttcccggggattgttcagcctctctcatcatcactgtaccagatgacagtcaaaccaaaaactcagctgacaagctcaggagatgctgaatgaggcagagcagaactctcctggccccaccacagtggctaatgaagcttgtgtgtgtcctggaggcggggctcttcaggagcagagatgtgggcagggaagtctgccctttcatggagttttctacatgcactttcagataaaggccttctgtaaagaccacaacagctgtcatctctgaacgtggccaagagccaaaggatcgtatctggagcaagcagaccgattttcagaaacgcacattgggtaggttacccgtggtgacgcaaaccagacttacttgatctaaatctcctttctccgttgccagttcctccatctctggtgttggctcatcttccaggaagggattggtagatgggggtggagactcaagctttttctgttaggtagatatgagaaagagaagtgttttctgagcatattcaatagctttccccattgatctgctttttctaggtgtctccaacaaggaagtcatgcacgctatctgataaagaagaactgaggcaacccagaccacattcttgcctccgggccttcacagtgctttccctcttcctgcaacctccccgaccaccccgccccaactcgaatctggctaaaacgctcacgcatcctcagtcctcaaaccggaactccgttctgctgggaagcctttcccatctgtcaggtttgggtcagatgtccctgacacgtgttcccaaaccaagctacatgtctcctacccaggcatttattaaaatatagcaattgcccattatttgtcttttcccttctggcctccatgatggcagagattgtgtctgtcttgttccccatcctatctcagtgcctagcatgtagcaggtcctcagtaaatagaaatgaatcaaagtgccagatggatttcaacgcaagaacaaactacaaaactaatctcatgtgttctagattaacagatgtctcttcccaagtaagccccattacaacaaccacaacagaaatctccttgagaaaatcgacttctcagcttccaaatatgaccactatttcaaaatacatcacggagtggaaacatgggccagtgggaaggctgcaggcaggaggcatggtagctgtagctccaaccgtgcggcactggccctatcacccagcttctctgagcctcagtaacttcatctgctgaatgaggatgtagtcacaggactatctggaggatcaaatgtgaaaccctagaagcagcacatgatacacacaagggtcactgatgacgttaattccagtacaactacagaatcaaggcagctctctggaattcctttacagttttcacctagagatgttgtttatgcctgggagctgaaggctttagcagaaaggaggccaactggacaaacagaaaagagggactgcttggtgctggggacgagggaagggggcaaggcatggctctctggagacgagaagttaatggagagggagtttctaaatgtacttggtattttagccaataccagtgggtcaatctgaattaatctctaagccaaaagggacagcagatggactatagcgtgaataactttgccaagtgccaggacaccatctgaagctattacaaacaaaaataaaaccaaaacttacacaaaggccgggtgcagtggctcacacctggaatcccagcactttgggaggctgaggcggcggatcacttgaggtcaggagttcaagaccagcctgaacaacatggtgaaagcctgtctctactaaaaataccaaaattagcagcgtggtggtaggcgcctgtaatcccagctacttgggaggctgaggcacaagaattgcttgaatccaggaagtggaggttgcagtgagccaagatggcaccactgcactccagcctgggtgacaaagcgagactccgtctcaaaaataaaatacaataaaataaatacattgcacaaaagcactacacctgcgtctggtttttggtttaagacaatactgctaacagtcatttaataactgcttattttttggccaaaacacttggatgcaagtgatgtggacagatacagcctcggtgcatgacaaagccttgtggtgatggcattagctcgaggtaatcagtagtaagatgatggtttttgtggtatcctggtgataaacaatatggtctaacacccaagcaagtatttcacatttgcacactccaaactttggcttctttacctaacatgagagaaaaaaaatccttaaaaatgtacagctcttgttagaaagcagtatttctaagcttgagttgtcttcttaagggctgctgatattttagagagagaggaatagtaataaagggaatctaccaagcttaatcttcaacaaccataaaaaaattaaattaggtaatagcattagactcctgattccactggcttaacagtgggctctgggattatgctgttgagctgagtcactatgattctaagtcttttggtcctttgtagatatgaaaagcaagtcagctaactgaagttaaaagctttgatcaaaatcattcagtgacagacacagaatttgagtttttgaactaaatgcccctcatctattgctaagtctattgggttgataacagcacctcacaattacataaagatgggcctcgtttttaaaacataatgtgttattggaaatcatggcaaacagcagatgtcagtgacgtggactgagaacgttcccgggctctgctctcgctggcataaagcatcaagaaaacgcagagggtaggaagaagtcaaacctactctcactggcgtaaagcatcaagaaaacgcagagggtaggaagaagtcgagcctactctcgctggcgtaaagcatcaagaaaacgcagagggtaggaagaagttgaacctactctcgccggtgtaaagcatcaagaaaacggagaggggaggaagaagtcgaacctaacgggcagccctgaagaagcaggcaccatctgaggcaggtgagcacaggccactcgctcagtgtcaccatctgggatagagtgagcatgggccaacctcagcctcctgagtagctgggactacaggtgcacatcaccacacccaagtaatttttgtattttttgtagagatgggattttgccatgttgcctgggctggtctgaaactcctgacctgaagcaatccatctgtctcagcctcccaaagtgctagaattacaggcgtgagccaccatgcccgtcctctattaacatgaggggagttgtggacatcaaggagctcctagctcactcatttgtggcacatgcattccacatgtggaccaagttagtacaggaaaagtgattcattccttccctcatccactcaacaaagggatatgcttggccctaggagtagagcagtgagaaagacaggccagcctccgccctcatggagattagagtctgctgggggagacagccttcaatccaacagtcacacaaacagtgagaagggccaggaaggaaaagcagtcgtcatggaaacgtgcaacagagggccgcagccgtccctaaagaaaagatgtctgagccagagctgaaggatgcctcagagtgaaatatatgaggggtggagggcggagggaacagcacgtgtctgccgctcactcaacaatgatgtactgggcatccactctgctccaggcactcttgggtgcaccagggatgcaagtgaggaagatggattagagaggcggcactgtagtggtgagaagaaaactcagggagtgggatgagctggggatgagggtgggaaagtgcttctacacacagggtcatcagaaaaggtctctgaggagatgacggctgagctgagtaagaaggaactgctcaggcaaaacccaaggaagggtgttctcagcagggagacccggtggagacgctggaaagcatatggtgagtctgagggacagaaaggaagatgggggcctggggtaagaggggtggcgggagtcccatcatattggtgaatcagggatggaaaggaagatgggggcctggggtaagaggggtggcgggagtcccatcatattggtgagtcagggacggaaacaaagatgggggcctggggtaagaggggtggcgagagtcccatcatattggtgagtcagggacagaaaggaagatgggggcctggggtaagaggggtggcgggagtcccatcatattggtgagtcagggacggaaacgaagatgggggcctggggtaagaggggtggcaagagtcgcatcatattggtgagtcagggacagaaaggaagatgggggcctggggtaagaggggtggcgggagccccatcacgcagccttttgtgggccatggtaagggtcggttttcttctcactgcaattgggcagtcgctggtagttttcaacagcgaagtgatgtgatctaatttggattttaaaaatattccactgctgtaggggaatggattataatgacagcaggcaaaccagtttaagaggctgctacagtgctccaggaaagggctgatgggaaccggactaagccagtgttccaggaaagggctgatggggaactggactaagctggtgatggacgatagaaaaaagtgtccatcggatttggggcacagttaggaggcagagccaggaggctttgctgagagagtgagaacgagggtgagggaatgaaaggagtgaagggacagtcactttctggtctgagcaactgcacggctgatgttgcccttaactgagatggggcaccctcgtgtagtggcaagggcacaggctccgtatctgacagacccgggttcgagtccaggttccaccatggggtatgctgtttaacttctagcctcagttctcctacctgcaatgtgaagggataggaatacctacctcgtatggctgccatgaggatgggatgaggcatgcgtgtcaggcgtgagctacacagttacgtgctgccatgaggatgggatgatgcgtgcgtgtcaggcgtgagctacacagtcatgcaccacatcaccatgtttccatccatgacgggccacggtacaaggcggttccactagattataatggagccatacaatagagtaggccaggggtccccaacccctgggccacagtccatggcctgttagcaaccaggctgcatatcacgaggtgagcagcagtgagtgagcatgactgcctgggctccgcctcctgtcaggtctcataggcaaaccctgttgtgagctgctcatatgagaggtctaggttgcacactccttctgagaatccaatgcctgatgatctgaggtagaacagtttcatctcgaaaccatcccctacccccatcccctgcactcccacccccacccccacctctggaaaaactgtcttccacaaaaccagtccctggtgccaaaaaggttggggacagctggagtaggttctagcaggcacactctatgaggtttgcacagtgatgaaactaatgatgcatttctcagaacatattcctgctgttaagcaatgcatgactgaatatatacagcagcttaacatgctgtctggcacagagggcaaggctcagcaaggggaagctttgagcagtaattaatagggtgagctacgaaacaaggcaaaactgttgtgcttctcttaataaagcagctcacagaaaacgtgggcatgcaggcttaaaagtcttgtcaaaagaatttctattaaccataagtggagcctcgtcccaactactttgtctctttgggatctctctaagaaataaaagcaaagggcccatcaactttgcactttctaagtggaaaggcacacggagctgctcctttcttccccagtctacaacaacgcacataccaccctcctccctgttgataaaagtcctaaaaccctaaggtgtggatatgcattcccgctagttagagggctacattactgctcagactgacttgctaagatgaaagaacaagtccttgtggggagcgatcactggcataacgcagccttctgtgctaagagccacacagatcacgcttctcaggcttgctttgcagctgtcacaggccacagagaattacaactttggggttagattgtcagtaactcaaaggacatatttcatgaactctgaggctgctaaataaagccaaaaatttccaagaagtgaatgacttccaattttgaaagaattcattctttttgctatgatgacagttgatttcaagccgatataggaaagcaaaattcttcatatagcaagttaatccctactgattaaatcacaggggattcccagcaccttcaaaacagttcagaccacaggacagtcaggctgtctaattcactgtcaagaagggaaagtctggcttcagtcagcagtacatccgtatctcgtctgcctacacaaatccctgtgtgaggccctagctggacacatcgaattatcaaagaaggaactctgaaatttaagactcttcctttccctagaggggaaagctttcgcttgtgagatgaaagttcctcagtttctgcatttctcactccataaatgctttactccagcccaattcctaattggtccttaaagagatggctgcggggctttagctgacagtcaggactgcaagcccaggggttcacacacttggtgtccaccatttctggggctactctcttgctaccgccatgtccacttcttctattgcaacagttatgtacagacttctttctcctactagaccctaagtgccttcccgatccaatttctcatcttttccaaagccctgaacaaagagggaagcttgaaaaatataagtgggtaaatgctgatcagatgaaaggccctcaataaaatcctcttcagaaacatgggcaacactttctattttctgtaaacaaaacaaaaagcctgcgtatatgtgtgcaagcgtgcttgcagaagcgtcaaaaatataccccaaagaattaaacagtgtggatacctccagggggagggatatacagtagttaagaagagatgtttatttaaaatttttttttctatttgagtttttaataggcatatatagctatttctgcttttttcttttcttttcttttctttttttttttgaaacagagcctcactcttccacccaggatgaagtgcagtggtgcaatcacagctcactgcagtcttgaactcctggacttaggtgacccttgcacctcagcctcctgagtagctaagaatgcaagtgcacactaccacgccctgctcattttaaaatttttttttagagacagggtcttcgtggcccaggctggtctcaaactcctggctgtaagagacctgcccacctcggcctcccaaagcgctgggattttaggcatgagccattatgcccggcccactgctcatttttttttttgacagaatatttatctgaagagtaaagatgatttataactaaactcatacactatcttctaaagcctttaattctaaattgtgatgtaattcatgtcacataaaactcaacattttaaagtgatttactattcagtggttttcggacattcacaaggttgtgcagccatcaccaccaattccagaacatttttcacccccaaaagcaacccctacctgttactgggaagctgttacttcccagtcttccccttcccaaccccatcggcctctatggatttgcctcttttgggtatttcctatagatggaatcatataatgtgtgacatctgtgtctggcttctttcactcggcatggtgtgtccaaggttcacccaggtcagggcacgtatcagcacttcattccttttacgtgaataatattccactgtacggacagaccacgttttggttattccttgtctactgatgtttctactttttggctattgtgaatagtgttgctatgaacatttgtgtaagacatacgaacatatgtttttaattcccttgggcatatacttagaagtagaaatgtgtaattaaaaaaaaagaattcagattgctttgctttttctatttggcagagttaccccttcacattaggcatggcacattaacactgtgagatgcactgaaacaagcagggactacttttaaatcttaactgcatttggaagaacagaaaggaagaggaacagaaagatgtttaaagcagaggctgaaattgaaagtgctcacaacttgagccgataattccactagtgtcgtaagaaaatcatctcactgctttgggtaagagacagcgaagaggagagaagagagaagagaagagaggaaaaaaacaatctcaaatgcatataaaattagtagacaaggccgggtgcggtggctcacgcctgtaatcccagcactttgggaggccgaggtgggcggatcacgaggtcaggagatcgagaccctcctggctaacatggtgaaaccgtctctactaaaaatataaaaaaaaaaattagccaggcgtggtggcgggcgcctgtagtcccagctacgcggaggctgaggcaggagaatggcgtgaacccaggaggcagagcttgcagtgagccgagatcgcgccactgcactcgagcctgggcgacagagtgagactccgtcacacacacacacacacacacacacacacacacacacacacacacacacacaaattagtagacaaaaatattcatatagccctatttataaaagtgagaaaaaactaagggtcctacgagaaaagaataattaggggaatcactgagtatctatagaataaaatctttctgtagtagttgagaaacaacttaagctgtgacatatgaagcatattttcatatgtgtgtgtgagttaatatggaaattaactcaaaatggatcaaagatataaatgtagcagctgaaactataaaactcttaggaggaaacctaggtaagtctctgtagccttggattacgtaacagtttcttggatatgacactaaacacaagcaagaacaaaaaaccttcattaaaacggaaatcctgtgaaatgactatcaagagagtgaaaacccacagatgggagaaaacattggcaaatcatatgtctgatacatgataaaatatctaaagaagttataaagcctgggcatggtggctcacgcctataatcccagcactatgagaggtcgaggcgggtggatcacttgaggccaggagttcaagaccagcctggccaacacggcaaaaccccgcctctactaaaaaaaaaaaaaaaaaatacaaaaaatacaaaaattagcctggcatggtgctgcgctcctgtggtcccagctacccaggagactgaggtccgagaattgcttgaacccaggaggcagaggttgcagtgagccgagatctcaccactgaactccagcctgggcaacagagtgagactctgtctcaagaaaaaaaaaaaaaagttatagaatatatctagaatgtgtaaacaactcttacaactcaacaataaaaacaatccaactaaaaaatgggcaaaaaatgtgaatagacatttccttttttttgagacatgagtggcgcaatctcagctcactgaaacctccacctcctgggttcaagcgattctcctgcctcagcctcccgagtagctgggattataggcacccgccaccacgcctggctaagttttgtatttttagtacagacggggtttcaccatgttggccaggctggtcttgaactcctgacctgaggtgatgctcccacctcggcctcccacagtgctgggattacaggcgtgagccaccacacccagctgaatagacatttctttaaagaagctgtgcaatgtcactagtcaatgggaaaaagcaaatgaaaaccacaaggagatactactctacacccatgagaatggctataattaggggaacaaaggagacacgcgtcagcaaggatatggggaaactggaccctcctacattgtgggtagaaatgtaaaaccgtgtggctgcttcgaaaacagtttgcagttcctcaaaaagttaagcctagggttaccatgtgacccagcaattccactcaggtatattctcacaagaataggaaacacgctgacacgaaaacctgtacaaatattcacagcagtattcatacagtgaaaacctgtaccgatattcacagcagtattcacatagtgagttcacacagtgaaaacctgtacaaatattcacatagtgagttcacatagtgaaaacctgtacaaatattcacatagtgagttcacacagtgaaaacctgcacagatattcacagcagtattcaaatagtgaattcacacagtgaaaacctgtacaaatattcacatagtgagttcatacagtgaaaacctgtactgatattcacagcagtattcacatagtgagttcacacagtgaaaacctgtacagatattcacatagttcacacagtgaaaacctgtacagatattcacagcagtattcaaatagtgaattcacacagtgaaaacctgtacaaatattcacagtgagttcacacagtgaaaacctgtaaaaatattcacatagtgagttcacacagtgaaaacctgtacagatactcacagcagtattcaaatagtgaattcacacagtgaaaacctgtacaaatattcatagtgagttcacacagtgaaaacctgtacagatattcacagcagtattcaaatagtgaattcacacagtgaaaacctgtacaaatattcacatagtgagttcacacagtgaaaacctgtacagatattcacagcagtattcaaatagtgaattcacacagtgaaaacctgtacaaatattcacatagtgagttcacacagtgaaaacctgtacagatattcacagcagtattcaaatagtgaattcacacagtgaaaacctgtacaaatattcacatagttcacacagcgaaaacctgtacagatattcacagcagtattcaaatagtgaattcacacagtgaaaacctgtacaaatattcacatagtgagttcacacagtgaaaacctgtacagatactcacagcagtaatcaaatagtgaattcacacagtgaaaacctgtacaaatattcatatagtgagttcacacagcgaaaacctgtacagatattcacagcagtattcaaatagtgaattcacacagtgaaaacctgtacaaatattcacatagttcacacagcgaaaacctgtacagatattcacagcagtattcaaatagtgaattcacacagtgaaaacctgtacaaatattcacatagtgagttcacacagtgaaaacctgtacagatactcacagcagtattcaaatagtgaattcacacagtgaaaacctgtacaaatattcacatagttcacacagtgaaaacctgcacagatattcacagcagtattcaaatagtgaattcacacagtgaaaacctgtacaaatattcacatagtgagttcacacagtgaaaacctgtacagatattcacagcagtattcaaatagtgaattcacacagtgaaaacctgtacaaatattcacatagtgagttcacacagtgaaaacctgtacagatattcacagcagtattcacacagtgaaaacctgtacagatattcacagcagtattcaaatagtgaattcacacagtgaaaacctgtacaaatattcacatagtgagttcacacagtgaaaacctgcacagatattcacagcagtattcacacagtgaaaacctgtacagatattcacagcagtattcaaatagtgaattcacacagtgaaaacctgtacaaatattcacatagtgagttcacacagtgaaaacctgcacagatattcacagcagtaatcaaatagtgaattcacacagtgaaaacctgcacagatattcacagcagtattcaaatagtgaattcacacagtgaaaacctgtacaaatattcacatagtgagttcacacagtgaaaacctgtacaaatattcacatagtgagttcacacagtgaaaacctgtacagatattcacagcagtattcaaatagtgaattcacacagtgaaaacctgtacaaatattcacatagtgagttcacacagtgaaaacctgtacagatattcacagcagtattcaaatagtgaattcacacagtgaaaacctgtacaaatattcacatagtgagttcacacagtgaaaacctgtacagatattcatagcagtattcaaatagtgaattcacacagtgaaaacctgtacaaatattcacagtgagttcacacagtgaaaacctgtacagatactcacagcagtattcacacagtgaaaaagtggaaaccacccgaatgtccacagctgatggaagagacaacaatatgtgcatcacccacacaacggtgcactattcagccatcaaaatgatgcactgacacacacctcatcatgggtaaggctcgcagacactgtccagagggagggaaggcagacacaaaaaccacacatcgtagcatccgtttatgtgaagtgtccacaacaggcatccgtaaagacaaaagtcaattcgtaactgcccaggactggggaaagagaacttgaaagtcctgcctgctaaggagggatttcttctggggtaacagaaatgtcctggagttgcacagctgggatcgtggcatcatcttatgaatatatgaaaaccaactgaactgtatactttaaacgataaatttcatgtgacatttcgtgacatgagttatatctcaattttaaaaactaggcagagaaaactgtatttaaaaaaatacaatttcaaccatgtaaaatatatagaaagaatatacccaaatcctcatctctgatttggatgacttttttcctgcttctctattctcgccataatttccaaattttctatcctgaccctgtattattctcttctcagaaacagaagttaatcgtcccttgcaatattattcaaatggaagaatacatttctttagcaccagtaaagcatccataaaatattttccaacgctgaagggagtgcatgaggcgggggaatctgtcactgtcggagacagatgtcctcaagctgtggcagagctggaaaacctgcccctgttccttacacagtctccctcatgcaggtgccggaagaccagggtgtagagtgagacatgctgggtggtctttcatgagtcgtgagccttttgcaaacgctcttacactcaaattccatggctgacaattgtacccatatagcttctatctttagaatgtaattctaaaaactggggaagtaaaggcccctataagccaaaggacaagtctgtttcaaaaggcaacttatgcagtggtcaagaggaagggaaatccagctgcataaaaggggaacatttttaattttattactacaaaaaaaacaaaaaacaaaacaaaaacctcccagtgaggcagttataaaaagctaatccgatctagtctgcttttctgctttcagcagaaggctgaatgtcatttgctcaccttgaatctaatcatcaagtcactaataatgcatatggatccagttacatcacatccagacattctcttttaatttcaaggcattttaatttatagactctcttgaattcctcctaaagggtcagaagttgaggcaactgggaaaagcacaggcagctcacctcctcaagtaacagttacagcacaggacatcgtgaaactggttaagcaacaagcctgtccctgaggctctttcagtctaaagttctatcaaatgttgaagtcacagctcttgaaaaagagccaaggatgatgcatcccactgaagtcaggagtgatgggtcaggaggagctgagctgtggcaggtcttgtcttccgggcgagctggccacactctcaagctcatcctcactgtttcactgccagtcaccaaggactggagaggtttggaatgatacagtgaaggcggcagtgggggtagggtggggatgacgtacagcctagggaggggcagcaagggagagtctctggccgttttggctccttggctgacatcttacctgttttgtggcacctttctgaggaattcagtaactttctataaaatctggcatatatcaaagggtatcaagatataccttggttcgtttcacaatttattctggtattttgaaacaaaatggtagccaaaaaggagtttccaaagagtgtatcctgaaaggaaggtagcatggggaaggggtcaggggccagggagcagcatatctccaggcagggtacccagcagctagactgggggtcaggacagctggaactcctggccttgcccaggcagccccttcccggtgctttgcgttgggagcatggtcggtagccatgatgaattcaccaaggtccctgccactgagggtcgcagaataaaggtgaagaaggtcgtgcacggcccacaatgagatgatggtggggaccaggctcagtgtgaacatcagctagagtgacagccttcacgtctcctcacagcagagctgcagtgaaccgattcctcaaggcccgtcccacctgggtaaagtggccatagggcttctgttgccttcctagaaacttatctttaagggaaaacccttgaaggatatcagacagccattttcaggatttggaatgcagaataactgccaggtcgtgatacctggcacaaagaatagggtaggaggacgaagttgaattaaagaagctgaaggatttagagaagtctgtggagaggagagctgactaaatagagagggaaagaaagaactcatggtgttcatcaggcttttctggctaaggatttagaacctgaaactctgcaaacttgagaggagaggagagcaacaactgaacaatgaagaggggatgatttaaagaccagttctgccaaaacatttcaaatatgaaaaccaaaaaggaaggagctggggaaaaaggctcaagtgttcctagctgacccctgaccaccaccacagagcaccacctcggccaggagacactgggctccaggccaggagcttggccctggccgagtgagttcaggcagaaaggggctgtgctgccctgagaaaccagtacccccagcccagtcctcccgggacagaaggtgtctgacagttggccaactgccattctgacagtcctgtacctgtgttttacaataaagcattgtctttgcaaacttgagtaagctcctgtcagtttttcatggtctctacgtggttaccctgttcagctgcctcagcttgtccagaagggccttccctgccctcgttcccttaccacttttggcctttgggggatttttccttggagaggtcctgggacagacccaggttcacaggctaccctggtcctcagatgcaacagggccatttgttcctctgtggtcctatagctccctaaatgtaaaagacaaatcaccaggaagtagggcccagccagagagggtgaagaatggctcaaaacaagtgcttggcaagaatgtcattcaagcatccttcactgggacctatttcccgtccggttatctggattaccagctcacagagcctgtcctgatgctctccggaccctgcccagccagaggccgtgggagctcagggggctactcccagggtggggcctgtgctcaatgctgaaccctcatgcttgtcgccgggcagatctccgtagggctgaatccagtgccacatatatctacgcttgaaaccaggcaggagcatggcttgggaaggtccgagaggagagccagcaagaggaatcagggggctgctaaagccaacctcatacttctcaggagaaactcaggattccttcagtgggatctctgttcctatttcctttccttttctgtttttttgagacagtctcactttgtcacccagactggagtgcagtggtgcaatctcagttcattgcaacctctgccttctgggctaaagtgatcctcctgtctcagcctctcaggtagctgggactacaggcgtgcgccaccacgccccactaatatttcccgggtagctgggactacaggcgtgcgccatcaggccccgctattatttcccaggtagctgggactacaggcatgcaccaccacgccccactaatatttcccgggtagctgggactacaggcatgcgccatcaggccccgctattatttcccaggtagctgggactacaggcatgcgccaccacgccccactaatatttcccgggtagctgggactacaggcgtgcgccaccacgccccactaatatttcccgggtagctgggactacaggcgtgcgccaccacgccccactaatatttcccgggtagctgggactacaggcgtgcaccaccacgccccactaatgtttcccgggtagctgggactacaggcgtgcgccaccacgccccactaatatttcccgggtagctgggactacaggcgtgcgccaccacgccccactaatatttcccgggtagctgggactacaggcgtgcgccaccacgccccactaatatttcccgggtagctgggactacaggcgtgcgccaccacgccccactaatatttcccgggtagctgggactacaggcgtgcgccaccacgccccactaatgtttcccgggtagctgggactacaggcgtgcgccaccacgccccactaatatttcccgggtagctgggactacaggcgtgcaccaccacgcctgctaatatttcccgggtagctgggactacaggcgtgcgccaccacgccccactaatatttcctgggtagctgggactacaggggtgcaccaccacgccccactaatatttcccgggtagctgggactacaggcgtgcaccaccacgccccactaatatttcccgggtagctgggacgacaggcgtgcgccactacgccccactaatatttcccgggtagctgggactacaggcatgcgccaccacaccccactaatatttcctgggtagctgggactacaggcatgcgccatcaggccccgctattatttcccaggtagctgggactacaggcatgcaccaccatgcccagctaatatttcccgggtagctgggactacaggtgcccacgacacctgctaatatttcttgggtagctgggactacaggcatgcaccaccatgcctgttaatatttcctgggtagctgggactacaggcgtgcaccaccatgccccgctaatatttcccgggtaactgtgactacaggcgcccaccaggcctgctaatatttcctgggtagcagggactacacgtgtgcaccaccacacctgctaatatttcccgggtagctgggactacaggcgcccaccacgcctgctaatattttctgggtagctgggactacaggcgcccaccacgcctgctaatatttcctgggtagctgggactacacgtgtgcaccaccacgcctgctaatatttcccgggtagctgggactacaggcgcacaccaccacgccccgctaatatttcccgggtagctgggactacaggcgtgcaccaccacgcccagctaatatttcccgggtagctgggactacaggtgtgcaccaccacgcctgctaatatttcccaggtagctgggactacaggtgcccacgacgcctgctaatatttcccgggtagctgggactacaggtgcccacgacgcctgctaatatttcctgggtagctaggactacacgtgtgcaccaccacacctgctaatattttccgggtagctgggactacaggcgcgcaccaccacgccccgctaatatttcccgggtagctgggactacaggcgcgcaccaccatgccccgctaatatttcccgggtagctgggactacaggcgtgcaccaccacaccccactaatattttccgggtagctgggactacaggcgtgcaccaccacgcctgcttatatttcccggatagctgggactacaggcgtgcaccaccacaccccgctaatatttcccgggtagctgggactacaggcatgcaccaccacaccccgctaatatttcccgggtagctgggactacaggcgtgcaccaccacaccccgctaatatttcccgggtagctgggactacaggcgtgcaccaccacaccccgctaatatttcccgggtagctgggactacaggcgtgtaccaccacaccccgctaatatttcccgggtagctgggactacaggcgtgcaccaccacgccccgctaatatttcccgggtagctgggactacaggcgtgcaccaccacgccccgctaatatttcccgggtagctgggactacaggcgtgcaccaccacgccccgctaatatttcccgggtagatgggactacaggcgtgcgccaccacgccccgctagtatttcccgggtagctgggactacaggcgtgcgccaccacgccccgctagtatttccttttctgacctgcattttctttaaggctattttcacctgttttgtgacccatttttttcccttgttactaaaaagaaatcaatattgaacattagttagcaagcagagaagtatacatatttttgatgtgctaagtaggaaaagagtgctttgtggtttcagctgcattttattctaataaagtcgtgagtgagcccaagtaggcaggaccttgtggtctggcctcaaaattgggctgctgccaccaccgctctgcagtccattgcctgaaaggccagcccgattcacctgctccaccctgtctaaagaccagcccgattcacccgcttcacctgctctgaggctggtctcatgggacaaagagggaattgcactgaagtctcagggttttaggaccagaagggtaggagctagagaaggtggcagaggtgaaggttgaacaagtgagtgggactccaggtacaagtcccagcctgcccccggcttcaaccacagtagctcagtttcacggtcttacacattagctccgtggcctggagtaagtttcaaatgagcacagcgcctacttcctatggctgatgaagcacagtgactgactgcaggtaaacgcacctaatatagcgtgggtcaccaagtggatgttcaaagcatgacagctatgggtgtttcagattctacattctattttttttttttttttgagatggagtctcactctgtcgcccaggctggagtgcagtggcgcaaccttggcagcacccaccaccacgcctgactaattttttgtatttttagtcgtgatggggttttgtcacggtagccaggctgctctcaaactcctgaccttaagtgatcatcccacctcagcctctcaaagtgctgggattataggcatgagccaccgcacccggcctctacattagattttgttacaagaaaggatttggaaatcactgatttggcccatctctctcattttaaaacaattgaaaaataactttgttaaagtacacacaaagtatgtaaatgcatttgtataagaaaatttccaaaaaaactataccagagtaaatggaaaaaaatatttccttgcttctctacctactctcactccaacttccttcccaagagacatccactgttaccatttccagacctctttcttatacatttacacacataaacatgctttttactttttccataaaagacattatacctcccaaagtgctgggatgacaggcgtgagctgctgcgtccggcccccgttctaccacttttaaactgctgtgtagcatctcacagtatggatgcactgtaatttatttaaccatcttcaataataaacattacagacacagccaagccttttgcttttaaggctgcagttcacctctttctttgtgcatcttcctctacatgtatggatttttttttagacttctggtttagatgtaaaattgttgcttgacaggacatgcatatttacatttctgaaagttctgataatgacaatttatgcaccaaaaaggttgtatcaagctgtatactagccctaaaatcctgtactgttagtcttgtaatttttttctgtttgcaaacctgatgtaggaaaaatatcctgttttcttttttttcatgtttattagccaactgaatttcttcagtcaatcgtctgtctgactctgtactcatttttctaacgggttactcgtattttccttatggatttttaggagttctttacatgtgctagatattaatcgtttgtgtcatgcagcttcaactgttttttaatcccttgattatgtttctggtctctttttccaaaagaacgttgttctctttatgttgttaaaccttttagtacttttcttcatggcttttgggttttatgtcttatttagtctccctaatattctgttattaaaggataggtgggcatggtggctcacacctggaatcccagcactttgggaggccgaggcgggcagatcacctgaggtcaggagtttgagaccagcctggtcaacatggtgaaaccccgtctctactaaaaatacaaaaattagccaggcttagtggtgtgcacctgtaatcccagctacccaggaggctgaggcaggagaattgcttgaacctgggaggcagaggttgcagtgggccgatatcgccccactgcactccagcctgctgacagagcaagactctgtctaaaaaacaaaatgaaaaaacaaaaaaataaaaaaataaaggatagtcttttcttctcatttaacagggaaggcagttcactacattacagcagaatcgggattagaccacaagtcttgactgctggtccaaggattttgctactaaatcactttgcttctctattgttacccgcagtttaaaaaaaaaaaacaaatctagctctaaagaaaattcaaaggtatgattctctcaacttggatttcttcttccctccctcctttcttctttccccttccattcctgcctgcatgggttctgtgtacactctgcacgactcgaggagacggatgagtcagctacaattcctgtattcaaggagctcaatgtctacgcatatgtaatgatgcaaacagaaattaccatagaacagagtcacttggtttcccagtggacaggaaatctgaagagagcaccttgatgtgttagcagggagcctgggcctccaaagagaagaggtttactcctttctctttcttttctttttttttagagatagggtgtcactctgtcactcatcatagctcactgcagcctcaactcctgggctgaagtgatcctcctgcctcagcctcccaagtgattgggactaaggggtgcacccgactaatttttttttttttgtagggatgaggtctcactatgttgcccaggctggtctcgaactcctggtctcaagcaatcctgccttggcctcccaaagtgctgggattatacaggtgtgagccactgcatcagaccaaaaagaagaggtttccggagtgaaaatttggacctggtctttgactacacagagacaaacgtttaaccggcagtactatgttccacctttccaatggaggcacgtagtccccaggcctgtatacctggctttggggtttacagagactcattgacctagtttgttcaccagagatgttaaaaggtaaaccctaaagtaaaaacatatcctaattgtaaccaaatctgataactgataaagaaataaggtatttgtgactgagtaaggcctctgactcacaaaattactagtctgtaaaatgggatcaatacttaagaaaaatgatgacagggcattctagaaacatgatgtactgcgtaagagacaaacaataaatccacacagagtgttctgtatcatcactttcccagcagctcagtgaaatcactgcaatgaggggttaagcaccgaagccaatggatagagtcaccatacagtgaaaccctgaatcccaaccacccaacccactgatttcacgtggcagctccctagggaaggtcttaccagggtcccatcggtcagggtgcagccggagaagcgttttgcaagaaacccctcaaagttagttgttctttgaatagcaaaaagaagcaatttcacttcaatttccttcgctctggtacgcataatcttggcaagttctgcccttcaaaacaaagagataagaatactatcaaacaagctgatcattcattcagtagagataaggtaaatggccttagcttatattcagaaaaaaaaaatgtatgtggtcatttcaaaccctgaggtctgttaccaccttagtctaaaacctggggaatagaaatacatattctaaacaagatttttaaggtgaaattatccaccaggcaaaaaaatcaggggtcatggatgatatatatatacttatatttatttgtttgtttatttatttatttatttatttgagatggagtctccctctgtcgcccaggctggaacctccacctcctgggttcaaatgattcttttttttttttgtatttttagtagagatagtgtttcaccatgttggccaggctggtctcaaactcctgacctcaagagatccgcccacctcggcctcccaaagtgctgggattataggtgtgagccaccagtaatttggttacatagttactacgttgcctgtatctttgaacagtttaataattggataataatacatatggagcacctaattttttattagtgtatatagcctatataatttcacaagtcattaattactgaattataaagccctccctcttcctgagggcccaataatcatctcttcaactagagagcaggagtcctggaaacacacgcaagggacaggatccctgcgggaaaagtggcaagcacgcttagctggtccctgcccgagaagctcctgtgcagctctcactcaaacgttccatctcagaagctcagttgctggtgaacagggacatgtgagttcttagtaaggactaagctaccatcttctcacacaaataaatgacaaaatgaaacaaagagtctctgagtttatttgagaatgatgtatctgtaggattttagccaaaattctaacaatagaagcttggcagcaacactgccattagccgagacaacaatggcaggtactggcgctcacaagaaacgtgctggctctagcatacgtccagcctctcccaggctccatttctcactgagctggtttgcaagtctgctgaactgtaggctaaaaagaattagctaacagtttctcaaggaattcactctttattttgttaattgggatttagaaggtgacaatctcaactcatcttaaaccaatgctaaaaggttctctaaatctacaggagtcaatgtgtttctttttttttcttcctctttctttctttttcccttccactcgccctccctccctccctccctcccttcctcacttccttccttctctgtctttctctctcttctttttttttttttgagacagggtctcactctgtcacccagggctggagtgcaatggcatgataatggcctactgcaaccttgacctgggctcaagcaatcctcccacctcagcctctctagtagctgggattacaggtgcttgccaccatgaccagctaatttttgcattttttgtagagatggggttttgccatgttgcccaggcttgtctcaaactcctaggctcatatgatccacctgccttggcctcctgaaatgctaggattataggcataaaccaccaagcctggcccaatgtgtttcttagaataacagccacacagaatggagctcagtgcacctgtagttgcagctacttgggtggctgaagcaggagggctgcctgagcccgggagttcaaggctggggtacgctattaccatgcctgtgaatagccattgtactccagcctgggcaacactgcgagacccccatctcttaaaaaaaaaaaaaaaagccacacagaatgtatgtgaacaccaagcgtgaacactaccatgaactatggaccatcactctgggtaatgatgatgtgtccgtgtagtttcatgagctgtgataaatgcatcgctctggcggaaggtgccgaccatggggaagactatgcacgtggggccgggagcacctgggaactctctgtgtcttctgctcaattctgctgtgaacctaaaactgctctaaaaggtaaaatctattttaagaaaagccaatatcccttaaaacacttttgccccacaatgtgtttgaaacatgcaatttgactttactttccatgattttaataaaaaagacggccatggattatgggaaaaggtggttgagttatgctagatatgggcttttttttctctttttcacccagcattagatctaactgtgtactactgggaggaaatatataactaataagaaccagttaccaacactgttgtagtctagccgcaaataaagaataaaaggagttcaagaccagcccgaacaacacagcaaaactcttgtctctacaaaaaatacacacacaaaaattagccggtgtggtggcacacacctgtcatctcagctactcaggaggctgaggtgggagaatcacttgagcctaggaggtcaaggctgctgtgagccatgatcacaccactgcactccagtctgggtgacaaagtgagaccccgtctcaaaaaaaaaaaaaagtctgactctggctttagctttgtcatagatatactgatttaaccttcctgggctttgggtttttttaatataaagagactatctgtccttgggctacactcatggataacgtagagaggatgaacaaaagacggtctttaaaatgcttggaaagctcagacgcaggccaggtgcagtggctcatgcctgtaatcccggcacttcgggaggctaaaatgggcgggcagatcacctgaggtcgggacttcaagaccagcctggccaacgtggtgaaaccccatctctactaaaaatacaaaaatgagccaggtgtggttacacacacctgtaatccttgctacctgggagactgaggcatgagaatcacttgaatgcagtaaatggaggtggcagtgagctgggattgtatcactgcagcactccagcctgggtgacagagtgattctgtcttgaaataaaagctctgaactatccagaggctatacacactgtattgggagtgggaaattcattcaacaaatgtttcctctgtgtctgctatatcattaaggtagatactaccctgtctctatggaactatctatctagcaagtcagaaaataaaaatgatgatgggatatatacacagcacactgatacatgcgataccgactaggggaaaacgtggggtagaggaatcactgtaggtcaatctggtgtataagccttgagttggtggagaaggtagagatggcttgaggcaagaactacaccacggaaagtcccagagcaaagatgggggcagagggagcagctggtggggccactgtggggtacgaggatgatattagtcatctggtggggtctggaagtggcatcaaatccacaggacaacatggaaccattagagactggggaaccgatggtgaaaatttgattaaccacagaaccagtagagaactggcatctaccttgtcacatggcaaaattccaccgcaatcctctcagccatgcaccactcacgtggaaacatgcggccgtatttctcctcatagtccacaagctggcgttttatccaggcatagcgtctgtcgattttgtccagccaggcaacctggtgaaggtggagatcaaaagccaccccagtggttagaagtagaaatggcagttcaaggaaacaagcaaaaacacagagccaagcaaaagggaaccaacctctgtatttctcatggttttaaagaatctaggctacctttttaacttgattttttacttaaaaattcagaggtttttggctgggcgcagtggctcatgcctataatcccagcactttgggaggccgaggtcagcagatcacctgaggtcagttcgagaccagcctgaccaacatggagaaaccccgtccctactaaaaaatacaaaaattagcctggtgtggtgacaggcgcctgtaatcccagctacttgggagggggaggcaggagaattgcttgaacccgggaggcaaggttgcagtaaactgagatcgcaccactgcgttccagcctgggcaacaagagcgaaactccgtctcacacacacacacacacacacacaaaatccagaggtttttaacctggggtccatgattggccttcaggggtctatacatttccagaaactatatgcagaattttatgcacaggtgcatgtttctgaatttctccaaagggtcagtgacctcaaaatggttaagaactataaactcagcccctaggactcacagctcaacaaccaacactgtcagacagtcatgtaatacgaggtctaaattagtaggcttgacagcactcatgtttcaataaaattcaaatgttacatctgatcttatttggtcaatactcacatcttggttttcttgaaaaagtaccagatactctgacagatgctgtttaataaactttttgatgatttcctgtttgatcctgggatctagaatattagcaaccagacatgcatctcgtagaacattgctgggtcctcctggtctctagtaaaacaaacatgtaccaggtgaaaagccagaaacaacctttaaacctcatggcttctcacagccactacttgttatctctacgcattgtcagtcttactcctgctccttcacactcattctttctgctgtggctggatctgtcagttacctgctgctcctcgaggatggaatccttacactcgttttacagcaagcgacagaaaaactaccctgtgaatctgcaatgagatattttgggaaatgggcagtaatgatcacgggaaatttgactttctgcaaaccaaaactgaaagagatctaaaagtcagaatgccactggtctctgatgtcgcaagatgctgctgaagaggcctaagagtgggaatgccaccagcctctctcctaagagttggaatgccaccagcctcactccacatgtgccactcttccctgactccaacctctgggattcctgttcttaaagtgctatgtttttgccaaatagtgtggtctcccttaacacataaaaccaggttccaagccacgacatgtgtttcacaatagtgaactacctagaaaggcagccaaagagaaaatgctgtgatactggcctcctgacctgagcgaacactggaaagataccaggcgctgtactgacgcatcacgacgggaaggtctttgttaccaaaagcaattcaatgaccaaagttttgctgagactttctttacagtacgtcactgagtgaacatgactggctaagtggactacagtaaaaagaacacttggaatctactcctggcttggctaaaaagccatgcatgtagctttggagcacttgctcacctcatatgaaaaataatagactttaggtgataagtaaggttcttctaaatctttattttttgtcaactctttccaattccacccatctcaactgaagttccacgcttctaaagtgttatataagctgcctgagacctgagtttttaaaatgttgacttactccatgctgagtggtttttatgtcatctgctgaacaccctaacttctcaattctcacttcaggatgaaagtgacctgatagagaagtcatagatgccaaaacctatgggttcacgggttcagattttttcatttacaaagagtttactaggttgtgccttggaaaaatttttaaaaatcttaattcccacttgtgaaatggaaatagtaacacaaggcctttaagaaaagcccatagtctttaaaaagaaaactaggctgggagcggtggctcacgcctgtaatcccagcactttgggaggccaaggcaggcagatcatgaggtcaggagatcgagatccatcatggctaacatggtgaaaccccatctctactaaaaaaaaatacaaaaaaattagccaggcgtggtggcgggtgcctgtagtcctagctactcaggaggctgaggcaagagaatggcatgaactcggaaggtggagcttgcagtgagccgagatcgcaccacgacactccagcctgggcaacggagcaagactccatctcaaaaaaaagaaaagaaaagaaaactaaaaacaaaacaaaaaaaaaaccacacacacacacacacacacacacacacacacacacgaagtcactatgccagagaaaagggaggcatgttgttaaagagaaccattttaatttcatctgcccggtggaatctgggaaaaaaaatataaagcaggcctcttctaaacaataaagatgggcttcatccacatcttcctgaaacttctagaaactgaaatgagtggctgggcatggtggctcatgcctgtaatcccagcactttgggaggccgaggcgggcggatcacctgaggttgggagttcgaaaccatcctggccaacatggagaaaccccgtctctactaaaaatacaaaaattagccaggtgtggtggcaggtgcctgtaatcccagctatttgggaggctgaggcaggaatcacttgaacccagggggcggaggttgcagtgggctgagatcacaccattgcactctagcctgggccaaagagtgaaactccgtcaaaaaaaaaacaaacaaacaaacaaaaaaaaaaacctgaaacgggcagctgagtacacgtgaggctaaccttgtcctaagaagagcccagtgcttctcatgagcgaatatccccacaatcccttttcacttctttgaccttcattttcctcatgtaataaataggactaatggctttccaatatctactccctccctgcagttatatcagatgactaaggaatatgaggttctccaaggaaagtgctttacaaataagcatctgattactagcagacagccacaaaatgtgaagacattaaaatcaggagcgggcttcctatagaaagtgatgggcaaaagctggggccgctactcccacttacttcctacatttcttttatggaacacaaagaaaaaataattaagatatttccagttattgaattacagagcagatgcaggaaatgttccttggatcagtaaatgaatgtatgtccccatctctacccaccgagtagggtgaggctccttgcccctaagtgcttcagtatatttctgccttgaacaattctttctcttgaaatagctcaaacaatagagaaaaagtctcgtatgggttctttcctgtccgacacatgctaggcgctaagatggcatctgctacagttggaagggtggagctaaaagcagttccccaagcaggatggcagcttgttacatgagaagtgcaaccaacagctcccaagtgaaatgctgtgggctttgcagacacaacacaaacagctctgctaccagagagagctcaagggcatgaattccgaagagcaggcttatggtcagtaacagtgaggctcctcactatatcactctgagagttacataagatggtggatgctccacccagttgtcttttcaccaaaccaaaaccagtaagttatgtaacaatcctaaaaacaccgcggcatgaagatttcttttaaatacagccatgagaaaaaaggaattgacagggcatacaagatagacggtttgagacctacatcaaattaagcccaaacaaatcctctctttctgaggctggaaggaaacagaggaggaactgccaccacctagggacatttaaaatccagggtggtctcattaccctgaacctgcagcagaaggatttgcagctgccagcgagcatgactggaatgataaccacatggtgactggggtgagcgtgagctcggcaaggatggtgatcatctctaaagactggggaaacgcaaagcagtaccttggtgccctgggaaggaaacgcttcttcaaaatctgccaggatttgctgtcctaactcagtctgtgcagccttcactctgtgaggaagagagaacatatcatcacctggcatcatatccttatgtaactacacaccgatccacagggtcggaagggctgaagtctttcgagaaaggccaggaagggtacagagacgtccatgaggtgagaggtcacatactagttaagtgacaggttgatgagcaggacccaggcatccaagatattctcagggtgaatcttctatatccccaaaattcttctaggccaaccctttacctgaggtcatatgtattaatctttatacagttccactgggggatagtcatgctgtgggaaaatgttatagaatcacatccacatcaaatataaatctagctgggcgcagtggttcacgcctggaatcccagcatgtgggaagctgacgtgagagggtcgcttgagaccaggatttcaaaaccagcctgggcaacattagagagatccagtctccacgaaaaacaaactaaaataaaaagtacccaggtgcgggggcacacacctgtactcgggaggctgcggcgggaggatctcttgagcccaggacttttgaagatacactgagctatgatcacaccacagcactccagcctgggtgacagagggagaccttggctctaaaacaaaacactaacaaacaacaacaaataaatccactttggattactggtgtaactgctgtcctactccttggagtacagaatggcaagagggctccataatgttttagggtgttttgtaaaaaattattatgggtatataatcattatatatatatttatggggtacctgtgaagtcttgatacaggcatacgatgtataatgatcaaatcagggtaactgggttatcaatcaccccaagttatttgttacttctccgtgttaggaacattccaattccaatcttttagttatttttaaataaacaataaattattaaccgtagtcaccctattgttctaccaaatactagatcgtatcattctaactgtatttttgtgcccagtagccatcccagttactccccgcctccctgctatgcctcccagcctctgggacccagcgttctactcgctatctccatgagtttactttgaaaatgtttagcacccacatgagtgagaacatgaggaatctgtcttcccgtgtctggcttatttcatttcacatcacgtccagttcaatccatgcagctgcagtgttttgggtttcctgttaacccagaaaccaacaagctcgttaagtttttaaacaaataaatgaaaagaatgttttctaaggtaaaaacaaaaagagccaagtgacaaaatgaactgctaaatgatcactagtgagggccactgagtgaccatttaagttcagaagtttgtgaatatgaaaacggaactgcaaggaaaaccagctagaaaggggaggccagtactcaacagtggccgtgagtgtactaggagctcaagaactgtgcgtgtacttgaatgcaagggcagaaaggagaagcggctaggatggaaagcggctatggatcataccccacgatcaatcacgccccgcaatggatcaggccccgcaatcacgtcccgcaatcgatcacgccccacaatcgatcgcatgctgtgcatcccccacgagctgcctgatgttggtggccaccgtgcaccggccagccttgcagagagagagtggaacaagattctcaggccctgctgggcttcctgagcctgaggcaaatactgtctggttgctaaaaatgccttaaaagagcacacttccattctcggtctccaccctgttccttcagaattaactttatgaagtttctagaaatagcaacagctcaaaaccacaatttctttggctgctaaggagtgtctggcaacctgctgagattttttttcagatgaggggataggcatgacccaaaacaatctgttttttccgtggcgtggttacaattataccttattccaaatactttccaaggtttttccagtatcttcaaaacttttaaaaccactcttagaggtgggtttgtagccttttgagtcagttttcaaggaggccagaatgatccagacgaggctattactggaatagccgccacctccagattggaatcagggccatacgtctagagctgtccagcagacaatgggagacattccttcagcgtgaactttgacatgagagaaaagaataaaattgtacttcggagcttcttgtgatgcgcacacgaggaggcagcacacagcctgctgtggtgccaggtcacaggacagcttccagaggctcaggccccccctgttcctaccctcttcttggaagcacacacacagcaccagttccctcctaagccacagggaacttatagtaggaacttttcatggttagaagaggaaggagttctcctcacaggggaagtccagccgctagccagggcacccacagtcacattctcaggactactggccatctcaatgacactggtgggcccggctctgcccctggcccgaactatttgctactccatattcttggtgactctggaactgaggtggcagaaaggagagcctctggcccaaactattccctactctgaattcttggtgactctggaactgaggtggcagaaaggagaaccagagcctgtgacagcacctggtatcaccagagacaaaaaagaggaaaaattaccagtctctgatttgtagacttccttgccatgctcttcattttcatttttttacattaaattattatgtacaccttatttttttttattattatactttcagttttagggtacatgtgcacaatgtgcaggttcgttacatatgtatacatgtgccatgctgatgtgctgcacccattaactcatcatttacattagctatatctcctaatgctatccctcccccctccccccaccccacaacaggccccggtgtgtgatgttccccttcctgtgtccaagtgttctcattgttcaattcccacctatgagtgagaacatgcagtgtttggttttttgtccttgcaatagtttgctgagaatgatggtttccagcttcatctgtgtccctaaaagggacatgaactcatccttttttatggctgcatagtattccatggtgtatatgtgccacattttcttaatccagtctatcattgatggacatttgggttggttccaagtctttgctattgtgaatagtgccgcaataaacatacgtgtgcatgtgtctttatagcagcatgatttataatcctttgggtatatacccagtaatggggtggctgggtcaaatggtatttctagttctagatccttgaggaatcgccacactgtcctccacaatggttgaactagtttacattaccaccaacagtgtaaaattgttcctatttctccacatcctctccagcatctgttgtttcctgactttttaatgatcaccattctaactggtgtgagatggtatctcattgtggttttgatttgcatttctctgatgaccagtgatggttagcattttttcatgtgtctgttggctgcataaatgtcttcttttgagaagcatctgttcatatccttcgcccacttcttgatggggttgtttgtttttttcttgtaaatttgtttgagttatttatagattctggatattagcccttcatcagatgagtagattgcaaaaattttctcccattctgtaggttgcctgttcactttgatcatagtttcttttgctgtgcagaagctctttagtttaattagatcccatttgtcaattttggcttttgttgccattgctttaagtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttccacgtatggctagccagttttcccagcaccatttattaaatagggaatcctttccccatttcttgtttttgtcaggtttgtcaaagatcagatggttgtagatgtgtggtattatttctgagggctctgttctgttccattgatctacatctctgttttggtaccagtaccatgctgttttggttactatagccttgtagtatagtttgaagtcaggtagcatgatgcctccagctttgttcttttggcttaagattgtcttggcaatgcgggaccttttttggttccatatgaactttaaagtagttttttccaattctgtgaagaaagtcattggtagcttgatggggatggcactgaatctataaattaccttgggcagtatggccattttcacgatattggttcttcctatccatgagcatggaatgttcttccatttgtttgtatactcttttatttcattgagcagtggtttgtagttctccttgaagaggtccttcacatcccttgtaagttggattcctaggattcccaaattcctagttggattttattctctttgtagcaattgtgaatgggagttccctcatgatttggctctctgtttgtctgttattggtgcataagaatgcttgtgatttttgcacactgattttgtctcctgagactttgctgaagttgcttatcagcttaaggagattttgggctgaaacgatggggttttctaaatatacaatcatgtcatctgcaaacagggacaatttgacttcctcttttcctaattgaataccctttatttctttctcctgcctgattgccttggccagatcttccaacactatgttgaataggaatggtgaaagagggcatccctgtcttgtgccagttttcaaagggaatgcttccagtttttgcccattcagtatgatattggctgtgggtttgtcatagatagctcttattattttgagataagtcccatcaatgcctaatttattgagagtttttagcatgaagggctgttgaattttgtcaaaggccttttctgcatctattgagataatcatgtggtttttgtctttggttctgtttatatgatgaattacattttttgatttgcatatgttgaaccagccttgcatcccagggatgaagcccacttgatcatggtggataagctttttgatgtgctgctggatttggtttgccagtattttactgaggatttttgtgccaatgttcatcagggatattggtctaaaattctctttttttgttgtgtctctgccaggctttggtatcaggatgatgctggtctcataaaatgagttagggaggattccctctttttctattgattggaatagtttcagaaggaatggtaccagctcctccttgtacctctggtagaattcggctgtgaatccatctggtcctggactttttttggttggtaggctattaattattgcctcaatttcagagcctgttattggtctattcagggattcaacttcttcctggtttagtcttgggagggtgtatgtgtccaggaatttatccatttcttctagattttgtagtttatttgcataggggtgtttatagtattttctgatggtagtttgtatttctgtgggatcagtggtgatatcccctttatcattttttattgcatctatttgattcttctctcttttcttctttattagtcttgctagcagtctatcaattttgttgatcctttcaaaaaaccagctcctggattcattgatttttttgaagggttttttgtgtctctatctccctcagttctgctctgatcttagttatttcttgacttctgcgagcttttgaatgtgtttgctcttgcttctacagttattttaattgtgatgttagggtgtcaattttagatcttttctgctttctcttgtgggcatttagtgttataaatttccctctacacactgctttaaatgtgtcccagagattctggtatgttgtatcttgttctcattggtttcaaagaacatcttcatgtctgccttcatttcattatgtatccagtagtcattcaggagcaggttgttcagtttccagtagttgagtggttttgagttagtttcttaaccctgagctctagtttgattgcactgtggtctgagagacagttcgttataatttctgttcttttacatttgctgaggaatgctttacttccaactatgtgatcaattttggaataagtgcgatgtggtgctgagaagaatgtatattctgttgatttggggtggagagttctgtagatgtctattaggtccgtttggtgcacagctagttcaattcctggatattcttgttaactttctgtctcattgatctgtctaatgttgacagtggggtgttaaagtctcccattactattgtgtgggagtctaagtctctttgtagtttctaaggacttgctttatgaatctgcgtactcctgtattgggtgcatatatatttaggatagttagctcttcttgttgaattgatccctttaccattaagtaatggccttctttgtctcttttgatctttgttggtttaaagtctcttttatgagagactaggattgcaacccctgcctttttttgttttccatttgcttggtagatcttcctccatccctttattttgagcctatgtgtgtctttgcacatgagatgggtctcctgaatacagcacaccgatgggtcttgactcttgagccaatttgccagtctgtgtcttttaattggagcatttagcccatatacatttaaggttaatattgttatgtgtgaatttgatcctgtcattataatgttagctggttattttgctcgttaattgatgcagtttcttcctagcatggatggtctttacaatttggcatgtttttgcagtggctagtaccggttgttcctttccatgtttagtgcttccttcaggagctcttgtagggcaggcctggtggtgaaaaaatctctcagcatttgcttgtctgtaaaggattttatttctccttcacttatgaagcttagtttggctggatatgaaattctgggttgaaaattcttttcttcaagaatgttgaatattggcccccactctcttctggcttatagagtttctgccgaaagatccgctgttagtctgatgggcttccctttgtgggtaacctgacctttctctctgactgcctttaacatttttttccttcatttcaactttggtgagtctgacagttatgtgtcttggaattgctcttctcgaggaatatctttgtggtgttctctgtatttcctgaatttgaatgttggcctgccttgctaggttggggaagttctcctgaataatatcctgcagagtgttttccaacttggttccattctccccatcactttcaggtacaccaataagacgtagatttggtcttttcacatagtcccgtatttcttggaggctttgttcatttctttttactctttattctctaaacttctcttcttgcttcatttcattcattcgatcttcaatcactgataccctttcttccagttgatcgaattggctactgaagcttgtgcgctcgtcaggtagttcttgtgccatggttttcagctccattaggtcatttaaggacttctctagactggttattctagttagccattcgtctaatcttttttcaaggtttttagcttctttgtgatgggttcaaacttcctcctttagctcagagaagtttgatcgtctgaagccttcttctctcaactcgtcaaagtcattctccgtccagctttgttccattgctggcgaggtgctttgttcctttggagggggagaggtgctctgatttttagaattttcagcttttctgctgttttttccccatctttggggttttatctacctttggtttttgatgatggtgacgtacagatggggttttggtgtggatgtcctttctgtttgttagttttccttctaacagtcaggaccctcagctgcaggtctgttggagtttgctggaggtccactccagatgctgtttgcctgggtatcagcagcggaggctgcagaatagcaaatactgctgaacagccaatgttgctgcctgacttcgtctcagaggggtacgtggctgtgtgaggtgtcagtctgcccctactggagggtgcctcccagttaggctactcgggggtcagggacccacttgaggaggcagtctgtccattcttagatctcaaattctgtgctgggagaaccactactctcttcaaagctgtcagacagggacatttaagtctgcagatgtttctgctgccttttgtttggctatgccctgcccccagaggtggagtctacagaggcaggcaggcctccttgagctgtgctgggctccatccagttccagcttcctggccactttgtttacctgctcaagcctcagcaatggcgggcgcccctctcccagccttgctgccgccttgcagtttgatctcagactgctgtgctagcaatgagcgagtctccgtgggtgtgggacccgccgagccaggcaccagatataatctcctggtgtgccatttgctaagactgttggaaaagtgcagtattagggtgggagtgacccaattttccaggtgccgtctgtcacacctttgcttgtctatgaaagggaattccctgaccccttgcgcttcccgggtgacgcgatgccctgccctgcttcagctcatgtttggtgggctgcacccactgtcctgcacccactgtccgacaagccccaatgagatgaacctggtaactcagttggaaatgcagaaatcacccgtcttctgcgtcgttcaagctgggagctgtagactagagctgttcctattcagccatcttagaactgcctatgtcgccatgttcttcattttcaaagtcacctcttgagataggctggacctggttatgttactagtgagccgcataatcacaagtcacttcctctctgtgggtcacaactttgaatagctgtgaaataagagggtggggctagcagcccatactagatgattctgtgtcctctccagtactgattattccacaacacccatcttacggtgctaactggctttacaggtggctagaggttagatgtatgcttaatcctggagcagaaggatacgcatataaatgtcaatgtttccaacagcagtttttttctttgttttttttttgagacgaagtctcactcttgtctcccaggctggagtgcaatgggataatctcggctcactgcaacctccgcctcctgggttgaagggattctcctgcctcagcttcccaagtagctgggattacaggcgcctgccaccacgcctggctaattttttgtatttttagtagagacagggtttcaccatgttggccaggctggtctccaactcctgatctcaggtgatccacccacctcggcctcccaaagtgctgggattacaggcgtgagtcactgcgcccagcctctaccaatagcagtttgtgaagtggctatcaatgactcagatgaaagcaactattcccttacagacatcactgatggtatctatagacccaaacctcaatcccatgcattttcagggtaagatgtgaatttcagtctttataagcaattgcttaaataggattctagaaagaagtcaacagacttgaaagaatttatctttggcctcattcctttaaactccttcctcttctaaccatgaaaaggttcccactacaaagaggtagctcaactgataactgtcagcaaagcacatatatgtgccaaactaccaagatttcctagtcattcctttcttttcagactggagtacagtggtgcatttgtggctcactgcagcctcaacctcccagggttaagtgatcctcccttctctcagcctcctgagtagctgggactataggtgtgcacctccatgcccagctaattcttgtattttttgtagagatggagttttgccatgttgcccaggctgatctcaaactcctgggctcaagcgatctgcccacttcagcctcccaaagtgctaggattacaggcatgagccactgtgcccaactgatttcctagccattcttgtgaaagtccgcctacaactcatagagaacagggaaaacaaaaattcctcctggcatccacgtaagttcagcctgttgcatggtggcaaccccaaatgggtcactcttcagaaacaaaagattcattgtgctgcccagaaaggaaagtcaaccaggtggtttctggcatcctccatgccacgtgactgcagggctgttccaaggcaccctttcctaaaagtgttctcagcttttcgtaagggggagtcacagacagacagcaaattatgaacattgttcagatatctgtggataaagtagccctgagacttttgttaccttgtgagtgacagtcccaaagaaaacacccccaacagttcccaaataaatataccgccctcccaaaccacagtcttctaaacagcagggttaattagtcaaatgctacagttccaaacagacaccataaagaatctcagcctagaatcttgagtgaccccatgagacacttctgagatcaccaaggacaacactcatacttggcaaccgaggacaacactcatacttggaaagcgaggacaacactcatacttggaaagcgaggacaacactcatacttggaaagcgaggaaaacactcatactcggaaaccgaggacaacactcatacttggaaagcgaggacaacactcatacttggcaactgaggacaacactcatacttggaaaccgaggacaacactcatacttggaaagcgaggacaacactcatacttggaaagcgaggacaacactcatacttggaaatcaaggacaacactcatacttggcaactgaggacaacactcatacttggcaactggggacaacactcatacttggaaagcgaggacaacactcatacttggaaagcgaggacaacactcatacttggcaaccgaggacaacactcatacttggcaaccgaggacaacactcatacttggaaagcgaggacaacactcatacttggaaagcgaggacaacactcatacttggaaatcaaggacaacactcatacttggaaagcgaggacaacactcatacttggaaagcgaggacaacactcatacttggaaatcgaggacaacactcatacttggaaatcgaggacaacactcatacttggcaaccgaggacaacactcatacttggcaaccgaggacaactctcatacttggaaagcgaggacaacactcatacttggaaagcgaggacaacactcatacttggaaagcgaggacaacactcatacttggaaatcaaggacaacactcatacttggcaactgaggacaacactcatacttggaaaccgaggacaacactcacacttggaaagcgaggacaacactcatacttggaaagcgaggacaacactcatacttggaaagcgaggacaacactcatacttggcaactgaggacaacactcatacttggaaaccgaggacaacactcatacttggaaagtgaggacaacactcatacttggaaagtgaggacaacactcatactgggaaaccgaggacaacactcatacttggcaactgaggacaacactcatacttggaaaccgaggacaacactcatacttggcaactgaggacaatactcatacttggaaagcgaggacaacactcatacttggaaagcgaggacaacactcatacttggaaatcaaggacaacactcatacttggaaatcaaggacaacactcatacttggcaactgaggacaacactcatacttggaaaccgaggacaacactcatacttggaaaccgaggacaacactcatacttggcaaccgaggacaacactcatacttggaaaccgaggacaacactcatacttggaaagcgaggacaacactcatacttggaaagcgaggacaacactcatacttggaaagtgaggacaacactcatacttggaaagtgaggacaacactcatacttggaaagcgaggacaacactcatacttggaaatcaaggacaacactcatacttggcaactgaggacaacactcatacttggaaaccgaggacaacactcatacgtgtcaacccaggaggcccaggaggaacttgtcgaggccatagagctgtgcaggcctgtccatttccaggttgagttcttttttcactccatcatgagacctgccaagcctttctcacatttataagaggttagaaatggctgtgaaaaatatattttcgttcaagagtttcatggttttcaagagaatgtaaggctcttccattcttcattgggagatactgactgatgactagaaacattccctttcacggatatgcttaggccaggaggatttgaaatgtaaagatgctaaagaaaaaactctttcctccaatgctacattaagcatggaagcatttgccagaagggtagttggaagaattagctatgctcaaatcaaggctcatgaacttcctatttcaaatgtacaggcaaagatttcagaacacaacttttcacatgacttctacactttacagacagcaagacagtaaatttgagaaacggaagcaatgcagagggtggtaacccgcctgccatctcccgccccttacaacaaatagctatttctctcatttccagatggttctaccatcagcacgtaaacataagggaagcaaattcaccagaaaggatgctaaaaataagaagtctggacttttctcaaacgtttagtacctcttaaaaaaacaatcctagtcaagcactgaaaataaaaataagaagttgtctcctcttgtgctctttttagtgttatttttttttttcccccgagacgggtctgctttcttgcccaggctggagtgcagtggcacagtctcggctcactgcagcctccacttccggagctcaagtgatcctcccatttcagcctcccaagtaactggaaccacaggcacacatcaccacaccagctcactttttgtatttttggtagagacagggtttcaccatgttgtccaggctggtcttgaactccagagctcaagcgatctgcctgtctcagcctaccaaagtgctgggactccaggtgtgagccaccatgcccagcctttttagtgttacttaatagcacatattctgtattaacctacacaaaattattgcaaatagagattgcgaaatgaactaaaagataagtaaatcctcctgtgtttgcagcaaccttatgtgataatgaatgtttggagcactgaaatatattcatagaatgttggactttctatttttcaggaatgtgattataacagtgattattaagttccttcaaatttttaaaactacctctttaaacaaatgttgaaaagcaaagagcccaccaaaagtacaggcagcaaaagcaaaaagaaacaagtgggactacatcaacctaaaaagcctgttggagaaatgcaggtggaaaccacaatgcagtgtcacttcacgtcctaacgggggcatcttttcatgtttattggccatttatttatcttctttggagaaatgcttattcaaatcctttgctggttttttaattgagttgtttggctttttgttgttgatttctgggaattctttatatattctagatattaatccattatcagataaatgatttggaaatattcttcccattctgtgcattgccattttaccctgctgatagtgttttttcatgcacaagttttaaaatttttcataaagtcccatttatctatgttttccttttgttgcctaggactttggtgtcatatccaagaaactgctgccaaatacagtggtgtgaagatctggtcttcgttttcttctaagagttttagaattaggttttacatctaggttacagatccattttgagttattaacgaatccctatgctggtttctgccaaataaaagttagttctgtcatgttcctgccatgcacaaccccttcctttataccgactggagataggctcccacacacatctccgtgaccgtgtggccactgcctcctaagggtcttatcttttctaatccatatcacggactggagactggctcttacacacatctccgtgaccgcgtggtctctgcctgataagggtcttatcttttctaattcataccacggactggagactggctcccacacacatctccgtgaccgtgtggccactgcctcctaagggtcttatcttttctaatccatatcacggactggagactggctcccacacacatctcggtgaccgcgtggcctctgcctgataagggtcttatcttttctaattcataccacggactggagactggctcttacacacatctcggtgaccgcgtggcctctgcctgataagggtcttatcttttctaattcataccacggactggagactggctcccacacacatctccgtgaccgtgtggcctctgcctgataagggtcttatcttttctaatccataccacggactggagatcggctcccacacacatctccatgaccgcgtggcctctgcctgataagggtcttattttttctaatccatactacggactggagatcggctcccacacacatctccgtgaccgtgtggccactgcctcctaagggtcttatcttttctaatccataccactgactggagattggctcccacacacatctccgtgaccgcgtggccactgcctcctaagggtcttatcttttctaatccgtatcacggactggagactggctcccacacacatctccgtgaccgcatggccactgcctcctaagggtcttatcttttctaatccacaccactgactggagatcggctcccacacacatctccgtgaccgcgtggccactgcctcctaagggtcttatcttttctaatccatatcacggactggagactggctcccacacacatctccgtgaccgcgtggccactgcctcctaagggtcttatcttttctaatccacaccactgactggagatcggctcccacacacatctccgtgaccgcgtggccactgcctcctaagggtcttatcttttctaatccatatcacggactggagatcggctcccacacacatctccgtgaccgcgtggccactgcctcctaagggtcttattttatccagactcctgtacctctataatccactagacttttacaaaatacaagtgagatcatgccccccgcacttaaaatctttcactgtccacaaaataaaaaataaattatttagcaaggcatataaaacctgacccgatctacctatgcagccctgtctccctctgctgcctccaaactccatgagactccctcttccttctttcccccattactgtcacgttggtaagatcccacccattcttttaagattcagattaaaacagaatttgtctatgacccctgccctcagcccctgcttcagcctatcaattcctcttctgagatcctgctatgccttgtacagcatataccagttttgttacatctgttatactggaatcttctattaatgtctttcttctccatacaaaaatggtgaactctttgaaggcagagagtgtgtatttcttatctttgtgccttcagtccccagcacggggcctaggatgtagaaaatgcagagtaaatatctatcatgcaaatgaagaaaagaacaaatgaatatgaaagagatcaactctgaatcatcctgagagcaggggtagaagggactgccttcctcctcccccatccgctgacagcaaatctgcctgctccatccaggctccttctttcttgcagctcataaagtcctgttcgcctgctttcttggctgcctcacagtccagtctgataaggtgatcagctggctctaggtgtgaggggtaggaaggatgagggaaagggtggcgatttccctagcgttctgccaagctcggcaagatgcacactgagcacacgttgcaacctcccattcctgccccggagcgtcagaaataataaaaagattttcatgaaaatccaaatccagacaagaaaagtggtatactagaagcctgaggacttcctggtaggaaggatgacagaaaatcactgcccaaaaatgcttctcgaaaatgaaagacatgaaggtggcgataccaggagcaggatggggccgctgtccgtgtctgcacccacaccgtgaatgcgtgaatgctcacgtcaggcggcaggggtgggcctctgggtctgagaacttcagcagtagccagaggggcggccaacacccaagaagaccagggagcctccaagcctaggagatcagctgctgggacacccacctggcaggtttctccaggtctggcccccctcactttggaaaagctgtctgtgatacacttagccaagtagcaattcccatttctcgcccacgagcaggtagcagtaaaagagcattcttgatcagactaatagagaatgtcaaaaataaaaataaggccgggcacggtggctcacacctgtcatcccagcactttgggagactgagacaggtggatcacttgaggtgtcaagagttcgagaccagcctggccaacatggtgaaaccctgtctctactaaaaatacaaaacttagctgggcatgggtggtgggcgcctgtagtcccagctacttgggaggctgaggcaggagaattgcttaaacccaggaggcggcgattgcagtgagctgagattgtgccactgcactccagcctgggcgatggagtgagacttggtctcaaaaaataaacaaataaaataaaaatgaggtttcagctaagaatcactaaacatttgagaaatgctaaagagaaagaattgccatgctgaacaaactgaagatcttacactggaggacagaggaatggaacaggcactgaagatcttacactggaggacagaggaatggaacaggcactgaagatcttacactataggacagaggaatggaacaggcactgaagatcttacactggaggacagaggaatggaacaggtaatgaagatcttacactggaggacagaggaatggtacaggcactgaagatcttacactggaggacagaggaatggaacaggcactaagatcttacactataggacagaggaatggaacaggcactgaagatcttacactggaggacagaggaatggaacaggcaatgaagatcttacactagaggacagaggaatgaacaggcaatgaaaatcttacactggaggacagaggaatggaacaggcactgaagatcttacactggaggacagaggaatggaacaggcactgaagatcttacactggaggacagaggaatggaacaggcactgaagatcttacactggaggacagaggaatggaacaggcaccgaagatcttacactggaggacagaggaatggaacaggcaccgaagatcttacactagaggacagaggaatggaacaggcaccgaagatcttacactggaggacagaggaatggaacaggcaccgaagatcttacactggaggacagaggaatggaacaggcaccgaagatcttacactggaggacagaggaatggaacaggcaccgaagatcttacactggaggacagaggaatggaacaggcaatgaagatcttacactggaggacagaggaatggaacaggcactgaagatcttacactggaggacagaggaatggaacaggcactgaagatcttacactggaggacagaggaatggaacaggcactgaagatcttacactggaggacagaggaatggaacaggcactgaagatcttacagtggaggacagaggaatggaacaggcactgaagagcttacacttgaggacagagaaatggaacaggcactgaagatcttacactggaggacagaggaatggaacacgcactgaagatcttacactggaggacagaggaatggaacaggcactgaagattgtacactgtaggacagagaaatggaacaggcaacccagtgctttaacaaacacataatttctattccgtgggagagacatgagaatattatgcccatgagaaaagaatcagctagatatgctggaaattaaaaagctggatttttaaaataaaaattcaacagctgggccaaatagcacaatggatgcaagtgaagaataaattaaaataggaagactgggttgaggaattctttcagaaagcagttcaaaaggacaaagagacagaaagcatgaaaggaaaattaagagacatggcagcagatctagaagatccaacgttcacgtaacaagaattccacaaggaaagaatgcagagaccaagttgtagagactactcaaagaaaggaataaaggagaataatttcttagagtatgagaaactcatgagtgtttagaggaagaagacaactggggctaggtacagtggctcacgcttgtaatcccagcactttgggaggatgaggcaggaggatcacttgagcccaggagttgaagaccaacctgggcaacataagaagatcccacctctacagaaaaatgttaaaaatcagccaggcatggtggtatttgcctgtattcctggctactcaggaggtggaggcaggaggatggtttgagcccaggagttccaggttgcagtgagctatgaccacgccactgcactccagcctgggcaacacagcaagactccgtctcaaaaaaacaaaacaaaacactaatcttactagctacaaggaaaatgaaaattaaaggaaccggataccgttttcaaccataagatagataaaaatgaaaaacaacaatatcaagtgttgctgagggtaagggtgctctcatacagtacagatcgtactacaagtatataaagctttgctggagggcaaatgggcagtagctactaaaattttaaatgtatacaaacctataacccagaatctgtcccagagaaatacttgcatatgtgcaaaagggggcatattttaagaattagaaacaacgacctagtgctaccaaaatggtgaaataatctgtggtatgtcacgctatggggttctgtgcatcaattccagagaatgaagcaggtttatacatactgatgagaaaaaaaatatctaaaatacatgtggttgaaaacaaaaagcagtttttagaataaagcgtaaggcatgaaaccatttagttaaaacaaaacaaagcaaaaacaaagccattaactgaaactatagatttatataaatacacacacaaatccggagagataggattaaaactatagatttatgtaaatacacacacaaatccagagcgatagccactgaaactacagatttatgtaaatacacacacacaaatccggagcgatagccattaaactacagatttacgtaaatacacacacacaaatccgcagtgatagccattaaactgataacaattaccacctctgaggacaacaatgggattctgaagtctaggtaaagggaacttaggtttcacctgtatacatatttgacctttttaaacaatagaagatgtggaaccaggtgcagtggctcacgcctgtaaccccgatgcactgggagcccaagaccagccctgggccacagagtgagaccctgtctctacaaaaaagtaacaaagttagttgggtgaggtgctgcgtgcttgtagtcccagctgcttgggaaactgtggtgggaggatcacttgagcccaggagttccaagctgcagtgagcagtaattctgccactacactccatcctgggtgacagagtgagaccctgtctctattttttaaagtctatgtgtattacttatataattacaaataaggaaacttaaggaaaacaaagaagcctgtagcattcgggccttattaagaaggcagagtcagaaacgtagctgctgctcagtaacaacgccttcatttcttctttgctgcaaggaaggttagaatttgtcaattgtgacggtctctgccttctcagtgttcttcctgcccctccttctaacagaaaaggtggtgcatcaactcctcctcgtcctcccttggaatcctcatcctccttcgctctgagaaattactttcctttccactggatctgaatctgggattaaaactcaacagcaataagaaggaaagaataaggttggggggaaagtcatctttttatcgtatctaaagtttttgtggttcactgtatttttttttttttttgagtctcaccctgtcgcccaggctagagtacaatggcaggatctcagctcactgcaacctccacttcccaggttcaagtgactcctgcctcagcttcccgagtagctgggattacaggcacctgccaccatgtccagataatttttgtatttttagtagagacggggtttcgccatgttggccaggctggcctcgaactcctgacctcgggtgatccacccgcctcggcctcccaaagtgctgggattacaggtgtgagccaccatacccggccgtggctcactgtattttctaaagaccgccacagcaatctatcccatcccacatgctttttgtaacaatgtgactttgacattcctcccgttagtgggtgggagaagactatgttccttcctcttgaatcttagcagccttgtgactatggcagaagtgatgctatgaaatttccaaggcttggttctcttgggacgctcattcttggaaccagccaccttaccgtgaggaagtccaagcagcccgtggaagacaacaaagaatcccagcaacggcctggccaagctcccagctgacagcaagcaccaaggagccagccatgagagtgagccaatgcattctccagtcccctcctgagctgcctcggctaatgctgcacggagcagggatgagctggtccccgagccaggccaaattatacgtgcaaaacaattattgttttaagctactaagttttgtgctggtttgttacaaagaaatagatacctagaacagtttctctcacaaatggggacaactgagagttgtccatatatacaactgtaactatctaccacaggcagctttggaagacatgggaaggggtaaagtgggggaacgtctgcaccagacagttagatcaggtagcatctgatattccttcacacactaagactctgcagtgaacacgctgagctaagtgcttaagcacttcctagcaccaggtccttttctgaaagcaagatcacttcttccggtgacagtttaccttttggaaagtttagctgccggatctgcggaatccccatatactttccctccagtgacagtttacctttcggaaagctgccggatctgtggaatccccatatactttccctccggtgacagtttaccttttggaaagctgccggatctgcggaatccccatatactttccctctggtgacagtttacctttcggaaagctgccggatctgcggaatccccatatactttccctctggtgacagtttacctttcggaaagctgccggatctgcggaatccccatatacttgtggaagtgctccaggacattcatcacaccctgaaggagattagcaacttctccgtattgtcttcgcctggtcatggctctgcaaggaaagaataagtttaaaagtctagaaaaacactaaagacgcaagatacagacacagaacaacccacgctagctctcaaacagatatcaactcagctgaatcaacgttcgctgagcactgagtatataagctgctgtgcgttgtgggaggaaaaaacaggatctggtccaaatcctcaaggtgacaccatatagtaagggagagagtcaagtacacatctaactagtatcaaaaaggatgaactatgttctaaacagaagtacaaattatgtgctacggcaggaagaatgtgtgagtgatgaattctcatttggtgtggggaggggaatctgggaagacgatgaatttagaatttgggttggatattatgggattagcaagcttgggacagagaaccggggtagggatgttactatctgaggattacagcctatgagcaaaccaaacacaaagggtgcggccaggcgcggtggctcagcctgtcatccccgcgctgtgggaggccgaggtggctcacgcctgtcatacccacactgtgggaggccgaggcgggcagatcacgaagtcacgagatcgagatcatcctggccaacacggtgaaacaccgtctctactaaaaatacacaaaattagctgggcgtggtggtggatgcctgtaatcccagctactcgggaggctgaggcaagagactcacttgaacctgggaggcggaggtttcagtgacccgagatcgtgccactgcactccagccagggtgacagtgggagactccgtctcaaaaacaaaaacaaaaatacacaaagagcagcactttacctattaactgaaatctgtaggttctaaggcgtctgtatcacagacctctactttccctactgctaaggttaatgacgcttaaataaaaggatgctgataaaatcaagttacacacagggaggaaatataaactattagatctaaatttttcattagggttgggttatttcattaaatttgtaatttatgattttccataagaagcattgaaaaagacaggattggccgggcgcggtggctcaagcctgtaatcccagcactttgggaggccgaggcgggcagatcacaaggtcaggagatcgagaccatcctggctaacacggcgaaaccccgtctctactaaaaatacaaaaattaaccgggcttagtggcgggcgcctgtagtcccagctactcgggaggctgaggcaggagaatggcgggaacccgggaggcggagcttgcagtgagcctagatcgcgccactgcactccagcctgggcgacagagccagactccaactcaaaaaaaaaaaaaaaaaagaaaaaagaaaaagacaggatcaagttcaagccaaggtgttccgttgctaccaccacctggttttaccaccgcctggtcttaccaccgcccagtcttaccactgcctggtctgatggtttggtggacaccgaccaccccacgaaggaacaaatgtgaccgccctctggcctccctctggccgctgctctcactgctcacaggagagtggaccaggcatccctggagctcatccaatacctagagaggtcaggaaggggcccgcccctcctcctctttccctcaaggcactctcccacttcccccacccaggactttgaatgctgcatctcagtttctatgacgatgcgctttccctgtccacatacggaatcacactgaggctggagcagggggagtccccagcctgagacgggccacagaggtgagctggagtgtcagaatcttgctagtaaaggaggctttagattgctcctttgtagtaaatcaccagctcttccttctctatttctaatgttctgatgtatcattccctctacaagccaaacggaaatctactttataaaaaaaagtggtttgaatgattgagttctgtctcatagggtctcttccatgacagtgcaactcagcccaacgcaagcaggaaacctgctgaggcagaagcagcagggagtgaatatgggcctgtgtcactctgtctgcctggagtgaatatgggcccgcgtcactctgtctgcctggagtgcatatgggcctgtgtcactctgtctgcctggagtgaatatggccctgtgtcactctgtctgccttgatggtacagagccacagcctgaagatgggccatattcttggagtcgtcctgaaaggcttctggggtccccttttgactagctgccagtgtttgttaggttctgaacaccagagggcacaaagcaaaaatggtgactgaacacttgaagccaatttgcagaaagtggggcaggatggtgagactttcctggctgagaagtaaataggcgacaacaccattttctctatgcgatacatttcccgtggccccaaaagagaaagttggcattgcttactcgagggagtcgacacctcctgccagcatgtgcaggtggttcagtgtggtgattgaggtggtcaggtggcgtttggcgtgatctaattgcttaatatcacgggtgatttctttcacctaaacattgaaaaaccacaagaaagaaaggaagacggtcaagaaagatgtaaaacacttctgcaagtagctctgtaagaaacgaatgcagatgaagcagggaaaaatctcaggttagcaaacattctcacaatacaaaataaaaataatttccaaccaggcatttaaaatttaatgtggcatctctttggactttactcagggttataaaaccttcagttgtgagcatgaaatgaactttatttttttaccccaaatgaaatgatccaaacagcaattcagtattgagcacacaggacagaggaggtaagcacagcacctttccttgaacaaggtgaggaaagtgtgccttctggtgatgaagccgctgggccatataaaacacctatcagtcagtactaggtactcagacggtctttactaatggaatgagggcctgagcttccagcaaagaagactttcaaatctcaagaagattgaaatataagctctgtaacatacgcttaacatgtaagttactaggagggcaggagcagtcttcagggagtgagaaggcaatttggggagtaagagcctgacagtgttgtttcagcaggtccaagagaagagaagctgtctctgggaatgcaagtatatttcagtcaccagaaaagcatattcaatagagaagttggaaaaattccccaactttactaacacccaggtgaaatcatccactgtgtttcttggtccatgctgactaagaaatgtgtgtgtgtgtgtgtgtgtgtgtgtgtgttttatcatgccacattatttttaattacgtacaaagatctaacatgtcacccacggaccatttcacccgctgctctgtttggccgccagtctcttgtctctctcttcagcaatggtgaggcggataccctttcctcggggaagagaaatccatcgtttgttgcccttgccaatagtgaaaatgttggaaacttgagtgccaaagctgttgccactggtgtctttcacatgaaccacgtcagaagatcccgggtacctctctctgttggggatcacaccaactcttcccaggtgagcacctccagtcaccatatatggcttgccagtgtcgaacgtgatgaaatcggtcatcttgccagtctccaaatcaatctgaatggtgtcattcaccttgatgaggggtcagggtagcggatggtgcgagcatcatgagtcaccagatgagggattccttttgtgcccacaaagatttttctcactttgcacaacttgtacttggtctcctcaggtgtacagcaaagcaacctttggtgtcacggatcagatggaaattctctcctgtcttgtcaatgctgatgacatccatgaacccagcagggtatgttatatcagttcggaccgtgccatcgatcttaatgaaccgctgcatgcaaatcttcttaagtctgttccttaggaaaatgatgaggggaagacactctctcaacttgtggggactggtggacggacgaggagcaaacacaccggtcaatttatccagcatccaatgctttggagctgctacccgcttcagatgcttcttggcaccacgagccatggctgcattaggcaaggaaaagaggacctttgtcttccggtgcacatagcgaaagtttcttaatagcaatttggttgcccaggttctgtgatacctggaaggaagggagtgccctggataccaaacacaaatactgtagtcactggatagatacatcccattaaagtgagtaacttggccatgagttcatggatagatacgtcctcattaaagtgagaaacttggccgtgagtttgtggatagatacatcctcattaaagtgagaaactcggccgttgaggtcgtggatagatatatcctcattaaagtgagaaactcggcagggagttcgtggatagatacatcccactaaagtgagaaactcggccgtgagttcttggatagatacatcgcactaaagtgagaaactcggcagggagttcgtggatagatacatcccactaaagtgagatactcggccgtgagttcgtggatagatacatcccactaaagtgagaaactcggcagggagttcgtggatagatacatcccactaaagtgagatactcggccgtgagttcgtggatagatacatcccactaaagtgagaaactcggcagggagttcgtggatagttacatcccactaaagtgagaaactcagcagggagttcgtggatagatacatcccattgaagtgagacactcggccgtgagttcgtggatagataacatcccactaaagtgagaaactcggccgtgagttcgtggatagatacatcccactgaagtgagacactcggccgtgagttcgtggatagatacatcccactgaagtgagaaactcggccgtgagttcgtggatagatacatcccactgaagtgagaaactcggccgtgagttcgtggatagatacatcccactgaagtgagaaacttggccgtgagttcgtggatagatacatcccactgaagtgagaaactcggcagggagttcgtggatagatacatcccaccaaagtgagaaacttggccgtgagttcttggatagatacatcgcactaaagtgagaaactcggcagggagttcgtgggtagatacatcccactaaagtgagatactcggccgtgagttcgtggatagatacatcccactgaagtgagacactcggccgtgagttcgtggatagatacatcccactgaagtgagacactcggccgtgagttcgtggatagatacatcccactgaagtgagaaactcggccgtgagttcgtggatagatacatcccactgaagtgagacactcggccgtgagttcgtgtgccctgctctttcagggtctgatcaccctaggtgaactcatacaggttacgacctgcacagctcaattccacacctatgatcctgcaagccttacctggatcttagctataaaaagcctctttcatggggacttccccatcaagccttctctcctgtaacctccaaacaatctctgtttccaatgaattaaaaaaaaaaaaaaaggttaagaccaccaccactttaccaaatacttaaatttggggcaaaaaaaataaaaataaataaatcaggagtggtataataaattagatatagaaggctgaagattggccctgtaacctgatcacccacttgcaactctgaaatcagcatcctttttcctacaaaaaaatctctgtatctcttccagcgtttttagcttcagtctaacatagggagtctttatttatttatttatttttttattttttgagatagagtttcgctctgtcgcccaggctgtactgcagtagtgcgatcttggttcactgcagcctccacttcccaggcaagcgattctctgcctcagcctccagagtagctgggattacaggtgtgctccacgacgcctggttaatttttgtatttttagtagagacacggttttgccatgttggccaggctggtcttgaactcctggcctcaagtgatcccccctccttggcctcccaaactgctgggattacaggcatgagccaccgtgcccggctgcatcaggggtctttaaccactgtgttcaaagtcacatcatctatgactcttcctggtccctgcatcaagtcctaaatattctccctctgcttcatctcaagactctatcccttctctctatgtcctaaatattctccctctgcttcatctcaagactctatcccttctctctatgtcctaaatattctccctctgcttcatctcaagactctatcccttctctctactccttgttcaggccctcactgctctgcactggagctgactggtctctttattcccaggatctcccgtcactccccatcccacagcctgtgtttctctagacaaactgaaccactgatttttccctaaacaaagccatcaatggcagggcacaccaggggtactcaggtcaaacctacacgagatcatctgcgagacagaaggcccatggttgattcgcctcaactgacttacacgagaccacctgtgagacagaatgcccatagttgatttgcctcaactgttgcccacgggctgcgaaaacgggtagagcatgaaatgggaggttgtagagtcagacagatctagggctgaaccccagctctaccactcaccaacgatgcatcctagaacaagtttctcagcctcactgagtctcagttttctcatctataagatgggtaatcgcaaagataataatgaacataaatcctagttcataaggttgtggtgagggctaaattagagtgctgacacaaaggaaccagcacactgctggcactgaaagagctcaacaaagatcacttctcccctcactcccacctcttcctcccttcagcacagcactgtccaggaaagcaagctgctttaaaataagacatctcataacttgggagtaaactgtcactgcaaaccccctcggttggaagaggaagcatactccagaacacagattagcatcataaggatatcaataaatgcaatcaactccagcaaaagcagcatcggatactctcgctgatcttcacgctttgagggcccctggtgctgctgggtgtggtgcacccttggggaaggacgagggcccctgggtgctgctgggtgtggtgcatccttggtgaaggacgagggcccctgggtgctgctgggtgtggtgcacccttggggaaggaccacagaaaatccaggtccctaggactatgctcagtgctcttcatacgtttaattctcacaacaaccctgtgaggcaaatgccattattcttattttacagttgaagaagctggaattctgagacaactgacagacaggacattattgagtctgaatctgaacccaggatccagcacttcccagcgcctcccatggaggaggagaaggtgaatgctggattctcggtcttcggggcaagcttctgagcacaacaccgggggacacaaatttgtcaggggagaactcaaccaaaaccacatacacagatcatgggcggggacatccctcctccctccatccctccctcctcccggctccaggaccattctcagcgtgcatcgagctacataccgtacatctcgatggagaaatgcatgataccaataccaagaaatgttagagaaaggaaaatccaaaatgactaggaaactattttcagaaaggagaaaaaaaaaagttgcagctgggcacagtggctcacacctgtaatcccagcactttgggaggccgaggcgggcggatcatgaggtcaagagattgagaccatcctggccaacatggtgaaaccctttctctactaaaaatacaaaaaattagccgggcgtggtggcaggcgcctgtaatcccagctacttgggcggctgaggcaggggaatcgcttgaacctgggaggcggaggttgcagtgagccaagatcgcaccactgcactccaaggctggcgacagagcaagactccatctcaaaaaaaaaaaaaaaaatacccaaaaaacaaaacaaaacaaaacaaaaaagttgcctatttaaaactagggctgcaaacacagggcagcagagatggtgagccaccactgaccagcagctccccttgaattgatctgaacgcattcatagggggcttgctttagagatgcagatgactctggttggcaggaggtgccattattagaaaaagctcattattagaatgcctagatgagaagctcacttcctcttttggtgcaaaaaggttaggaagaaaccagaactcaccatttgctctgatttttcagctttgtctttgatatctttgattttgccaaagagttgttggatagctttctgagcctcttcaagcgcctagagtaagggaaatacatgaaaaacaaaaagtggctagagacagctccagtcactaactgtaatcaatgctaggcacaaaagaaatttccatgaagctctcctgattcattgtacttatgccaacaatttttctggaccaaaatagtagagacctatagagtccagtggctgcgaacaggtaaacactcgggactcttaccaatgttcctcacaaagtttcaacttaaaactaaatgattcccctctacctcagtcattactgtacatgttattgataacagcaaataggacaagtagatctctgtgtgtgggtgtatgcaaagactcacacagagggacaggggtagctctaaattggggcaagggaaagctctggacttggaagttccagattgtgcattcaaaaaaacctgaaccgtgaatggggactccagaactgcaacaaatcttaaagactttcatagtaagccatttgaaaaccaatgaaatgcacttagaaaggaacactgggccggacacagtggctcacgcctgtaatcccagcactttgggaggccaaggcgggcagatcacgaggtcaggagatcaagaccatcctggctaacacggtgaaaccccatctctactaaaaatacaaaaaactagccaggcacagtggcacgcacctgtagtcccagctactcaggaagctgaggcagaagaattgcttgaacccgggaggcagagcttgcagtgagccgaaattgcgccactgcactccagcctgggtgacagagcgagactccaaaaggaaagaaaagaaaagaaagagaaagaatgaaagaagaagggagagaaagagagacaaagaaagagaaagaaagaaagaaagaaagagaaagaaagaaaaaaagaaagagaaagaaagaaaaaaagaaagaaagagaaagagaaagaaaggaaggaaggaaggaaggaaggaaggaaggaaggaacgaaggaaggaaggaaggaaggcaggcaggcaggcaggcaggcaggcaggcagaaagctaatggtggctcacacctgtaatcccagcacttcagaggctgaggcaggaggattgcttgagcccaggagttcaagactagcctggggaacatggcaagactcggtctctgcaaaaaaaaaagttagccaggcatggtggcgcacaccagtagtctcagctacttgggaggctgaggtgggaagattacttgagcctgggaggtcaaggctgcagtgaactgtgatcatgccactgcactccagcctggtgactgagcgagatcttgtctcaaaaaaacaagcaaaaagctaatggtgagcccagcatttccactgaaataaaaacctacaaggacagatgctacacaatgaaagtattacaacacagctgcagcttctgctaggaggggaagcaacatgagggcagttgtgacatgtggagaccagaaagttcctgtgagtgccagcaggccacagacgtgtacagaccaaatgcactggaccgtccgtgagtaaagactacccacagctaaagtacctgtgagtgccagcagcccacagacgtgtatcgaccacatgcactggaccatccgtgagtaaagactacctacagctaaagtacctgtgagtgccagcagcccacagacgtgtatagaccacaggcactggaccgtccgtgagtaaagactacctacagctaaagtgtctgtgagcgtgtcagcaggccacggatgtgtatagaccacatgcactggactgtccgtgactaaagactatgaattcctgaggcagttatagttctaggcacgagtcagcatctccttaattcactccttcaatcactcaatgagtatttactgaatgcctcccatataccaggcatgattctaggcattgggaatccaatggtaaacaagacagtatggtctctctctctgtcctcaaggaatgaacttactttgagaagtaagggggaggagatcctggaaaaacaacaaaataaagaaacaagataattcctaagtgtggtgaattgacaggtgtggtgaaggacttatgcagtgatgagaataagggagatggtggtcacagaaggtctcctgagaaagggcacacaaatcgggacctgcaggatgaggaggtgtgagaatttgtagatttggagtaagatgattttttttttcttgagatggagtctcactctgttgcccaggctagagttaagtggcgtgatctcagctcactgcaacctctgcctcccaggttcaagcaattctcctgcctcagcctcccgagtagctgggactacaggcacctgccaccacacctggctaattttttgtatttttagtagagacggggtttcaccgtgttggccaggatggtctcgatctcctgacctcgtgatctgcccgcctcggcctcccaaagtgctgggattacagacgtgagccgccgcgcccagcctggagtaagaggattttcagcagagagaaaagcaaatgtgaagatcctgacagagaaaagacctcggtgttttggaggtccgaaaagacagacagtaggtggtagtgcaatattgcagcgggaagtgtctggaaataatctggagaggtgggcacgagccagagcacggaggcctcaaagcataaggattctgctctaagtgccaatgagaagccactgaagggtctaaacaagggacagatgtatggcttacttgtataagactgtcctggctgctgtgtggcaaaggggctgtgcaggggcaggagggaaagcgggagtgaaagctctgtgagaagttgctgcagtgtccacgagacggtggaggcctagaagaggcagccggtgctgacgggaagacgccgagcgattcagggtttccaggaaggtacaatgtgtaggactcactgatggactgtgtgtgggtgatgagggagagggagaaccaaggatgacgcccgggttttggttgaaaagccaaggccagggttcactgtctgaaccagggaatgcaggaggaggacgggcttgacaggcaggtgtgtgtggtggtggcggggctggaagtgaagagtcccatctgcaatacgttacgggtgcctgtgctatggctggaatgcatccccaaagttcatgtgttggaaacataatccccaatgcaatggtgttggcaggtggggcctttacgaggtgaccaggtcatgaggggtttgccctcacgaacaaatgaatggcattatctcgggagtgggttcttgataaaaggatctgttcagccactttctcgtgcatgcacacactttcttgccttccaactctgccatgggacgacgcagtgagaaggccctcgccgcaggacgacatggtgagaaggcgctcgccgcgggacgacgcagtgagaaagccctcgccgcgggaagatgcggtaagaagcccttgcctgatgtgggccccttgaccttggacttcccagcctccagaattataagaaatctcttttctttataaatgattcagtctgtactattctgttacagtaacataaaacagactaagaaaactggtatcaagaagtgggctactgctatagtaaatacctgaaaacatggctttggagctgggtgatggacagatgtggaacagtcttgaagtgaaggctggaaaaagcctgtattgctgtgaacagagtgctaagggggattctgctaagggctcagaagaaaagcagaaatgtagagaaagtctggaacttcttagaaattacttcatggttgtgaccggagtgttggtagaaatacagacagtaagctgggcatggtggctcacgcctgtcatcccagtactttgggagcctgaggcgggcggatcgcctgaggtcaagagttcaagacagcctggccaacatggtgaaaccccgtctctactaaaaatacaaaaattagatgggcgtggtggcgggcacctgtcatcccagctactcgggaggctgaggcaggagaatcacttaaacccaggaggcggaggttgcagtgagctgagatagcaccactgcactccaacctgggtaataagagcaaaactctgtcccgaccaaaaaaaaagatagcttacttgagatcaagtagagacattaagttggacataagattctggagcttggaagagaggtgataggttgggatttaaattcagaagtcattactttagagatgatatgtaagtctgtaagattagaagtcacctaggaagacagaatacacaagagaagaaaagatggcacagggctgacccttgggcatgccaatattcagaagtctaaaataaaaaaaagcagagatgcagagaaaaaccaccagtgacatgagaaaaaatcagggacgatgggtgttacagaagccaaacagaagtgtttgaaggagaaggaaagagtgattgtgccttctgttgttaaacactcatgtaagaggctgggcgcagtggctcaggcctataatcccagcactttgggaggccagggcgggtggatgacctgaggtcaggagttcaagaccagcctgaccaatatgatgaaaccctgtctctactcaaaatacaaaaattagccgggcgtggtggcaggcgcctgtaatcccagctactcaggaggctgagacaggataatcgcgtgaacccaggaggcagaggttgcagtgagccaagatcgtgccactgcactccagcctgggcaacaagagcaaaactccatctcaaaacaacaacaacaacaaaaaactcatgtggatcatgaggtcaagagtttgtgaccagcctgaccaacatggtgaaacccctgtctctactaaaaatacaaaaattagccaggcatggtggtgtgcacctgtaatcccagctactcaggaggctgaggtaggagaattgcttgaacccaggaaacggaagctgcagtgagccaagatggtgccattgcactccagcctaggcgacagagcaagactccatctcaaaaaaaaaaatgaagacagctgctactgattttgacaacagggaagttgttggtgaccttgacaagagcagtctcaatgcagtcaagggaatggacagcgatgacatgaagtagaggctgtgatcacagagcaggccacaaatgatggcctgtgggctgaagccagtctgccacgtctgccacctgtttttgtaaacaatgtgtttttggaccgaaactcattaataatacttaaaccaaactcatttgtttaagtattgtttatggggacttttgccacacaatggcagagataaatagttacaacagagaccatatggtcagtaaaggctaaaatatttactatccagcccttaacagaaagcttgctgaccctggtatagactttttttttcaagaagtttttgctatgagaaaggaagaaaaatagggcaaaagatggcgtaaagggagtaatttttaaagatgagaaatgcttgcatacgtctgcttgggagtgatttagcaggagagaaatttatttgggggggcaatgggttaattacagaagaggactgttttaaacataatgttctggggggggcaatgggttaattacagaagaggactgttttaaacataatgttctggggggggcaatgggttaattacagaagaggactgttttaaacataatgttctgcggagggggcaatgggttaattacagaagaggactgttttaaacataatgttctgggggggggggcaatgggttaattacagaagaggacttttttaaacataatgttcttgaattgtttagtgcaggggaccccaagccctgggccgtgggccagcaccagtccgtggcctgttgggaactgggccgcacagcaggaggtgagcggtgggcaagtgagtgagcatgatcttctgagctccccctcctcagatcagcagcggtattagattctcataggagcgcgaaccctactgtgaactgcacacgcgagggatctaggttgcaagctccttaacagaatctaactaaggcctgattatctgaggtggaacagtttcatcctgaaaccatgtccccctccctggtccatggaaaaactgtcttccaaaaaactgctcgctggtgccaaaaaggttggggaccactggtttagtgtatgagtattagccctttagcagggttataagtatcctttagaatggggaccaaggatatgaacagcactcctatagagcccatagctgagccaatcatccatttggtttaccggggacacgctgcgtttatgattcagtatagttattaacagctccctctccttctcaaagtgactctggtgataaatcatatggtcacctcacctacagcacctaagcaaggctatggcacagtgggaccttgacaaatattgcccactgattaaaagtatcatggtgcacctgtaagagtgctggtgctgaggctaccgctctgaataagtgcgctcataaccattcctctaacttcaggcccaaccatgagcagtggttcaaaatcacagcttcatgctttctgtaagtattctctatttggcttaaacagagtctaatatccaagatgctacatgggatcagtaaattctaaaaaagtttcaatcgtggagtaaaaagtgcaacagaggcctctgtaggcaactgaccactagaaaggactgatctttttcgacacagctcacatggaattctgtgatactgcaggtcatgtcatgttatggtgacatgctaatgggaccatagctactgtgttctagacaaacaccctaaaacatatgacatgcagctaagaaaggcaaaaaaggggctaagttatacacttaggtctcacatatgaagaagtctgcatgatcctatctcagagaaagggtttctatccctttctctcttacattaaacctggcatcctaccagaactgtctctgctgaaggtatcgcttttttcttccagcaaacaaataagactcacacaatcttacatgtcacagtctccaagatagataaactatgtgccagacttttttcgggctggaatacttttgcttgttttaataaggtactgaagttggggaaatgtactataattcattttgcagagtttaaaaactcctctgaagcactggtgctatcaggcaagtccattctcaacacacaccctaatatttgacatctaacctctgatcatgagtcatatagaaagattgttttgcaactggaagaatcatgggtcctacaagaagttaaggtttttttaagaaacacaaaaataccttcactacctggctaatcagaaatgtgctgaaagaatcactctggcactgtccctagacactttttaaaataaaaacgtggttggccgggggggcagtagctcacacctataatcccagcacgctgcaaggctgacggtggattacttgaggccaggagttcaagaccagtctgaccaacatgacgaaactccgtctctactaaaaatactaaaaaaattagctgtgtgtgctagtacatgcctatagttccagctactccggaggctgaggcatgagaatcacttgagcccaggaggcggaggctgcagtgagccaagattgcgccactgcactccagcctgggtgacagagacatactctgtcttaaaaaaaaaaaaaaaattaggccaggtgcgatggctcatgcctgtaatcccagcactttgggaggctgaggcaggtggatcatgaggtcaagagatcaagaccatcctgcccaacatggtgaaaccccatctctactaaaaatacaaaaattagctgggtgtggtggcgcatgcctgtaatcccagctactcgggaggctgaggcaggagaatcacttgaaccagggagtcggaggttgcagtgagctgagatggtgccatcgcactccagcctggtgacagagcgagactccatctaaaaaaaaaaaaagaagaaaaaaaagtaataataaaaaaattaaaaggtggctactttccattccaagctgtatgtggattaaaaacagaactaatcactcccaaaaatgtctgcatttaatctaccccactagagtttctgaacggagcactggagctacagcttacgtctaaaggtgttataaagcagtgactgttgtggccctttttaggactcaaattctatacacacacagcctgcatcctaaagtgttataaagcggcgactgtgtttaatctgcccctactggagtttctgaactgggcactggtgaactgggcactggtgaactgggcactggtgaactgggcactggagccacagcctgtatctgacggtgttataaagcggtgactgccgtgctcctcttttaagactcaaattctgtaaacaggagatgaaaagcaacccactgaattagcctagaaggctcagcaaaaccaattccagcatctttgtatttctgtgcatcctaatggtaaccactactctgaattctccttgcctcctggaggagacggtgagcaggctctcaaagccacaggaggtcacgtgtggaagataaggagtatggaacctggcacagactctcctgctttcttctttctctttttcctttttttgcagaactgttgtctgccacgttagtagacagaggggctctgattcattggcagtgccttaagaaatgagcatccctctggctctcaggtccatctaattttgcagtctgcgccatcagagaatgatgctgcctttatcctgtgagtccgcaggcagcctttcagagattttaaaccgagatcccctttgtggccactgcaggaaggaggaaaggttgttcattttccgaagagctggtatggctttagactattctgtgaaaaaataaggtgctattattcacggttactggggagaaaattagatttttccactattttgctaccatttctgttttccaacttgacatctatctgctggttcccttttctattatatggaaaagcaacgtgctgggccaggtgcagtggctcacgcctgtaatcccagcactttcggaggccgaggcaggcaaatcacctaaggtcaggagttagagaccagcctagccaacatggtgaaaccccgtctcttctaaaaatacaaaaactagccagccatcatggtacacacctgtaatcccagctactggggaggatgaggcaggagaatcgcctgcacctaggaggtggaggttgcagtgagccaagattatgccactgcactccagcctgggcaacagagtgagacggagaaagaaaagaaaagaaagaagaaaggaaaaggaaaagggaagggaagggacaaaaagaaggaaggaagggagggaggaaggaaaaagaaaaaaagaaaagagagacaggaaagaaagaggaaagaaagaaagaaaagaaagaaaagagaaagagggagggagggagggagcaacatgctgtatgagttacaagcaagggattttcaactagcagactgggattcaaaccttggctctgccagttactgtgtgatttctgtcaagcctcttatcctctaggaagtagtttcataatttccagaatgcaaattctatcagctacctgaaaggtagtaaggaatgtgagagtagaaaatatgtttggaatcgtttacccaacactcttcccctccgcatgcgaaatcttcctttcaccgtgtttctacagagtctgctgtccaagagctgaccaggccctcgttggagcagttttcccatgactttttttttttttttttgagacagagtcacgcttcgtcgtggcatgatctcagctcactgcaacatccgcctcctgggttcaagtgattctcatgcctcagcctcctgagtagctgggattacaggcacccgccaccacacccagctaatttttgtatttttagtagagacggggtttcaccatgttggccaggacggtctccatctcctgacctcatgacccgcttacctcggcctcccaacatgctgggattacaggcgtgagccaccagaatgagaattgggaaaaagagtttgtctttcgcgggtggtaggagtcccaagaagtgaaactgagttagagagcagctaggttccccaggaagggcaggaggctggactacaggtagagatgatgagggtgacacacacacacacacacacacacacacacacacacacacacaatctctctctcacacaatctcaatctctctctctctctctctctctctctctctctctctgagctttactcccgtctttggcttcagctgtttgacaagcccagctgagacgctatccttctggcggtcacacttgttgaacttcttcaaacgagacacaacaggatccttccaaataatcccccttttgcctaagcccgtttgaattgggatttttgtcttctgcaaccaagagagtcttgaatgagtttataaagcactcagctcacagaaagtgctcacttaatggcaactattagtattcccacatctcctagatggagtaggatatttcagatgagactaccctctaagaatcagaggttgttactcatcttttagagctttgtaaataagatggctaagttcagtatctgcaggcagactcagaagaacggctcatggattaagaggatggaatctttgaaccatgctgaaaatgagacattctccagaaaaaaattgaagtcttttgttcattcattcaattaaaaagtgagtgcctattacatgtactgtgctagatactgagagaaaaagatcactagctagggaatgtatctttaaagggcttgtaaggaatacatgtctgaattatacacaaaatgatacaaagagcgatgaataaagaatggcagcggccgggcgcagtggctcacgcctgtaatcccagcactgtgggaggctgaggaaggtggatcacgaggtcaggagatcgagaccatcctggcgaacacggtgaaaccccgtctctactaaaaatacaaaaaattaaccgggcgtggtggcgggcgcctgtagtcccagctactcgggagacttaggcaggagaatggcgtgaacccaggaggtggagcttgcagtgagccgagattgtgccactgcactccagcctggggcacagagcaagattccgtcgcaaaaaaaaaacaaaaacaaaaacaaaaaaaaaacaacggcagcatcatttcgaaagccaggaggtcctccagagagcagaaacatggatgagtgctaccacatctgataagccctacacggaagccctcaccacatccactgagggtggacaccaagggtcaagtcgcctctctttagagaaagtctcttcttttgttactgctgaccaccccggcatcactgagagctgttgctatggaaacgaggtatccccagctgaaacagaggtgcttcagccagcctcagcaatgctaacaatgcagcccgctctccacgacggtgctcaacagcagcagaggctgcgggactctcacacacccagcctcagcaatgccaacaacgcagcccactccccatgatggtgctcaacagcagcagaggctgtcggactctcacagccacagatggctgcacgtctacagctctttgcttccctacgtgtccgagaactcaaccaggactgccctggtcaaatgccagatggcgcccatcagatgagaatcactgatgtttacacaaattcctccacaccacttaggaacctggagtataagaaggctttatttaaagcacagatttctttccaagtttgtgaaccaaaaaccaaaggactgtaaagagcaaacggagtaattctcaccttgtttgttaaaatgttctgttccatgtaagttacttttatttatgatttctgcaaaccaaagccactgaaaatgtgaaccaaagagctcatttttgttgttttcaggagacaagccagaaattaaaatcacaagacgaggctcggaaacaaattcagcagtgcccaaataagactaaacatttacattgcaaagttctgcctatatctgttatcacccctaacttaaaacaagctagccctgaaatagctgcgagtgacggatgcgttcatgcagcttcctttgacgaaaggtaaccccggaggatgagagcatttcaagcaacacctccaagtggcaaaagacaaggaaacgtttaagcaaaagtttctgctgcttttgctgaatgaaaggtaaagaaattcaatatttttggaaatggggcacattaaaaggaacaacttgtccaagtttaacaaaggactacttttcccaaatagccaggacttccagttgccaagttcgaggttattgacttcattctaattccccatatcttactattacttctcattttagtcacttcataactctcatctatatcgtaagtcttcattcaggagaaaacatccttttgcgtgacatctggatgttccctcagctgactttttgagacaccttctgtgccaaatgcccttcaggctgcgaggattcatctgtgtgatttttttctcttcctggttcgcttactctctttagggcctcactggtgtctgtattttcggcagcacaggtgtgcagaacacagagagttctcttcaacctggggttcttctctcagtccagtttcttcgtcatactgagggggaccaagctggctaatgaggccatggtcactgccattatttgaaattccttatgaatcagccttccaggctccacagcaaaacaggtggctcccaaatctgcttttaaatgtttgtcactgtttaaagataatttagtatggacaagtatgcagcatactgcgaatgagaaaatctgggtctgtgattaactcgcttcgtgtgattttgggcacgtcacagaactgatgcgggccatctcttcatctgtaaaatggggagaacagcatctacgtggcctaattcacacatctttgtaaacatgtgaatcgagtaaatcaagtaaagtaatatatgcaacaatattttgcaaggtaaacatttatagtgtaataaaacattagcattacagatcaagacaaatgactcaaaatgttatgttctgcaaaagcaactgaaaatgtgtctttgcttacagtgaatgaatcaagaacagatcagccttaaaacagtacatccttaattacagagatctggaaaattccagggctgacaaacggtcctagaacctgcccacaagacactagttaccagaaatctctaaagactagaatctctaagtcttcaatgaaaaaaaagtttaaatttctgacttattagaagtagcactttgcctagctgataattctacggttatcacggaagtaggagagggctgtctgtcgcgaccgttcccttgtgactaggaacaagaaaagctcaagtacaacaaggagacaggagttaagaattcggtctgagatggggtaaagacccctcaaatacaccttttctcctgctttaaagacagaatttgaatcatcaaacttacttggggccaggtgcagtggctcacgcctgtaatcacaacactttgggaggcagaggcgggcggatcacctcaggttgggtgttcgagaccagcctggccaacctggtgaaaacccgtctctaccgaaaatacaaaaattagccgggtgtggtggcaggcacctgtaatctcagctactcaggaggctgaggcaggagaatcacttgaacccaggaggcggaggttgcagtgagctgagatcacacctccatcctgggcgacagggcgagactcccatctcaaaaaaaaaaaaaaaaaaaaaacttacttggtagtaagtatatctccagaagaaatgcccccctccaaattgggggtcattatgaaagtggcactaatacatttttgcctaacatccatattccaggtatcacatacaatacctagaaacgaacacagcatctgttcagagtctacgatgcaatacagaaacagaaattagaaaccccggcatgggatccaataatatacggaggacgacaagtttctgatgtattttagagctttaatctagatgactacaaaacgccaagccaaaacagatgtattatctttggttttgcaaaactaatctccttccagaggagaccctggagtccaaattggagcaaaggaaattttatagttacagactcttgaaaatggagacttacacatggaaatggtgacggcacaaccacaacgctgaatctgtgctcttctaaatactgtttccgtggatgaaagagggaagaggaaaaaggaggccaagttcttccatgaagacagaaagccaaattcccatccattgtacaaacatatctcagtgacttcttgtatcaaggacctgaaatccagaaggctttgctctgttggcagtaattccgcaatttttctaatgcacagcctcaaactgaggatggaattttccttacacgatttctaactactagcaatcaaaagcaagagtgacctgggtactagccagagcagttacagtggtgatgaatggcattttcctcttgagacgcagagtctagtttaaacttgtgactgcctctaacatggaaataagcagatggtgagttacgcttgaccttctttcttggctcctgaagactgccagtttatatggagatggctcagaagaacctgccaatttatatggagatggctcagaagaacaataaacttcagtgttctttcttggcgcagtattttcctaaaactattttcaataatcatgttgcagaaaagcgggacttggcgtttctaaggtcaggaaggaaacagtccaactgctggactagttaactaaataaaagaaaaaatcagggtggttttttttttttgtgggagagaacatctccatgagtaggcactacatacaaaagcttaagattcttgctaatcagaaacatgttgtctatattaattaaatgaagacaaaacagaacgcttgtgttaatgcacctgagtctatggaaagaatgaatctatgaaagttcagaacaatatggaaaaatgtttctaaagagattaaatattgcaatgattaaaaattaccatgtgacccagcaattccactcctaggtacacagcataagggacggaagcagaaactcaaacaggtatttgtatgccaatattcatagcatcactgttcacaaaagccaaatggtggaaacaatccaagtgtccatggacagatgaatggatacacacaatgtggtggaactacaccacggaatattattcacccgtaaaagagaagaaagtgctgatacatgctacaacgtggatgaatcctgaagaccacagaagtgaaatacaccagatacaaagggtcaaatattgtagaattccacttatattaatataaagttcccagaataggcaaattcatagagacagaaagtaaaatagaggttacaagaagttgaggaaagtgggcaggggaaggaaggacttaatggttttaatgtttacagagtttctatttggggtgatgaataaatttcagaaatagtggtagtggtggttgtacattatgaatgtaattaataccactaattatacacttaaaaatgttaaaataataaattctatattatatacatattttacaaggtttaaaaaataatgtaatatcaaaaaccactgaacagtatactttaaatagatgaattatatgtgaattatagctcactaatgctgttaaaatatagccatataaaaaattgaaaaaggttatatttactaaaatgaaatttaataaaatttttaaaagcatcatcaattacaccaagctacttgccaagaaaaaaaaccaggccaggtgtggtggctcacacctgtaatcccaacatttaaaaggctgaggcaggaggtcgcttgaacccatgagttcaagaccagtctgggcaacacagcaaaacccggattccacgagaaatacaaaaaaaattagccaggcgtggtggcgagtgcctgtagtcccagctactcaggaggctgaggtgggaggattacttgagcctgggaggtcgaggctgcagtgagccatgattttatcactgcactgaagccgaggtgacacagccagaccctgtctcaagagagaaaaaaagccaggcccggtggctcacgcctgaagtcccagcactttgagaggtcaaatgaggcaggcggactgcctgaggtcaggagtttcagactagcctggccaacatagcaaaaccctatctctactaaaaatacaaaaaaattagctggacatggtggcgggcacctgtagtcccagcttcttgggaggctgaggcaggagaatcgcttgaacccgggaggtggagactgcagtgagccaagatcaagccactgcactccagactgggtgacagagtgagactctgtctcaaaataacaaaaacaaaaaacccataaaaataaaaacaataaaaattcttttttattttttttgatacagagtctcgctctgtcgcctaggctggagtgcagtggcacgatctcggctcactacaacctctgcctcctgggctccagcgattctcctgtctcagcttcccgggtagctgggattacaggcatgtgccaccactcctggctaaatatatatatatatatatttttttgagacagagtctcgctctgtcgcccaggtagagtgcagtggcatgatctcggctcactgcaagctccaccccccgggttcacgccattctcctgcctcagcctcccaagtagctgggactacaggcgcccgccatcacgcctggctaatttttttgtatttttagtagagacggggtttcaccgtgttagccaggatggtctcgatctcctgacctcgtgatctgcccgcctcggcctcccaaagtgccgggatgacaggcgtgagccaccgcgcccccgccattaaaaattcatttttaacactcaggagatgtggccaaagtggcattcagagaaaagccgtacctttaagcgctcttcttacataacaagaagtagaaggagcataaagacaacagagatgaaagcagtaaaatataaaggtacagagtaatgaactgaaacaggaaaagaggagaactgacaaatatatccaagtgcaagtcctctgagaaggcctaaagaaattctggctgttttaatctaggattgggggtgtgggaaagagaaaacataaaattaagaatgaaaagagaggccagatgcggtggctcacacctgtcatcccagcacattgggaggccgaggcgcgcagatcacgaggtcaggagattgagaccatcctggccaacacggtgaaaccccatctctactaaaaatacaaaaattagccaggcgtggtggcggccacctgtagtcccagctacttgggaggctgaggcgggagaatcgcttgaacccaggaggcggagcttgcagtgagccgagattgcgccactgcactccagcctgagcaacagagcaagactccgtctcaaaaaaccaaaacaaaacaaaaagaatggaaagagaatataaacagagaattggaaaggatgaataaacttaaacatctgagtaaaattattttcaagaacaaggacttactaaaatcaactcaagaagtggaagatgtaactataaccacagaaataacagaaaaggctgccaagaaaccaatctcccaaaaggcacttgaccttgataatgggtcaattgtttcaaagacttcagggacttcagggtatattatctatagtctgactctctgaaacagtttactatttaaatggtctctgcggttgcaaaaaatgggaagcatcccagtttgttttataaagctgacaaaggtcaggcatggtggctcacacctgtaatcccagcactttgggaggccgaggcaggtggatcacctgaggtcaggagttcgagaccagcctggccaacatggtgaaaccccgtctctactaaaaatacaaaaatttagctgggcatggctgggcgcggtggctcacgcctgtaatcccagcactttgggaggccgaagtgggtgaatcatttcaggtcaggagttcaagaccaatctggccaacatggtgaaaccccatctctactacaaatacaaaaattagccggtcatggtagcaggcgtctgttatcccagctactcgggaggctgaggcaggagaatcgcttgaacccaggaggcagaggttgcagtgagtcaagatcgcactactgcactccagcctgggtgacaaagcgagattccgtctcaaaataacaacaacaaaaactgacataaacccgatacaaaatctaacaatgataaccaaaaagaagaaaatgtcaaactaatttcattttttaacatgaatcaaaatcccagataaaaatactaggattcaacaatatatttaaaagacaatacacgatgacccagcaagcatttatgaaaggttaaatattttaaaaagaaggaaaaaaaaacttaaacaaatcaacaacatgaaaaaacccctatgactatattcagtacatgctgagagggcatatgataaaatccaacgtctattttctggcaaaagtgcttagtgaccaagattgtgaagatctctccttaacagtcaaaagaatcgggaaacaagacaacattacacttggtgtcagctccgggagagaagtgtcttttgcttttttcattgtgtaattctcaatgcttaaaatagtgccaaccacacagaaggcactcactaaatatgtactgagtgagcaaatgaacagatacactatgtaaagtgcctgtcattaaaatcaagaacaaactgcctgccattcccactcttagctgatcctaaagagcatttctaaaactttttgacctcagaatctctttatacccttggaaatttattgaaagggtttatgtaggttatatctactgacatataccaatgttggagattaaaactgaggagtttaaataaaaaatatgtatctgttaatccatttaaacatgacaatgataaatatattacatgttagcataaattacatgttttttgaaaaataactatattttccccccagacaaaacaaagttgtttttttgtttgtttgttttttgttttctgttttgagagggaatattgctctgttgcccaggctggagtgcagtggtgcaatttcggctcaccgcaacctcagcctcctgggttcaagttattcttctgcctcagcctcccgagtagctgggcctacaggtgcatgccaccacactcagctaacttttgtatttttagtagagacatggtttcaccatattggtcagggtggtctcgaactcctgacctcgtgatctgcctgcctcagcctccccaagtgctgggattccaggcgtgagccactgcgcccggcctacaaaacaaatttcttgagaagcgtggcactgctggggtgtctctgcaaaaatctttagtgtctgctctgataaacaccagctggactcccatacacgcttccatattgaatctgttgtgatctgttgttctggttgaaaatatgaagaaaatctggcttcacatagatatatgtagttagaaaaggaagaaatactttaatacccaactctttgtctatttaggctgctattaatataaccaaatactttaaactgggtaatttctaaacaacagaaattgttaacagtcctggaagctggaaagtccaagatggaggcaccaggagatctggtgcccagtgagggccctttcctcacagacggcatcttctatgtgtcctcacatggggaaaggggcaaatggccatccttcaaaagtcttttatgaggacactgatctcacagatgagggcagaccccttgtgactcagtcacctcccaaaggccctgcttttaaatcctgtcacaatagggattaagttccagcataggaatcgtgggagataccaacattcctgtgctgtgacatgctgttttggttgaaaatatgaagaaaatctggcttcacatagatatatgtaattagaaaaggaagaaatattttaatacccatttcttagtctattcagctgcaattcatagaacagaacactttaaacacagcagcccttttcaggtacttggtgataagccttttttaaactacactaaaactcaaaaagtggtagattcttgaggattagctgcagtgtgggatttgaaattgaattaatgaacttgccatactatatgctgcatgaaacccgctgatcagctgtgcttctgccgaggatgcagaaagcagaaagagtgctgctcttacactaacaaggaggaaaacggaaactgaaaaccacaacttttcttgaacctagcagagagctaaaggtaaccaagcatcctgaaatccaagaaggaaggtgctcccccaggaaagacaggacaggagaaccgtctccatgtagaagggcatgtaaggaagacgggggtgccacacaagcaggcgagagggctgaaggaaagtttttaacaagttactaaaggccaagtgtgggctggcgcaatggtagggaggcctggaaagtgtaagcacaggtgggtttgcacccactctcaggctcttttccaagaccttcactgggtgttcatgaggaaaaaatgggggcactctctcctcttctacacaaaatgcctggcattcaataaaaaattttaagacatatatacgccaaaaaagaaaaaaaagaagaaagggaagaaaggaaaagcacccattgttaagagacaaagcaaccaacagaacctgtctcaaagaggagccatttggtataaatattagataggctacagaggaggggattttaaaataacaatgaataatatgctaaagaatctggtagaaaaggtgttttacctgcacgaacagatgaagaattgcagcagagagcaggaaattataagagtcaaatggaaatgctagaaaaaaggacatggtgtcagagctgaagaattccttcaacagcctcatcacactcgacacagcaaaaaaaggattggtgaactttaaggtgggtcaatagaaagtacccaaactgaaacacaaagaggaaaaaagaaaagaaaatccaacacctgcaggacagtattaaatgttctaaaacacatgtaagtagaattctaggaggaagagagaacacaacagaaacatttgaagagataatggctgagaatttttttttaagtgaaaggcattaaaccactgatccaagaagtgctgagatcccaagaggaataagggttgacttctcagaaacaatgcaagctagaagacaaagactgacatttttaaagtactaaaaaaaaataaaacaacaaaactgccaacctagagtcctaaaccaagcaaaaatatttttaaaaaataaaagcaaaattaaaacttttcaagcaaagaaaagctgagagcatttcttgccagcagaccgtgttataagaaacactaaaggaagttcatgaggcagaacaaatatggtacagaaaaaactcagatctaaggagataaaaatgagatctatgtgaggtgacaaatgccttcatttgcttctctgcaggctattttactgtctttatgtatcctataacatgttatacaccttacatatacacaatacaatttacttcttcaaacataaaataaaatagctgggtgtggtggcacacgccaatagcctccggctactcaggaggctgaggcaggaagatcacttgagccaaggagtttgaggccagctcaggcaacatagcaagaccccatctctaaaaatataaaataaatgtagaaacttgaaaactgacaaacaataaaaatatttttaaaatttatttttaattactctaattagcaaaaatagcaacagtgatggtgttcataatacgtaaaaacaagatgtggggcagagtggaatgcagagaggatgtgaggaagaggtcagaagcctgctatgaaaagactctcacattacatgtgaagtgatacaatgtcatcactgtgacatcagtgacaatatgactgtgataaagatgcatattgtggacccaggacaaggaagtacaagaacaaacagaaaacaagcaagatgctagatttaaatccaactatatcatgggaacaaagcaaactattcactttcaccagttttattccatatcacactgtaggtcctagccagagtaataaggcaaaaaatattttattcataggtgagatgattatctactttttaaaaatcccaaaagcctacaaaaaaaaaattcctgaaactaataagtgagttcagcaaagctgcacaatataaggtcaataaataaaaatcaattacatttccacaactagcaagagacaactggaaatttaaattttaagagataccatttataatcataccaaaaaccacaaaatatttagtataaatctagcaaactatgagcaagatctatatactaaaaactaaaacacactgttgagagaaactaaagacctaaatatatgaagaaatattccatgttcatagattggaagatttaatattgtaaagatgtcaattctccttcaattgatctatagactcaacgcaatcccaatcaaagtcccagagatttcctttttttcttttcttaaatcaacaagttggccgggcgcggtggctcacacctgtaatcccagcattttgggaggccgaggcgagtgaatcaccgaggtcaggagttcgagaccagcctggccaacataattaaaccccgtccctactaaagaatacaaaaaattagccaggcatggtggctcacgcctgtaatcccagcgactcgagagattgaggcaggagaatcacttgaacctaggaggcggaggttgccgtgggccgagatcgcgccactgcactccagcctgggcaacaagagctagattctgtttccaaaaaaaggaaaaaaaaagactaataaaggaaaacagatcccaatacctgtaaaagtcctgatgatcttggcgtaaaaactgccttgctttagagatgcaatgagagacagagaaaacaaaaagacagatgtactcaacacaaacagctggagtggagaaagcgggcagctttgagtctgagagccaggaagggaagactgcagttccaagagcctgggtctggaaaccggtgttgaacaggcagcaaaggctccctgcagtgacccaggtgtcagttccttctgttcattacaatacggcatccaaaaatacttttcttctaaaataatataccaacggccctcaacttgggatggttcaacacagaattttcttactacacgatggtgcaaaggtgagaaacattctgtagaaaccatactttgggtacccatacaaccactctgtttttcactttctgtacagtattcaacagatcacatgagctattcaacactttagtataaaataggctcggtgttagatgatttgcctgactgtagcctaatgtaagtgttctgagcaaataaatttaaggcacggtaggctaagctatgatgttcagtaaattacatgtattaataaattttcaacttaggatattttcaacttacgatgggtttatcagaataagaacttattcttcattgcaagttaagaagcatgtgtatgattgagaaaaatctggaaacaggtgtggtggcttgcacctgtaattccagccactcaggaggctgaggcaggaagatcgcttgaggtaaggagtccaagaccagccagagcaataaaggaacaccccatcactacaaaaaaaaactttttaaattaaaaaattagccagacatggtgacatgcacttgtagtcctacctacttggaagtctgaggtgggaggatcgtttgaggccaggagtttgagacagtgagctatgcacgccacactccagcctggatgaccctggagcgagaccctgtctctaaaaaaaaaaacagagagagaagagaattggctggttgcagtggctcatgcctgtaattccagcactctgggaagcgtaggtgggaggatcacctgaagccaggagttctaaaccagcctgggcaacacagtgagattccatctctacaaaaagtgttttaaaacagtcaggcatagtggtgtgcacctgtagtcctagctacttgggaggctgaggtggaaggatcacgtgagcccaggagttcaaggctagagtgagctacgatcctgccattacattccagcctgaatgacagagtgagaccctgtctctaagaagaaaaaaaagaagaatttggaagttataaaaactagaaatgaaaaaaaatctatctgcagtctcaaatttcaaaaacaatacaaataataaattctgttgtcaagtggaatgtttattttaactatagggtgatattgcatgtcacgccaggcaaacatctaatggaggtcttgaagacaggacaagagaaatgaacctttgaccaccactgttgccacagcagatattctggaccataggtaagctgtgccgccatttttattcacagagaacagcacgctgaaggcagtaaggggcctgggataattcagaacaagtaaacctggagttgctttaaagcacagcagtggggctggagaggagctgatggagctgacggaaaagccacaggaactcgacaaatacctggatgcacggaactaggaaaactgaaattccagtggactgtgtatcagcagcactggtgttcctgccatttactaaacatgagtgagcccaacattgtgcaaaaaaggtgttttaaaatacatttattctaggccagatgtggtggctcatgcctgtaatcccagcactttaggaggctgaggcagaaggattgcttgaggccaggagtttgagactagcctgggcaacatagcgagacctcatctacacaatacttaaaaattacattagctgggcgcagtggctcacgcctgtaatcccagcactttgagaggccaaggtgggcagatcacctgagatcagaagttcaagaccagcctggccaacatggtgaaaccctgtctctaccaaaaatataaaaactagccaggcgtggtggtggtcgcctgtaatctcagctacttgggaggctgaggcagggagaatcacttgaacccaggagacggaggttgcagtgagcagagatcgtaacacggcactccagcctgggtgacacagcaagactccagctcaaaaaaaaaaagccaggtgcggtggctcatacctgtaatcccagcactttgggaggctgaggcacgcagatcatgaggtcagaagatcgagaccatcctggccaacatggggaaaccccatctccactaaaatacagaaaattagccgggcgtggtggcacatgcctgtagtcccagctactcaggaggctgaggcaggggaattgcttgaacccaggaggcagaagctgcagtgagccaagatcgcaccaatgcactccagcctggagagagagcaagactcagtctcaaaaaaaaaaaaaaaaagatgcgcatggtggcatgtgcctgtggtcccagctactcgggacgctgaagtgagaggatcacttgagcccacgaggttgagggcgcagcgagctgtgattgcaccactccactctagcctgggcaacaaagtaagaccctgtctcaaaaacaaataaataaataagtggataaataaaataaagtatattaattctaatcccccctaaccctgaggtacgtattattatctccatgtcacagatggaaagttaaatatcttgtccaaggtcacacagataacagcagagacaaaatttaaattcaaagctcaagtttttttcactttaccaagatgccatccaatgttacatcactgaagatatctaactacaccaatccttagagaattgaaataaaatgcccagtccttcactgtacatagaggagagaagatagctatttggattccttatagcttttctaaaaatgagggattttagaggatacgtggcaaagtgttccaaatatgccgcagacatgtctccctgccaaaaaagcgctatcaaggtgatatgatttggctgtgtccccacccaaatccctacatgtcataggagggacctggtgggaagtcactgaaccacggggtggtttctcccattctattcacgtgatagtaagttctcacaagatctgatggttttgtaagaggcttcccccttcgctcagctctcattcttcctctctcctgccaccttgtgaagaaggatgggtttgcttccctttccaccatgattgtaagtttcctgaggcatccccagccctgcagaaatgtgagtcaattaaacctctttcctttataaattaccccgtctaaggtatttcttcatagcagtgtgagaacggactaatacacaaggcttgtgtgcaataaacaggatgaagaatggtagtgaggccaaacccagttgcactacattgttaaacagttaacggacattttatgagtccccgcctcaactacaaccagtagcactctagaagcaggcaaaatgaacagtcgcccgccccgcctcaactacaaccagtagcactctagaagcaggcaaaatgaacagtcaccggattcaacttgacaaaggcaagccaaccttgacctctgcactagacgtaagaaatcctggttgggaaatgactgtgagcccgaatcaaaactctgcccctacaaaaggctgatctaacaacccgactccagggctgccccacagatcacggtgttcagggcactcccaggtcatgtccaaacctcagcaattcctgaagtttagtgttatttgcagacatgctgaaaagtacaacgcaaaaaataataacagaaaagaaacaaaaaatgtccagccaatcttggccactaatgggaaacttcgaggccatactctaaaagctcagtcgctttagctgtggtatgttttagtaggaagaagcaagtagcaattgccatttttttccaaactatttgtggtccctttaatactaataccaattactttcttcaatttttatcaatcaatgggcttcattttcctcccaagagaggatgagagaaaggatcaatttaaagtgagggaggataagaatataaagtctccttctagtgagctgacaatgacaaattcaaaatcccacataatgaagatcaatgccatgctgggaagtcagtcttggagagcagttatttttgttcttttcacttgagacagggtccccaggctgcagtgtagaggtgccatcatagactgctgtaacctcaaacccctgggctcacgcaatcctcctacctcaaactcctgagtagccaagactataggtttgtgccaccatgctggactaatttttttttttttttttttttttttttgagatggagtctcactctgtcaccaaggctggagtgcagtggcaccatctcagctcactgcaacctccacttcctaggttcaagtgattctccagcctcagcctcgtgagtagctgggactacaggcacgcaccactgcatctggctaatttttgtatttttagtaaagcccaggtttccccatgttggccaggctggtcttaaactcctgatctcaggcgatccgcccacctccgcctcccaaagtgttgggattacaggcgtaagctaccaagcccggcctattttcgttctaatgcttgaattgcataatatgctaattttgaggaagaaaagcaaggaacactttctccttggaaggcaatgtactttgctgctttagttcataatctttatgatatctctatgtaaaagtgaagaaggcaagtattaacagcctccttttttggtgaaaatcaagacatgggaagatgaagaaacagccccggacgacacacacagacaggtagaaatcctgttttttgggtctggcactttgcgctgaagtgaggaggaagaacaggaagcctctgacggcacgtcacacggctctgaatccactccattctgccttttcatctacaacttgaatgaagacacagaaggcatgtctggcaaatctgctaatgataaagtggggaggtcatcaaggctcccaaagatcttgatgggataaacaatcgagcagaactagtgggatgaaacgaaagctgagacacacacggtctgacaatttcaaagactctcttgcacaaacagaggtggagaaagtttaaatgaaagtcatatgaagaaagacctgggacagtactggcccacagatgtgttttgtttgccctttgcagtgtttgtgaaaaacactaagccaatagttaaaaattgtgagagttacatgaaaatccggatttccggctgctcttgaaaaactgatagatctggcaattccaggtctgcgttcagacgtgacaacagctgattagaattcacttgtgactatccccttaggacctggtggatgcatgtggacacacaccagcctgcttacgccgcttaggttactttcccagctctgcggacatctgtttgcgactcttgacctgggggtttcaggtgactgccaactcagtagaagccaaccatgtaatacggctgccaaaaatctcagcaaatccaaggtaatggaagaatagtgtctaaaataaaaaatctcagcaaatccaaggtaatggaagaacaatgtctacaatcaaaaatctcagcaaatccaaggtaatggaagaacagtgtctaaaatcggtggcccttaagttttgaagagtcacagactccttagaaaatctagaaaaatcaataagttttcctcccataaatatgtctagacatacaaaaatttacagttaatttcagggacttgacagacactctggacccccagtccctaagttaatgagctcggcccagaacaaagaggtcaactgtctcagtgtatatgttgacacagcatgtccactcctgggaaccacattttaagagggatgctgacaaacagctatcaagagcaaggatgataaagggtctggaaattgcattataaagatgaagaaactaagaatggttagcctagaaaagggaacacttaggaacataatatccattttcaatttcagaagctgtagtaaggaaaagggattaggcttacacccatccagctggcagaactaagatcaacaagaagttacaatgaagtctatttcactgtttcagttcagtctaagaaaggagtttctcacaactaaagctataaaactgaactagtctgtcctgtggaccaacaaagtagcaagctccccatcactgaaagtagccaagcttctgcaagataatgaaacgtcagagatgtaatacaaaggactcctgaactgggtggaagattgtactacaattacctaatccttcttccaaagcgaaggagtgagcaatacagcaccccctccttatcagcagttcactttctgaggttttagccacctgtagttgactgtggtccaaaaatattacatggaaaattccagaaacagacaattagtaaattttaaattatgcgccattctgagtagtgtgataaaatcttgcaccacccaattctgtcctgaccaggtcacgaatcattccttcacccagtatatccatgctgaatacagcacctattagtcacttagcagccatctcggctattacatacagctccaaatcacaagaggagtgatgctggcatactgtcataattgtgctattttatttttagttattgtggtgaatctcttactgtgcctaatttgcatgctaaagtttatcacaggtatgtatacataggaaaaaatacggcatatatagggtttgctactctctgggtttcaggcatccactgggggtcttggaatgtatcccccacaggtaagtggggacgacttgtaataattctcttctcctcccaaaccttactcttgttctgatcaaagaaatggctacattgcagccaggctccattgaagagacagaaactcggtggctgatcctctcctgtgagtctgagagcttactgacgaccggtcaacgttggccactcttgaaacttcccactgccggctttttcttcctctaacccgcccctctattcacctctctttcacctacgttcaagccatccattttaattcttgggaagctgcaaaaatttcatagcataccacatcatgtacttgttgaattgactcatccacaaagttttaaacgtgggcatttaattaaagcttttgactgatgatttcaacagataaaaatggggaggattccgtgccatataaactttataagagcatcatcgtctggttagaagaggtcacagactagaccagttcaagctggcccacatagaaggtggtcaaaaaacaaagactctgcaaacgtttagcagaatgttaaccaagcggctggtatttcagaaacttcaagaagctcaagaaatgacctaattatgccttcaatatttaaatcattccttacccccaaataatttttgagtcaaaaacattgcttttcaaaagcaacttttctgctaaaaatgtcatttaagacaccatgaatgtgaagtcaacactttccccttatttacagatatagaagcacacctagccgggtgcggtggctcacgcctgtcatcccagcactttgggaggccgaggcgggcggaccacaaggtcaggagtttgagaccagcctgaccaacatggtgaaaccctgtctctactaaaaatacaaaaatgagctgggcatggtggtgcgcacctgtaatcccagcactttgggaggccgaggcgggcggaccatgaagtcaggagtttgagaccagcctgaccaacatggtgaaatcccgtctctactaaaaatacaaaaattagccaggcgtggtggtgcatgcctgtaatcccagctactcaggaggctgaggcaggagagtcgcttgaacccaggaggcagaagttgcagtaagccgagatcacaccactgcactgcagcctggctgacagcgagactctgactcaaaaacaaaacaaaaaacaaagaagcaagaagcacatctaggctgggtatagcctagcagccatctcggctattacatacagctccaaatcacaagaggagtgatgctggcatactgtcataattgtgctattttattttcagttattgtggtgaatctcttactgtgcctaatttgcatgctaaaatttatcacaggtatgtatacataggaaaaaatatggcatatatagggtttgctactctctgggtttcaggcatccactgggggtcttggaatgtatcccccacaggtaagtggggacgacttgtaataataagtgtctcatgcctataatctcagcattttgggagcccaaggcaggaggatcacttcaggccaggagttcaagaccagcccgggcaacacagcaagaacccatctctaccaaaaataaaaaattaaaaattaaaaatagctgtgtgtggtggcacatgcctgtagtcctagctacttcggaggctaaggtgggaggatcacttggccccaggagttcaaggttaccgtgaaaaatgattgcactccagcctgagcaacaaggcaggaccctgtccctaacatgataataataaatacaaatttaaaagcggcacatcggttctggttaaacacaatcaagattaaatttataaaacgaaaacctccttttgtccatatgccactcccttctgagtgttcttcagaagcttaggaagcgagtgctgaaagcaaacttctcttctcttccagggaagaggggaacgtggggcctcttgacctacaaaactcagtattttggaacatccgtaattccaccaagtctgttgcagtcaaatagactccttttagcaaaccagccagccagggctggagagcaaggctttcatacctaggagttgacaaggacaggacccaagagctccttggaaaaaaaaaagcttgtacttcagtttgcattacaaagtgctggaaaagacagatggggccatgacaggaaaagcagttatttcttctgggcttcctttctgtctggattctaaggagacgaatacaaagttccatcacagattgaaatgctatctaaacattcttgaaaatgtggtcttgctctgtgaaatacgacctgctctgctgcggcaacctgtaacctattaatacgggatgggggagaacgccgacattcctgcagactgtcgaattctgggtctgactctgtaataccgctagtttgcaagagtccagaaccacaggttgaaacgtaaataactgaaagatacacatctattatgcacagcatgacccaacaaaaaatgccgatgaatcactcactattttcacattcttgaaattttaaacatctatgactcctgcactgtaagacttctagtgagccattccaaatgtaggctgaatcacactgaacaagcagtgttactattcccagtagcagcaagttgggactcttaatgcacaaagcaagttctaaatcacttttaaggaacacccacttgctgatcaaaatgatgtttttatgataaaatgtttttgtttatttataattaataaacaatcttagacagacaaaatattcaatacagttgcataaaatgttgtgggggttttgctgttgcttttggggatggggtctcgctctgtcatccgggctggagcgcggcggcaccattacagctcactgaagcttgtactaccacacccagctaattattttaccttttcgtagagacgtgtattgctatgttgccgaggctggtctcaaactcctggcctcaagtcatcctcccacctaggcatcccaaagtgttgagattacaggcatgagccattgtgcctggctcagttgaataaaatgttattgcatgtggcctatgtgtagtgaaatagaaagatgacaaagatacagttcttaccttccaggagcttacaaacatcaaagggatgagacttgttctctggtaagtcaagggagaccccaaaagccaaatgaaaagtacaagaatggggctgtgggatttatggagaaaggacatcgagggacactggaatccattttctcctctgtaaaatgaggggaggggcccagatgagtttcaaatcctttccagttcaaaattctgattccttggtgtattcagataaggtccatggaaaacatcgtcaagaaactagtatctgagctggtccttggatgggtaagattgggaaatgcggcggcttaaagaaataggaggaaaagcatttcaagcacaaaagagtctgtaagcacaggtccagaaagcacaggcatgctcgtagagcacaaagtcttcagtgtagacagaacacaagaggaggcaaaactggaattggagaccagaattttgaatgccaagcaaaggaatttggatttctttttttttttaaacagggtctcactctgtttcccaggctggagtgcagtggcgcgatgatggcttactgcagcctcgaacttcctggctcagctgatcttcctgtctcggcctcctcagtagctgggactacaggcacaggccaccaccatgcccagctaattttgtactttttgaagatgcagggttttgtcatgttgcccaggctggccttgaactcctaggctcaagtgatctccccgcctcggcctcccaaagtgttgggattgcaggtgtgggccaccatgcctggccttggatttcatttagtggccagagctgatacggtgtctgaagaggtagacaatacgatcaaacacagattaggacagctaagcagcagaatgcagctggagtgcttgaggctgccctgtccctctgtaggacccctctgaaggtcccatttacatgggcctcatctgccaaagaagccatgcttcatgaaatatacctcaacagacaaaacgaggtaacgagggctaaaaaaaatacaggagtccagaaaaccagaacagttttaggaacctaatgtgtctacacacaaattctgatgatgacaagaaggccagctactcacaaacaggccaaaggaaactggctatcaaatggaaagtgactataaagtggaaaaatggaaaaagaaagtgatataaagtagtaaaaatagacagatgggaaaactacagatgtaaaagaaagagactcctaatatctgtaagcaactggcagaaggaaacagaaatatcagagatctggaaatttcagcgtaggattatatgctcctcccactccaaatctgggcagcaggatgaacatttttagaaattagctgtcctaaaaaatgtcaaagaggagaaatcacagcattgaagcaattgcaaagaagcagtcctgacctgagttagtgctgataagggaggacaggacatggcaagagaggacggctagaaaggcaagctcagcatttctactacaacagccattctgaaatacgatgcctcaacagaagaacagaatcaaataaaaagggaaatggttcacagataacatctggcccctcaattattaaagagtatctcctccctacacacttttcccttcattgcctccaacagcctccttaactagatccagtaagacttacttcattccctccaatggcctccttaactagatccaataagacttataaaacttttttttttttttttttttgagacagtctcacccctgtcgtccatgctggagtgcagcggtgcaatctcgcctcactgcaacctctggctcctgggttcaagtgactctcatgcctcagcctcctgagtagctgggattacaggcgtgagccgctgtgcccgctgtgcccggccaacttgtaaaattttttaatgaatcttgagtcacctgcctgctggcaaagcgaggtacgaggaaatggtaactatgtcaggttactatcttttacagccacaaaatatcaaaaccccaacaactcagctgacgaatgcagcaacctcatttagccacagcccacaaaataaaagagggcacaagagatgcccgacacgaaggagaaagacaaggaagccccagtgttctcatctggcctcgggtgagcggtgccacagttcacggtcctggtccaagggacactgagggacagcacgtggctgctgtgggcgcctgccctgtcttgtcctgccatgtatgaaacggatcaatcggaaagtgctctgcaagagggcacatcgacgttttggtcatctggttgccgggagaaaccaggggagcataggtaatatggaggaatgagttacttacttgccgtccatcctgccccacgttcgtctgacctcttacaacagttcgaatattgtcatccagtctcctagcaaaacagttcaaggatacagtcattcaaataatctttattctaggttgaccaaaagaaaaaaagtaaaaagtaatttattcatcaacttctgcagactgcacctaattgtccagaaaaccaaacatgtgtgagtggcatcaggcaggaggagggcagcgacagccgtgcgggaagtcaagcccagtgcaggctgatgcatcgccttgttgttaaaaatgcctattttcacttaatagtcagagctatctgaaaggactaataaaatctgcaggatttttcatggagtacatcaggaatgacaaagttccggagcctttacgtgaacatgccagataactcaaattacctcacacacaatccctttctcggtccccttatgaggcggaaagagccagagtgatagatggaatcagtgcttccgggccctgatcatgcaatccatgcctgaggcagatctacggcttccagctcctctgcccccacggttcacaatgtttaatcatgggccaccacccaacccaccagcagatctgacatggttagctgttatgtgaccaagggatacacatataagcccatcttcatgtctaagccttgggaacacaaaaacaggtaaatccacaaaaacagggaaataaagccattaaaaagctagtcgaaggacagacagaatggctcacacctataatcctagcactttgggaggccaaggcaggcagatcacttgaggctaggagttcaagaccagcctggccaacacagtgtaaccctgtaactactaaaaacacaaaaattagctgggcatggtggtgcatgcctataattccagctacttgggtggctgaggctcaagaattgctcgaacctgggaggtggagattacagtaagccaagatcacaccactgcactctagcctgggtgacagagccagactccatctcaaaaaaaaaaaaaaaaaatctagtagatgtgggagactgaggcaggcagattgcttgagctcagcagtttgagaccagcctagccaacaaggcgaaaccccatctctacaaaaaatataaacattagcaaagtgtggtggtgcgcctgtagtcccagctactcaggaggctgaggtgggaggatcacttgagcccaggagttcgaggctgcagtgagctgtaactgcaccagtacgctccagcctgggacacagagtaagaccttgttttgaaaaaaaaacagaaaaaaagaaaaaaaaaatctatcagaaaagcttttgcctccttctataattacaaaagatgttttgagtagactctatcacagcttccttccttttgtatgaagaattgaagactggccaaagcattgagttccttgccacaaagttcatatggataaaataattatatggccgggtgcggtggctcacccctgtcatcccagcacgttgggaggcgaaggcaggtggatcacttgaggtcaggagttcgagaccagcctgaccaacatggtgaaaccccgtctctactaaaagtacaaaatttgccaggcgtggtggctcacacctgtaatcccagctactagggaggctaaggcaggagaatcacttgaacctgggaggtggaggttgcagtgagccaagatcacaccattgcactccagcctaggcaatgagcaaaaatccgtctcaaaaataaataaataaataataaaaattttaaaaggaattatattaccatctatggcaaacttgagatttcagtgctctcacagaaaaatgtgatccagaatgtgattaactaaattaacaatatacttttcattaattatgaacaatcacacagctttactcaccttattttcagcctaattttgttcacgacttcgtctatgttcgccagagactacaataaagaaggaagagtgcccagctgttagtccacttcctggaattcctctttcacaggaaaatgatgtgctataatagctacttatgaaatctcaaaaaatttaatcacatgatatgagttttgctttaaaaaaaaaaaaagtaaagcagtagttggaagctacagccacatctagcccagcccctgttttttgtaaataaagtttcactggaacacagccatgcccgttcacttacatattgcctgcggctgctcttaagctaacatggcaggtaggcagtcgtgaaagacgctgtacagccacaaagcctgaagtatttactatctggacctttacaggagagtctgctgacccatggtgtacgtgattgtgacaaattcacgtaacgaaatacagcaacaaaaatgaatgaatgcacaacaccatggataaacattttactaacggaatggggcacagaaaaagccagacacaaggggacagaggatatgatttcactaacataattctcctgttagaagctaggacagtggttatctctgggggaaggtagtgacagtgaacaggcaaggaaaggccttctgaagatttttttaaatgttttatttcttgatctgggtggcagttacatggctatgttcattttgtgaaacttcatcaagttgtacccttaagatttgtgtactcctctgtattatgttatacttcaataaatacacaaatttattttttattatatagatccactagaaaaaagtctggaaggatagataggagtaattgtaatgtattagtagttgcagcattagtagctataatctatcaactacgtattgcaatatgaaaagaagtgatttcaaatttttcttcttgggccgggtgcagtggctcacgcctgtaatcccagcactttgggaggccaaggcaggcggatcacctgaggtcaggagtttgagaccagccagaccgtcatggcgaaaccccatctctactaaaaatacaaaaaaaaaaaaattaggcaggcttggtggtgggcacctgttgtcccaactactcaagaggctgcggcaggagaatcgcttgaacccgggaggcagaggttgcagtgagctgagaatgtgccattgcactccagcctgggcaacaagagcaaaactctgtctcaaaaaaaaatattttcttctttttgtctgtattttataattattgactatgcactactactgtgattataataagcttattataacaacaattaaaacaaagggatcacttctgaccttagagatgagaaaatgtgaggaaatggtgccccctaatggacaagaggaggtacaattttatagtactattttaattcaagttttcaaaatacaatttaataaatcctcttcctctctcccttaacaaatattttatctcagaaggaattagggatattgtaggaaatatgcttataaattgcttctggctacctctgatgggaggaggaggccaggtgccttccaggagcaggtctggtaagagaaacaggccatgagtgtttgagatgtcagactgggttgtcacagctcatcctactgttctgaccaagccaacagttactcagaattttcagaaatccaagaacagcttgaggtaaaaatgaatctcaggctggacgtgatggctcatgcctgtaatcccagcactttgggaggctaaggtgggaggatcacttaaatccaggaattcaagaccagcccagacaatacagtgagatcccatctctccaaaaaataaaaaaaagttagccaggcatggtggcatgtgcttgcagtcccaggtactcaggaggctgaggtgggaggatcacctgagcccagaaggtcgaggctgcagtaagtcatgtttgcaccactgcactccagcctgggctaaacagccctgtctcaaaaaaaaagaaaaacgaatctcagaaaaattactttaatttatatataattatatatatacatatatttttgtgtgtgatggagactagctctgtcaccaggctggagtgcaatggcgcgatctcggctcactgcaacctccgactccctggttcaagcgattctcctgcctcagcctcccgagtagctgggattacaggcacatgccaccacgcccagctaatttttgtatttttagtagagacggggtttcaccacgttggccaggatggtctcgatctcttgacctcgtgatctgcccgccttggcctcccaaagtgctaggattacaggtatgagccaccgcgcctggccaagaggaaaacatttctaatatcattttatgatagcaagtatttttataatatcaaatagcctacctttaagatggcggctcactctgtcaccaaggctggagtgcagtggtgcaatcatagctcactgtaacctcaaactcctgggctcaagcaatcctcccaccccagcctcctgagtggctaggaacaaaaaggtacatgcactgagcctggctaattttattattttgttataaacacagggtcttgctatgctgtccaagctgatcttgaattcctggcttcaagcaatgctcccgccttggcctcccaaagcactgggattacaggcatgaggcagtgcacccggccctataatatcatttttataatataatgaatgtagcttttaaaaagaacagaggccgggtgtggaggcttatgtctgtcctttgggaggctgaggtgggtggactgctagagcccaagagttagagaccaacctggacaacgtggtgaaactccgtctctacaaaaaaatagaaaaattagccgggtatggtagcacacgcctgtagtacaatctgcttattaggctgaggaaagaagactgattgagtctgtaaattccagggcacagtgagctgtgatggagccactgaactgtagcctgggtgatgggtgacaatctcaaaaagaaaaaataaataaaaataaaataaaaataggctgggcgcggtggctcatgcctgtaatcccagcactttgaggccgaggtgggcggatcacaaggtcaggagttcgagaccagccaggccaatatggtgaaaccccgtctctactaaaaatacaaaaaaaaattagccgggcgtggtggcaggtgcctgtaatcccagctactcgggaggctgaggcaggagaactgcttgaacccaggaagcagaggttgcggtgagccgagatcgcgccactgcactccagcctggataacagaaggagactctgtctcaataaataaataaatagaagagaaagaaatatcctaaagttacactatttgatagtcaggtggcctttgggtgactgttttcccttcatttccaggctttctgctggaggggaaagggaaaggctgctagcatttaatgtggatctcctaggcaacaattgcaggcacttcacagaaattatttcccttaatcccctctgccaggcgaggcacacttttctcctcttcaacgttaagattgggaactatggaggcggaggccgggcatggtggctcatgcctgtaatcccaacactttgggaggccaaggtacgtgggtttcctaagctcagcagttcaagaccagtctctgggcaacctggcaaaaccctgtctctaccaaaaatacaaaaaactacctgggcttgctggtgcacacctgtggtcccagctactcaggaggctgaggtgggaggatcgcttgagcctgggaggcagaggttgcagcgagccgagatcacaccactgcattccaacctaggtgacagagtgggaacccacctcaaataaaaaacagatgggaaacgtgctctgcaggacaggtgctttgcctgaagctgcagagatcccacctcaaataaaaaacagatgggaaacgtgctctgcaggacaggtgctttgcctgaagctgcagagatcctctttcttactctagcatctacctctaacgcaatgattcttgacctaattttcctgcaccccaagacaccggacagctatgacacacccactctcatcagttagttcagtgtctggctatggcagtgatcctcaccagggtcgagggcctctcctggagttggggaaaagccctgtgggaatccacattggctgggcagaggggtttatcctgctttgagaatcactcatctcgtttagttataatgtggttgtacagttttgtttactttttaaatgttttagttattgcaaaatatttcctgattctaatggtaattcttgacaattacagaaaataggtagtcatctgcacacccaggacagtatgaccacaatcagaatttttgcgtattgccttctactacgaaactgtatagctgtacaaaaataaactgggatgataagcaatttggcatcttttttttttttttttaaggcaggatctcattctgtcacccaggctgcagtgcagtggcacgatctcagctgactgcaacttccacctcccaggctcaagcgatcctcctgcctcagtgatccacccgccttggtctcccaaagtgctgggattagagaatacagccatgagctggatcttgggtttttttttctcttaacaatacagatccagagcatttttggggtcaccagaaactctttagaaacatccccatataactcttttctcaaagttcctaattatgttagttttgtattagttttccataaatttcatttagtttcctctaatcaaactttcaaatgattatcttcagtttactattaggaggctaaaacgattttctagaccactgcgaccaaacctggctactatttaaaccccacaggcactctgctgcatggaaaatcccaagctcctctcaggcctggctgggtgaaatagtaagaggcatccattccaggccactcaacaggctccagacaaccgcagacacacaagtacttccactcaacagaaacatattctcaccctcctcctcacagtaacactaaattcactctggaaatactgaaatctactttaaacaatctaaactcataatgtacaagtgtttactggaggtccatgaggtatacagatggtttttgcccaatatctgacaatagttaaatttcaagctatgccactactttctactaccttttcattaagatccacaggaatctggcttagatttcactcagatgacctgctaagtgaaactctgagactagagaagtaaagataaccctgtgtcataaatgttctgagttactctaagaaacgtgactgtacattatcatatacctggggcataattagacaagacacagaactgaatctgtggaacaacaaagatcttgagttttcagtagtttaaaaaaaaatacagcacatacacacacaccacaagaggtgagaacctggtggtttcctacaaaattttcaaatctaacacttctttttgttttggtgaatcagcaattactatctttatcctagctattcccaaatgtctatctccagctaattcctaaaattcccctttcatacaaaatgatgagctataaaggcttttcgtgaaatctcaaaaaagacaatcacacagtatatcatcttttaaactttattttaaaaatcagtatatccattaaaaaaagtttggaaggatctgccaaaatattcacaatgatggggatcaagagctctgcactcaaatacccaacaacttatttccacctggatgacctgagtatgttcaaacttgggctcaccttacagcccactccagccctacctgccactgaaacctgctctttctccttacactcagtaattgggtaaagtggaaagctgccattacccatccagtcagccaaatctggctacctagaaaccagttcaaaattcttaacttagggccaggcacagtggctcaaatctgtaatcccagcactcggagaggctgaggcaggagggtggcttgaggccaggagttccagaccagcctgggcaacacagcaaggcccagtctgtaaaaaaaaaaaaaaaattaaaaatcagctggggctgggcgcggtggctcactcctgtaatcccagcactttgggaggctggggcagatggatcatgaggtcaggagatcgagaccatcctatcctggccaacatggtgaaaccccatctctactaaaaatacagaaattggctgggcgtggtggcgcgtgcctataatctcagctactcgggaggctaagacaggggaattgcttgaaccagggagtgggaggttgcagtgagccgagatggcaccaccccaccccaacctggtgacaaagcaagactccatctcaaaataataataatactcagctgggtgtggtggcacacacctgtagtgctagctactgaggaggctgaagtgggaggagtgcttgagtccaggaatttgaggttgcagtgagctatgattgtgccactgcactctagcccgggcaagagagtgagaccccatctcaaaaaaaaattattaacttggcctgtagtattcagctaaaacaccatttcctcaagggagtaagccttttcaatccatcttgagcaagtaaggccctgggttctgctgtcactgtatttggcatgcttccttcatggcaacgctatcacatttaagccgagtgttatctttccgtgcctcgtgattcttactctaaaataagaaggataacaaagtggagtttatcactgtttagtgcctagagtgctgtcgggtacacaggaagtatctaataaagattactattacagttgtagtaaaggttatataagagcaagtgacaaataatatttaaaaattatatgagcaagtcaggccaggcgtggtggctcacgcctgtaatcccagcactttgggaggtcaaggtgggcagatcacaaggtcaagagattgaaaccatcctggccaacatggtgaaaccccgtctctactaaaaatacaaaaattagccaggcttggtggcgcgtgtctgtaaactcagctactcaggaggctgaggcgggagaatcgcttgaacccaggagttggaggttgcagtgagccgggattgtgctactgcattccatcctggcaacagagtgagactcagtctcaaaaaaaaaaaaaaaaaattacacaagcaagtcattgtaacatcataatttacctataatctgttactgtgagattaactatcaagatagactatgaagtctgtgttggtagactatatctgtcttgctcacttctctaccccagatttcttataaagctaggtagagtgggtgtttttttaactgaataaacgaatgagtgaattttggattctccatgaccctctactttcatgccctcaggtaccaaactgcatgactttggtcccctcaatagctctcagatctggttctctctatcccacagcttttctccaggtctcaccatctctttccagtgatctactgcgtgagtctcctgcctgtagtctctccccacctccatcccttgctcgtcctccacatggctgccagacggaattttaaaaacgtgaatgtgctccagtcattatcctgccaaaagtccttcaatgaatactcactgcctacagcagcaacctccagagcagggtgcgaacgtccccacggggtctgccacactgccccctggggtgtgaggagcaaacactgaagcctctatgtttattttctatttatatagcaaatactactgaagcctaacatttaaaattggtactcacatatgtatataatattctggggatacaggcttaaaaattatccaagtgaaaatcagctctgtgggtcgggcgcggtggctcacgcctgtcatcccagcactttgggaggccgaggcgggcggatcacctgaggtcaggaatttgagaccagcctggccaacatggtgaaaccccatctctactaaaaatacaaaaattagccgcgtagtggcaggcccctgtaatcccagctgctcaggaggctgacacaggagaatcacttgaacccaggaggcagaggttgcagtgagccgagatcatgccattgcactccagcctgggggacaagaatgagactttgtctcaaaaaaaaaaaaaaaaaaagaaaatcagttctgtgaaaaatatttgggccaggtgcagtggctcatgcctgtaatcccaacattttgggaggctgaggcgggaggatcacattagctcaggagttcgagaccagcctgggcttcgtagtgagatctcgtctctactaaaaaaattttaaaacttagctgtgtgtggtggcatgcgcctgtagtcgcagctactcagaaggccgatgtagtgggagcgctagagttcgggagttcacagttactgtgattgtgccactgcactccaacctgggcaacagagtaaaactctctttcaaaaaaaaaaaaaaaaggaagaaagaaaaaaagcatttcactgaaaggcatgtggtctccaaaaaaactggcaacgataagcctagaggacagagatcctccaggatccttgctctccctcctcagcctcatctcctgtgagtctctgctcactgtgcacatcttatgtctcctgtttctgtgccttggtcctgtgtttagaagggccttctgtagggtccagccctacggggccttgtgggttttctcttcgtgtgcggagacgagagattgtagaaagacacgaaactaagaagtagtaggaaagacagctgggcccggggcaccactaccaccaatgcacagagtccaatagtggccccgaatgcctggacccactgctatttattgtatacaaggcaaggaggcagggtaaggagtgtgggtcatctcaaatgattgacaaggtcaagcaagtcacatgtccacgtgacagggggcccttccctttgtggtagccgaagcagagagggaggacagcagacgtcagcattttttctttgcacttatcagaaagatcaaagactttaacactttcactaattctgctactgctatcttctaagaacttaaaggaggagccaggtgtacaggtggaacatgaaagtggaccaggagcatgaccactgaagcacagcaccacagggagatgctgaagcctccggatgactgtgggcaggcctggggaatgtcaggccccccacgagagctggtggagcagagtgttctctaactcccccagggaaagggagactccctttcacagtccgctaagtaacgggtgccttcccaggcactggcactaccgcaagaccaaggtgccttcaagcagcccttatccaggcatgacagaggttctcactgttgtcttctggtctcctgactctgtatggcctggtttttccttggtcgtaataatgaaacaaagattaatactaaagactaatgattgataatatccatatacaatcatctctatatcctatttctattataactctacttatttaactattttctttattatattggaacaggttgtgccttcagtctcttgcctcggcacctgggtttctttccgcccacgccttccttccctcatcatcctggaagagatacctagctgctggctctgtctagaatactgttctgccagactgctgcaagcttgactccttcctgtccatcaggtctcagcttagagggaaccacctcacagagaacttcccgttaagcccctttatttaaaggaccctccgcagcacgctctgtcacggaacctgcctggtatcacggcgcatcacgctctgtcacggaacctgcctggtatcacggcgcagcacgctctgtcacggaacctgcctggtatcacggccaccatgtttgatcatctctagtgtatttgttggtttatttcttgtctttctccctacactagactccataagaccaagaccagatttgtcatgtttacatttctccctagtttctaaaaataatacctgacacttagcagacatttaataaacgactgctacgttttactaaatgaatacatgaatgaatccctcaagctcggcagacaggctacctcctctctgaagttgtgattttccttggaagaactggtctttgtttccttaccgcactgtcccactgtcactgacggcattcgccagggtctcccaccacttgatcctgcacacctcaagggcatggactggaccttatcatctctgcaccctcagcacctagcacagtgactgacaacacatgacaggcacctactgaacaactgctgactgaaaaaatggaaacgaagcgggactctcactgcccttctcccaactctgctacttccagttctggtctacttctcacccaaacacccaaaaaccaattttgtaagaaaatccatctccacaggaaaatcaccggacaaaaaataataaaacgtgaagtctaaaaatctgtatcttgaggccgggcgcagtggctcacgcctgtaatcccagcactttagggggccaaggcaggtggatcacgaggtcaggagtttgagaccagcctggccaacatgctgaaaccccgtctctactaaaatcacaaaaattagccaggcgtgatggtgggtacctatagtgccagctactcaggaggctgaggcagaagaatcgcctgaacccaggaggcagacgttgcagtgagccgagaccgcgccattgcactccagcctgaacgacaacagcaaaactccgtctcaaaaaaactaataaatagaaataaaaatttacatcttgaaatagaggtgaaagtggctttatgattctgggcttatcctgcctgcctcacccccacttgtccctactacattataaaaatcctttccactttcaatttacagcagaaaatttgggaggactctcacaacctaagagtacaattattaataatatgttcactatacaatgaattccattccaacacagtgtagctcactgccccagctggtgatgatggagtttgatttgaatttaactctcccttgtgtatcaagggcccgtagatgatctagtgtaacacacgaagcataacacccaagatgtgccaaaagctgctgaaaggaaggaaacctgaaactctacttacttgctcggttgggaacagggtattgatatactcaacagcattgaaatctgctcgatctagagggtcctggcttggaaacacctatatagaaagagaggagtatatataaaaacatgtagtataccgtaaatatatataattttaatttgtcaattaaaaggaaagggccgggcacggtggctcatgcctgtaatcacagcactttgggaggccaaagcagatggatcacctgaggtcaggtctctactaaaaataaaaacttggctgggtgtggtgttggcgcacacctgtaatcccaactactcaggaggctgaggcaggagaattgcttgaacccgggaggcggaggttacagtgagccgagatcacaccactacactccagtctgggcgaaagagcaagactctgtctcaaaattaaattaattaattaattaattaaaataaggctgcgcggatcgcttgagctcaggagttggagactggcctgggcaacatggtgaaaccacatctctacaaaaaaaaattagctgggtgccatggcacatgcctgtcatagtcccagctacgtgggaggctgagatgggaggatcaccagagcccaggaggttgaggttgcagtgagccgagattctatcactgaactccagcctgggcgacagagtgagatcctctctcaaaaacagtccacctctaagacatacagctaactccctaacaacctgaagaacacgcaacaaggtggatgatacaagcagccaaattatccactggacactgggtctcacccagcttgatagagttacaactgtgggaagcaacttcatctctgaagaagccttccaaagaaatatagagtcaaaaaatcaaaatatcttcaagacaactgttagaaaagctgaagccttctaccacatcaagaggaggtggatgagaagaaagtgaagatgttttctttttaaaatgttcagcattgctgtttccataatgcacatatacacaggttatttacacagtctcaatgatacgtgctcaccagagggaaagtataacccacagagagcaggatacaagagatacaaactatttcctcaagttgctctcagtttctgtattcctctcacgactcctaggttttagtgctgtcctaggttttaaattgttttcatgtaacaaggctcctaacaaaagccagctgaaaaaagaatgactggttccaatgatggaggaaaaaaactaacagccctagacttatcagagatgcatacgtggtacttcatgggcaatttttttttttttttttgacacggagtctcgcgctgtcacccaggctggagtgcagtagcgcgatcttggttcactacaagctccacctcccaggttcatgccattctcctgtctcagcctcttgagaaggtgggactacaggcgctcgccaccatacccggcttattttttgtgtttttagtagagaaggggtttcaccgtgttggccaggatggtctcaatctcctgaacttgtgatccacccgcctcggcctcccaaagtgctgggattacaggcgtgagcctccacacccggccttcatgggcaatttaaagaacttcagggcagagtgattttcatgtctagagtgactttcgccttttttttttttttttttttcgagatggagtctcactctgtcgctcaggctggaaggcagtggcaccatctcagctcactgcaacctctgcctcccgggttcaagcagttctttgcctcaacctcccgagtagctgagattacgggcacctgccaccatgcccagctaaatttttgtatttttaggagagacggggtttcaccatgttggccaggctggtcttgaactcctgacatcgtgatccacccgccctggcctcccaaagtgctgggattacaggtgtgagccaccgagcccagccaattttcaccttatgcaatgactctgggacttcatcttggagtaaaatgtgattccattttatcaacccttcctgactcctcacacatcactactctttacaagtatgctactacagaatttcattcagagtgctaaagtaagaaaaaattctgaattcatcttgacataatgatgtctgaattctgcttgacataaagatgtctgctatactatcactcaaacttattcttacaaaataggaaaaatgtcagaattcaccgctatgtaattcatccatgtaatcaaaaaccacctgtaccccaaaagctgttgaaacaaacaaaagaaatagcaaaaatgtgcttttctgatacctgtcaaccaaacagtaactgactgcattattcttttcttccatgagagcccactagtccaaagagcaacagaaatgttatgtctttttctggcaaaaggaggtaagtggtggagccgtgtggccggaacactaaaagcttcctgcccaatggtttggcgttctcaggctaggacaaagttggttgtataagtaatccaaccactactggaaaaacacacatcgaagcgtcaatgaatgcacctgtagtcccagctactcgggaggctgaggcagggttatcacttgagccccaggagttcgaggctgcagtgagctacgattatgccactgtactccagcctggacaacagagcaagaccctatctcaaaaaaaaaaagtttcccaggggtcattaaataaggcataatggaattgtccatttcctcaatcataaatccctttcttaaatcatataacttcatgacaattcctttaagggagattttctccgtttatcaggagcaataccctgcagtattagaaatcactatttctgaccgggtgcagtggctcacacctgtaatcccagcactttgggaggccgaggcgggcggatagcctgaggtcaggagttcaagaccagcctggccaacatggtgaaacccggtctctactaaaaatacaaaaattagctaggcatggtagcggttgcctgtagtcccagctactcaggaggctgaggcaggagaatcacttgaacctggaagcggaggttgcagtgagccgagatggcacccctacactccaacctgggcgaaagagcgagactccgtctcagaaaacaaaaaaaaagaaaaaaagaaaagaaaaaaatcactatttctaatatcattagccttaaaaactcaataaacttgcaaaggcaagagttcctgcaggcagggccgcgcgtggtggctcacgcctgtaatcccagcactttgggaggccaaggcgggcgggttacttgagctcaggagttcgagaccatcctggccaaaacggtgaaacccccgtctttaccccaaaaaaaaaaaaaaattagccgggtgtggtggcgtgcgcctgtaatcacagctactcaggaggctgagacaggagaatcgcttgaactcgggaggcggaggtcgcagtgagccgagatcgtgccgttgcactccagcccgggcgacagagcgagaatccgtctcaaaaaaaaaaaaaaaaaaaagttcctgaagggaaaagaggccccttgggagtattctccaacctcacccaaactattcaacggtaggaattctcaaccttttaagaatggtaacgatgtcatttttcaacactttctctcttctctgccgtccgcttcagaaattaaagtcattcccttcccccagttccaagccactcacgaggtgccagcttgcaaaaccggggcgttggcacgagtctggtaaatgcatgaagcccccacagtccccagaatctgaggatggcacccaaggcctgcattctcctagcgtcgtcctctctaagcgcacaattcctttccccaaaaccaccagaacccccagccctcgccaaagacaatcaaagcctagaaagggttctctttcctttccttctgattcagaaaccgcttctcacccgcaccacctccccacctccactttcccttctgccgcgagcccccggccctccgtccacccgccgcggcctccccagcgcccggagctgccgtctcccctcccgcactcccgtttcccctcctgaggggcggaacgcttacctgctcgatggccagctgcacctcgggcgtgagctgcagcacggcttccagctcctccacgaactccagttcctcctcctccatcattccgccacccggccccctgccgacccccgccgcgagcccaactcaggcctccagccgccacccaggccccagcacagcaactccctcgcggcagcgacctggtgagcccggctccgtcagccgctctgtcagccgctccggcacttc

SEQ ID NO: 1855 - DNA, 34984 bp, Homo sapiens
tttatttttagtattttatttttcagattctcagcctctgcacagccttagtactccctgagaaattcagtgtttgcatatcctttccacaaaaatgagaggaaaaaggaccagtacctgctagtgactgatacatttattagtttctaacaaaaaggcatacatggtaggcagagtagaaatactaacagaaattagtttatcttgaaaccaattttagtcaggaagacttcttcacagagaatgagctgaatatataaatcccaaatatatcacaccatatatgtgatatatttacacctaaatatatcacaccctcctttttggtcacagactattccaggaagattaaatagataacgtttaatttgaggcattcaagaatgtccaccctaaaactgaaagtgaaattgctcttagagaaaaattggtttgatgagaagattgatcttagcctgtctcagacaaatttggtttatttatttttacttaacgacccatgtgatagtatagttgcaagctatacttcatttaactacaatcattactcagaggacaatcaccttaagaggcaaattaagttttaaattagcacagaatttataattacccaatcagcattgacatagatgccatcaggtatgcaaagattaacaaaattctattaccaaccttagaggaaaaaaacttaatgacatacagaaatactggcaaatttaagctagaattagctccaggacattttatcttattttcacattaaaagaatagattactagatatcagcagaaatgctgttaaagctattttttactaatagttgttcatattaatgaaacaaaagatcaatagtctctgagctaaatttcacaaaatgaaatcagtgtcttctgatttaactttcaggagtaagaaagggcaaaacccaagcaccatactttctatttctgttcataaactcaaataaaagcagtatcaacacaaatgatcatataagaaaacacgtggttatgtttcaggttccacaacataagacactgtgaggtaactctcctgtaatacattcccatttttttctggaatagcagatgcatagaaatgcaggtttccaaaaattcacccaatttagtaactaattttgattctgatgcctgatagtagggtgtgaaaagctgtaaaacccaaatgtttcctgtgttctttcacaaggacaagggaagaggatgctctgccaaactgcccctgctgcgtcatagtggaccagtttcaatgatccagactgtcagtcaccccatccagcctcatcctcatctggacccatttctcaccacccaatcagtttcaatgatccagactgtcagtcaccccatccagcctcatcctcatctggacccatttctcaccacccaatcagtttcaatgatccagactgtcagtcaccccatccagccacatcctcatctggaccagtttctgaccacccaatcagtttcaatgatccagactgtcagtcaccccatccagccacatcctcatctggaccagtttctgaccacccaatcagtttcaatgatccaaactgtcagtcaccccacccagcctcatctggaccagtttctgacgacccaatcagtttcaatgatccagactgtcagtcaccccatccagcctcatcctcatctggacccgtttctgaccaaccacccaatcagtttcaatgatccagactgtcagtcaccccatccagcctcagcctcatcctcatctggacccgtttctgaccaaccacccaatcagtttcaatgatccagactgtcagtcaccccatccagcctcagcctcatcctcgtctggacccgtttctgacgacctaatcagtttcaatgatccagactgtcagtcaccccatccagcctcatctggaccagtttccgacgacccaatctgtttcaatgatctggactgtcagtcaccccatccagcctcatcccagctcttaactccttctgcatagttcagtttcctttctggcaactaattcccaatttcctagaaaaccctgattttctgatttaacactgattcgaatccactttaaaccaaaggaaacaggccgggcgtggtggctcacgcctataatcccagcactctgggaggccgaagcaggtggatcacctgaggacaggagttcaagaccagcctggccaacatggtgaaatcccatctctactaaaagtacaaaaaaaaaaaaaaattagctgggtagctgggtgtagtggcacatgcctatgatcccagctactcgggaggctgaggcagaagaatcgcttgaactcgggaggcggaggttgcagtgagctgagatcgcgccattgcacaccagcctgcgtgacagagcaagactctgtctccaaaaaaaaaaaaaaaaaaaaaaaaaaaaaaaaatctgggatttcccacatatgaatatgaatccaaattttgaaactccgtctaaaaaaaaaaaacaaacaccaaaggaaatgctacaatgctgaaaattgaattaaattggagatggaaattagattactttaggaaaaccttttgagtactctgtaaacattggacaatagcaagaaaatggattttaaaccctgcatgggttccttaatcactcagaatagtataatcttgctttgattaccagtcacgacaaaaaggtgagcaaaggccataaaacatgcagtttttggaaagacaatggcacttgaagatttcctggagttggccaaagcttaagatatctctaagaattgtaaagcttaatacacatctgttattaagaagggaaacgacaggggacccctgcttaccgctgagctgtgcagaagctcatgtgtctatgcagtccttacaatcacacagaccttcattaaggacaatgagtgtgcctagagagcagcatgaatgacacatggatgaagattccatgataggaaagagcttcacattccagctttactagatcacaaagcactccctttaccaggccttactttgtgcatctctgaaacatctgaaaaacacttttctgtgaaatgctaggctgtagggagtgagcacttttggataccttacagtgatctctagtagaatttggcatctttcttctattaactgactgcttcaactgcatctttaaagacacttgcctatttttgtcccttgagcctctctctggtgttggatgctttgtgtgagtttgccttttgaagttcccatctttgggattcttcctctgtccatttagcactttgtctggaggggaggatgtagcgcgtaagtgatactcatctggggatcctttttgccggtttggcaccatttgctctttatccacctccttctgaagttgtaatgccaataacctgtcctgttcttcttgtttatgtctctcaaacagtagatgctccaaatctatcagtttttgggtaaagtttatttctgtttcctcttgatctggggaagattcgggggacacttttcttctttttgcagaaaagcatggatccttgactgcttcaaaggaagattcttggttttttcttttggaaatctccttactgatcagtaggcacgactcttcattttctgtctcacctgtgttgtttccatttgtctgtgtcacccctgatgtgggggcgcacccactttctgttctgccacaaggcataactgcagtttctttcgagtagggaactctggttttaggtcgctcgtgacttaagacacataactctttcccatgattgcttggtcttgttttgacgtttccttcatggtaccattcggcaccacaggcacataaccatggcataggggactctattgaagaatctgcaccttgttctccaactccaagggatatctgtggagaaagtgtcggcatatcttctatttctgtgtcttgccctgttgggcttttcctatcactactgtcaatgtcctgtagaaaacagaaaaagactgagtgaaccaggggaaaatatcaaatcataagatgtaagtctaattacactgatactacagctggactgtcactatacattattattactaataaggtatatatttctttctttcttttctttttttttcagagtcttgctctgtcgcccaggctggagtgcagtggcgcggtctcagctcactgcaaccttcacctcccaggttcaagtgattctcctgcctcagcctcccaaataggtgtatatttattcttaatagtatttttatttcatgggcaaatttagattaagctattacttcattttcactcccatgaaaacctacagattaaaacccacagactagattccaaatatggccaatagctggtatcaggacctgaccttctttcaccttacaaaggtctgccagcataggggtttttaactcttttctctaccgtggaccctccttttggcatttaggtgaagcttacagaccacttctgagaataatgtttttaactaaaaaattaagatatacagtagctttacaaaaggaacaatttatgttgtaaacacaatcattaaaaggttcaaaaaaatgtgaggtaataatgtgcatctataatacagtaaataataggatctaccagccagtctaataactcataatacccaattatctgtgtcacccctgatgtagtacacccactctctgttttgccacaaggcacaactgcagtctaataccaatgtagagataagtataaatgatatttaaagatatctgtaacatggctgggcacggtggctcatgcctgtaatcacagcacttccggaggctgaggcggacagctcacctgaggtcaggagtttgagaccagcctggccaacatgatgaaaccccatctctactaaaaatacaaaaattagccgggcgtgggggtataagcctgtagtcccagctaccagggaagctgaggatgcaccgagcatccactgtactccagcctggacgatggattctctctcaaaaaataaacaaaacaaaacaaacaagcaaaaaaaaaatacctagtgtttggaagataaagcttgggacttctataagttacttctataagtaacttgactgggtgtatttctcaccaagacccctggaagctagacccattgtttgttataagaaataattgacccttacagggcatgtggtctcaaagtagttaatacactcacttgtgtggcctttttccaggctatcaccttggagctctgctgctgaggactcctgctgaacacacatgcctgatgctgccttactagcatactttttctcatcttgcaatttttttttttttttttttttgaggtggagtctcactctgtcatccaggctggagtgcaatggcgacatctcagctcactgcaacctccgccttccgggttcaagcaatactcctgcctcagcctcctgagtagcagggactacaggtatgtgccacacctggctaattttttttttttttttggtatttttagtagagatggggtttcaccacattggccaggctggtctcgaactcccaactttctgcctgcctcagcctctcaaagtgctaggattacaggcctgagccaccgtgcttggcctcccatcttgtaatattctttttttttttttttttgaaacagagtttcactcttgttgtccaggctggagggcaacggcacgatctcagctcaccgcaacctctacctcccgggttcaagcaattctcctgcctcagcctcccaagtagctgggattacaggcatgcgccaccacacccggctaattttgtatttttttgtagagatggggtttctccatgttggtcaggctgatctcgaacccctgacctcagataatccacctgcctcagtctcccaaagtgctgggattacaggcgtgagccaccgcattcagctccatcttgtaacattctaagtgaagctggtgccaggtataacctattcagttttgtgagtttggattacataggtcaaggatcagtaatctatggctcatggaccaaatccagcctcctgcctgtttttgtaaacaaagttttactggaatgcattcaagctgatgtgtttacatattatctatagatgctttcacactacaccagcgtagctgagaagctgtgacacagatcacactaactgcaaaggcgaaaatattcactctcttagagaaaaactttgctttttgtagtatgtttatttaaaaaattgtagtttcctttggagaaaaagtgctttttctctaggtgagcctaagaggactcagacagggtgtttgattaactataggggcttttgttaaaaggtagaaaactatggatagcactaatctacagcattaatgaaccagcaaaactcagaacatcttcagtatcaacataccttagatacggagtctttcctgacttcttgtacagcttcagagtgtgaggctgacccaaactgagatttcggtgtcaaatacctaaaagaaaagtttaccaaagtttcaatgctttcaaagacagatggtatgtacccaacataataaagctatttataccgaaggttgtctggtttgctgcttggctgttttatcagagtgtatctcatttccgtgcttcagatattttggtcaattccaggacaaaacttaaatgattgagtattgatattttagtgaaaaacagaaaaggaagtaaaagtcaaatctaaatattttttcttttttttttttttttgagatagagtctcgctctgtcacccaggctggagtgcagtggtgtgatctccgctcactgcaagctccgcctcccgagttcacgccattctcctgcctcagcctcccaagtagctgggactacaggcgcccaccaccacgcccggctaatattttgtatttttagtagagacgaggtttcaccgtgttagccaggatggtctcgatctcctgacctcgtgatccgcctgccttggcctcccaaagtgctgggattacaggcgtgagccactgagcccggctaaatatttttttttcttttcttttttttgagacggagtctccctctgtcgcccaggctggagtgcagtggcgcgatctcagctcactgcaacctccgcctcccgggtttaagcgatttttctgccttagcctcctgagtagctgggattacaggcgcccgccaccacgcccggctaatttttgtatttttagtagagacgggtttcaccatgttggtcaggctggtctcgaactcctgacgctcaggtgatccgcctgtctcagcctcccaaagtgctgggattacagccgtgagccactgcgcccagcgtaaatatttcttaattcttgaaaaaagcttaaaaaagcagatagcatcaaaacaatgcaagactctatagtcttcccaaaagtaatgaaaatgatgctttaaactaggagaaaggatatgttagtttcttctttatgctggaaatgttggctgttcacgacattttaaatctctactattgggaaaaagtccatgattaaattccttactattctggtatagagatgttatcatacatacttttatatcaactctcttcttttttttttttttctgagacggagtcttgctctgtcacccaggctggagtgcattggtgcaatctcggctcactgcaaccccgcctcccaggttcaagtgattctcctgcctcagcctcctgagtagttgggattacaggcatgtgccaccacgtccagctaatttttgtatttttagtagagacggggtttcaccatgttggccaggctggtctcgaagtcctgacctcaggtgatccgcctgcttcggcctcccaaagtgctgggataacatgcgtgagccaccgtgcctggccctcaactctcttcttagaaacacatatctttacatttctttctttttttttgagacagagtctcactctgtcgccaggctggagtgccgtgacatgatcttggctcactgcaacctccgcctcccgggttcaagtgattctcctgcctcagcctcctgagtagctgggactacaggcacacgccaccatgccctgctaatttttgtatttttaatagagacagggtttcaccacgttggcctggatggtctcaatctcttgacctcaggtgatccgcctgcctcggcctccctaagtgttgggattacaggcgtgagccactgcacctggtcatatctttacatttctaagaatcttcaatataacaggctgtttgccactgaaaacactacggttttaatagaatggaaaatgttataaaagaacggggaatagaaaaggcaggctacaagatggtaggtatagtttaaaaattgtaaaatatccaaacatgcatataactatgtttacaaatggcagaaatttcccaaaatgttggttgtctccaaatggtggaaactttgggtgattttcaaagagcagctagccatggcttttagaattagagaaaaaaagtgactataaataacagacaaatccataagttacactgtgtcaaaagcaccaacaagtagcatatggaacaatcaaacctaaacaaagatctcatataaagaactaatgaatattccttatgggcaaacaagagtacctaacccatatatttagttatatcaatctatatatttactctgttaactttgaagaacaagaaccaaattttcagttgaaaagaagcttagtctcatttagtttctttaggctgaagaattctttctgtcaatgctgatgcgggaccactacttacgaagcataccagtaccaaagtatcactgttataacagttgttttgacgttcataagcagagaacagaatgttattacttatccaacacaatcactgaagattcattaactctcttggatattccttatttataataaccaagtaatatatgaatacatgctcattctgaaaataagcagaactggccgtggtggttcatgcctgtaattctaacactttgggaggctgaggtgggaggatcgtttgaggccaggagtccgaaaactggacaacacagcaagacccatctctacaaaaaattaaaaagaaaaattagctggacataatggtgtgtgcctatagtcccagctactctgaaggctgaggtgggaggatcgcttgagcccaagagtttgaggctgcagtgagctattttcttgccactgtggcctgggtaacagtgagaccctgtctcttaaacaaaacagaaatacaggaaatatatgtcatcaaccctttcccttcccatgttttaagaacttttttttttcttttttccttgagtctgaatttttgggatccattcccatttgcttccttttatgttttaaattaagtttagcctaaagctgcctccttacgtattttaagttcagcccaaagatttctctgtatatagtgaactacagcctaaagggaggtgtgaacagcctgtaaactactcttgtgccagtcaccaagctttggccaaagggggccaactgttcaaatcatgttcaaataaggcaaatgccaaactgtaaccactctggctgtctctgcccctcatttctgctttccatacatcacgttcccttttctgtctgttaatcttcttccgacatgtggctccacgggagtcgctctcggcctactctggctcgagaggctgcccaatttgtgaattgtcctttgctcaattaaactctgttaatttgtctaaggttctccttttaacatatgtaaccaattttttaaaaatatgatttctatgaaatacacactctttttgattttgtttattttagttattttattttttgggggacagagtctcactctatcgcccagactgaagtacaatggcacaatctctgctcactgcaacctctgcctcccgggtttaagcaactctcctgcctcagcctcccaagtagctgggattacaggcatgcaccaccatgcccagcgaatttttgtatttttggtagagacaggctgatctcgaatgcctgacctcagaagtattgtatttttggtagagacaggacagccaggctggtcttgaactcctgacctcaggtgatccacccacctcggcttcccaaagtgttaggattacaggtgtgagccaccgcacctggccattattttatttatttttttttgagacggcgtctcactctattgcccaggttggagtgcagtggtgcagtctcagctcactgcaacctccacctcctgagttttaagcaattctctctgcctcagcctcccgagtagctgggattacaggtgctcgccaccacacccggctaatttttgtatttttagtagagatggggtttcgccatgttggccaggctggtcttgaactcctgacctcaggtgatccacccgcctcggcctcccaaagtgctgggattacaggtgtgagccaccgtgcctggcttcattattttttaaggcagggtcttgctgtcaccaaggctgaagtgcagtagcaccatcatagctcacggcagccttgacctcccaggttcacgtgatcctgccacctcagcctcccaaacatctgagaccacaggcacaccacgcccggctaatttttgttattttttgtagagacagggtttccgcatgttgcccaggctggtctcaaactcctaggctcaagtgatccacctgccttggcctcccaaagtgctgggattgcaggtatgagccaacacacccagcctcacgcttttttttttgagacggactatcgcccaggctggagtgcagtggtgtgacctcggctcactgcaacctccgcctcccaggttcaagcaattctcctggctcagcctccccagtagcgggattacaggcgtccgccaccacgcctggctaatttttttgtatttttagtagaaacggggtttcaccatgttggccaggctggttttgaactcctgacctcaagtgatctgcctgcctcaccctcccaaagtgctaggattacacgcataagctactgcgcccggcttgtgatttgcttttttcactaatgtcttaagatctttccaagtctgcctcatgaaaacaaagtttatgagagaacagtcatacaatacatgtaagaatcacagtacagcacggtcacggggagggggacactgactggaaagggaaagggcacaagcaaacctttgtaaatattccgtcttcatctggtgggtggtttatacacacacaaaaattcaccagaaagtatacttaggattggtgcaccgtctttttaaattttttactttttcttttttaccctgtcttatggtgccgaagactggtgcactttaaaatatatgtttgctgctctgtggtccattaaaaacaaaacaaaaaaatgtgttattcttctaaaaagtttaaaaatctgtattaccatgaaagcccatatgcttattacttggttgaagggaaaagaaatcattggtttgaaagtctcctatggggcctcgtcatctcccacctcatactatcctgagtttcttatatcttactttttaaaacagatttgccacacttttgcatctctaaacactttattgattagtattgtgtgattctgagcgagactccgtctcaaaagaaaaatttgaaaagttggaattctgattcgaattgcactgactctatagatcagtctgaggagatctgaccattttgtagtattaggcatcttctaacccatgaatattgtatatttaatataatacaattttctccacgggtcgtacagatttttatttttctgagacatggtcttgtctgttgcccaggctggagtgcagtggtaaaatcacagctcactgcagccgtaacctcccaggctcaagtgatcctcctgcctcagccacctgagcagctgggactacaggtgtgcatcatcatgcctggttaattttttaatttttttttaagagatagggtctccctgtgcagctcgggctcgtcttgaactcctgggctcaagcaatcctctcgcctcagtctcccgaagtgctgggattataggcatgagccaccatgcttgcctcagattttaacacatttatttttaagtacttttattttctgatactactatcgacagagtatttttaaagttacattttacaattgactttttgtacagattttatatctggcaaccttgctaaactcttcattctaaaaatgtacctctgactttttgggttttctacatagataattataccgcctctgaagaatgatagctgctttttccttcctttccaggctgatatgttttatctccttttattgtgttactgtgcagactaaactctccagcatgagtctgaatgcaggtggagagtagcaggccacccttgcgtattcctgaccttacaaggggaatggcggggcgtggcggctcactcctgtaatccaggcaccttgggaggcccaggcgggaggatcacttgtacccaggagtttgaggttgcagtgggccatgatcgcaccactgcgctctagcctgggtgacagggcaagaaagactgtctggaaaaaaaaaaaaaggaaataatttcgatgttccactatgaagtatgatatgtgatgtaagattttggtagatatccttcaacaggttaagaaagtttctttctgttaccacttcattaagaattatcatctcgtgtatttcatatttatacagctaattgaataacttacagtgattcattttctaccattaaaccagcaatgtattcctggaattgtctttttaaatacgttttcagctgcgtttttttttttttttttttttttttttgagatatgatcatagctcactgcagcttcgacctcttgggctcaagcaattctcccacctcagcctcccaagtggctggggttacaggcatgtgccactgcatttggctaatttttttattttgtgtagagacagggtcttactatgttgcccaggctggtcttgaactcctcctggcctcaagcaatcctaccacctcagacctcagcctcccaaagtgctgggattataggcatgagccactgtccctggcttttttttttttttttttttagagacaggatcttgctatgctgtccaagctggtcccaaactcaaactccctgggcttaagcaatcctcctgcctcagcctcccatgtagctgggattacaggtacgtgccacaacacctggctgccctttcttcttttctgatacggcacgtaaagccttctaaataccactttagccacataccagttttcatgcatattttcagttctgtatttccaacaaaatttactctttaatcaacaagttgtttagaaatttttcttaattttaaaactatataatcctgttattcatttttaaacttttgaattgaggtgtaattcacataaaatggaatgccacattttgtttacccattcatttgttaatggacatttgggttgtttctacctttcggttatttgaataatgttgacacaaatattcatgtacaagtatttgtttgaatacctgctttcaattcttttgggtacatacctaggagtggaattgctgggtcatatgctaattccgtttaacttttcaaggaatcaccaactgttttctgcagccacgataccactttacattcctaccaagcaatgcgcaaggattccaatttctccacatctttgtcaacacttattattttccctttttgtggattatagccatcctaatgggtatgaaatgctatatcactgtggttttgatatgcatttccctaataactaatgatgttaaacatattttcgtgtacttattggccacttgtacatcatgggaaaaatgtctactcaagtccctttgtccagtttttaattatttgtcttctgttgttgagttataagagttttcatatattctagaaaacagactttatctgtttttaatattgttacaactttaatccatcagtttctcaatttttgcttttaaatccttagtttttcttgtatctctggtaattttttatttttatgtatttcaaagtatatatttagatatataaagattcatgagttatagccttaaacagcatattgtatcaatatgaaatacttctgcattttagcggttttctcatttttactttgcacattatgagtactggcgacactgatattgtcacatctttttttttttttaatagtacctccctcatttaacattctcttctcctaagcttcctcccacctcaaatacaaaatttcaacaaatcttggaaggagatgagttacctgcacatatttcctcagttgaaccagaagtccttatgtatttttcaagtctagactgtggtttttaaacttttccaactgtgagttaccatgggaaagctgatgtttgcgtaaagccaccaactccacctggcacctgaccctggaggggtgttgtggtgaaactcaatcacgccacctttgtctacctgactcatgcattttgtgtaatagagaagaaatgacaaattgtaaactctttcagtgaagataagcctatctgggacccatttttttcatctgaatttaaaccaagagaaagaggaatccaatggttcactttgagaaaactggaaatcctgaggcagtaagataaaagtatgaatctgccacagtaagtggctgagtgagaagccaagaggaagctgtgtgagtagctctctccttttcaatttacctcaacctcagactattttcatacaaagttcacggaccaaactttgagaatcagtagtagtctatatgaacagaaaacactggcatacagtaggaggtcaacaaataattcatagtcatgttcacttacttctgaatatctccagtgtttctttgtttgttcttacttttcttttcagacttgggtgtaactggatcagattttctggaattcaagggagaagccgagatacttccctcacagaaattgttcttcaacaatagaaaaagcataacagacattatgagagagaactttatgataaaataagctattaatttgactaattcagaaatccatagcatttttcagaaattatagttatatttaaattctgtacatctcttgaagaatattgaccatgcaaaaatcagaataaactatgttcatccaagttggtctaaattaattacatttttactgtacatcaagcacaaaataaggcataatactaacctcattagctgataattcctgttgatctttctttcctttttttttttttttttgagacgcagtctcgctctgttgcccaggctggagtgcagtggcgcgatctcggctcactgcaagctccacccccgcaggttcatgccattctcctgcctcagcctcctgagtagctgggactaccggcgccctccaccatgcccggctaattttttgtattttttttagtagagatggggtttcactgtgttagccaggatggtctcgatttcctgacctcatgatctgcctgcctcggcctcccaaagtgctgggattacaggcatgaggcaccgcgcccggccttttttttttttttttttttttttttaagacagggtctcactctgtcgccgaggctggagtgcagtgtagcaatcatggctccttgcaaccttgacctcccaggttcaagtgatcctcccaccttcacctcccaagtagctaggactacaggcatgagccaccaggcttggttaggtgggttgtttttgttttattttgagacagagtcttgctctgtcatccaggctggactgcagtggagtgatcatagctcactgtagcctcaacctcctgggctcaggcaatcctcccatcttagcttctcgagtagctaggacacaggcatgtgccaccatgcccagctacttttttttaaatgctttgtaaagatgaggtctcactatgttgcccaggctggtctccaactattggaatcaagtgattcccccaccacagccttccaaagtgttcggattataggtctgtgccactgtgcccagcctgttgatttttctaataaatacttttatataattacttttatctatatggacatattcagagagctgtggatatacccaaaagaatagttttatgtaataatattttagttctggactttaagggcgtattaataaaaatcacaaatatttacttgctgtaccagtctcgtaagtttcttactaccctaatggaaaagttcatatatggtgatggtgaatatttggccttaaaccaccaaactttcataaataaatagaaaattattctaggttgggcatggtggttcatgcctgtaatcccagcactttgggaggctgaggtgggtggatcacatgaggccaggagttcaagaccagcctggccaacatggtgaaaccccatcggcactaaaaatacaaaaattaacaggatgtggtggcggcacctgtaatcccagatactctggaggctgaggcaggagcatcgcttgaaccgggagttgaggttgcactactgcactccagcctgggtgacagagtgagactcttgtctcaaaaaaaaaaaaagttaaaaaaattattctacagtatcaataaatctactcttataataccatgggaaaactagatatacttcttccctattccatttattattccattggtcaatgacttttatttagtttcctgattgtgtatttctaaagcgattctacttaaaaaagacacataaaaaggggcatataacccaaaatttgggtacattattattaatggtaggcctctcaaaaaagaaaaaaattcccaattctgcgtatactcattttgctaagtgtatatacatatatatttttttattctattgaacttcccatgattcaatggtaagtgtatgttaagatattcgttgtttgaaagctgaagaattgttttcacaggctctcaaacctgaatgtttcacacttccctacatgcctctgaagattgtattccctaggtcccatccctagagactctgacttaatagatttggagtaaatatgagagtttgtatttcaacagcattcccaggttactctgccaggctcgttcaaaccactgggccccacagtaccctctgatcttaaagtatgtgttttatcacacaccatttaattcattttcttacaggcagcaatttaactacaggaagcagaacatccaagtttaatacattatctaaaaatttaatgtgccttactttcaaaatgtgatttacatccataaaatggaatattattccactctttaaaagaattagattgactacatgtagtaatatgaaaaatctctacgatgttatcaagtggaaaaaatgtaagcagcaaaacagtgtgattgctttatataatcctttttaggtcaataaagaaaaaaagcttttttttttgagatggtcttccaggttgaagtgcagtggcgagatcagctcactgtaacctcaaactcctgggctcaagggatcctcctgcctcagcccctcccagcaggtggagctccaggcacgcaccatcacactcggctcattattaatttttctgaagaaacagggtctcactttgttgcccaggctggtctcaaactcctgggctcaagcgatcctctcgcctcagcttcccaatgtactgggattacaggcccgagccatcgcaccctggcaagaaaaaagttgtaagaaactgttaatagtggttacctttggggatagagactgatataaatggaaaaggaacgggagtggagaggtggaagaaggaaaaaggaagctttcattcttcactgaatagctttcctacatataaaaaagttgttaaacaacttgcggtggctcacgccacaaacccagcactttgagacgccgaggcagatggacggcttgagcccaggagctcgacaccagttcaggaaacatggcaaagccctgtctccacaaaaaagtagccaggcatggtagtgccagcctgtagtcccagctactcgggaggttggaaggatcaccggagcccggccgtcgaggctgcagtgagtcgtgattgtgccactgcactccaacctgcatgacagagtaagacctgtctcaaaaaacaaaaaaccccaaaaacctggattagagcaaatatgtaacaatatgcaaaacaattttactttaagtaaagcaaaaatgttatcaatagcttctaattatggcaacgccatctcttctgttctttgaaaaccacagtcaaagcaatcggaatgttaatagttagctttccgtatcagcaggttccaaacactcaaatccaaccagcctggggtggaaaagacaatatttgtgggatgcagaacctggaaatacaaggagctgactcttcccatgagcgggttctgcagcagcgcataccaagggatgaccataccttagcgttccctcctaaaacttacaatatcaatgcttagctttcttgccagttcctcatcacttttcagttgttcttccatcgctcttcgccttttttctgcctgtcttttttcctcttcttcctcctctgccaacaacctctgtatgtattcttcactggctttgttttcttcttcctcgctggcccgtcgctctgccgccaccttaaaagtgattaataaagagcaatccttctctgaacgttttggtatacttgcaatatttcataacaagaatagaaaagtagaaaaagaacaaattggcagaaatttaaatgatctcaaatgaagtacaaatctggagaagtagattcctgcaagatagctgtcccatctcagcctcccaaagcactgaaattataggtgtgagcctccacacctagcctgagatgtattacaagtgaaaattatacacaaaattttgaagactaacaaaaaaagagaaaaatctctatttatgtataacttcatatgtaattaaaacataatgcttcactataaacactgctttttaggtacttttcctatttaggaacttcacagctagccctttaacctttcctcatctaaactcacactctaccacccttttactttaagctcaaaactttggggaaataaaaatatatcctggtatggattaaattaggaaaaagaagaattaaaaaattttcttcatatgtaaatgcttagggaacactatcacataagagcattaattatgtagaagtaaattacagcaaaaaacaaagcccttataaagtacattaaaattatccatattttggccaggcacagtggctcacacctataatcccagcactttgggaggccgaggcgggcggatcacaaggtcaggagatcgagaccatcctggtgaacactgtgaaaccccatctctactaaaaatacaaaaaaattagccaggcgtagtggcgggcgcctgtagtcccagctactcgggaggctgaggcaggagaatggcatgaacccgggaggtggaggttgcagtgagccgagattgcgccactgcactccagcctgggtgacagagtgagactccatctcaaaaaaaaaaaattatccatatttcaagatatactagttatataagcacaaaaaactaaattaaaatctgaaactaaaaacacagcagagaaatattccaaaaaaaaaaactatttagcacctaccttgcttatttcctcttcatattctcttctcagttccccaggtttactgagcagacgaactggctgatagtcatcagctatttcatatcaaaaaagaaaataacattataggcaacacaattttatggtaactttggtcttccattaaaacgaaaaattaaaatatacaactattaataactgcagcaatatctccttttggaattccatttttaacatttattttatttatttattttagatttattttatttattttttttgagacagagccttgctctgctgcccaggctggagtgcagtggcacagtctcggctcactgcaacctccacctcccaggttcaagcgattctcctgcctcagccttctcctgagcagctgggattacaggcatgcgccaccacacccagctaattttttatatttttggtagagtcagggtttcaccacattggccaggctggtctcgagctcctgacctcaagtgatccacccgccttggcctcccaaagtgctgcgattacaggtgtgagccaccacgcccggcctggaattccattttgtgaggccagaggtttagggttttgggtttgaaatggcatatgaatgcatatacttaacccttcctctaaactccattaaaataacagtaaaggaatttttaaaaactgtaatcctacaacagcagaaattagcagaggaggttaactgattaaaaaaaaatgttttttttttttgagacagagtcttgctctgtcacccaggctggagtgcagtggtgcaatctcagctcactgcaacctccgcctcccgggttcaaacaattattgtgcctcagtgtcctgagtagctgggatcacaggcatgcccaaccatgcccagctaatttttgtatttttaatacagaccggtttttgccatgttggccaggctggtttcgaactcctaatgtcgggcaatctgctcacctcagcctcccaaagtgctgggactacaggcgtgagccaccgtgcccggctccagttaaaaaatttttaacaaatttctagaaaatgggaaggcaatgaaatagagataattgatacagcagaaatgaaggaaaagaaatccttgaaagggaagactacagctgaggtagaattagaagggaatctgcctcctatttgcctagagagaggctcatagagtccagagtgagtaaccgtgggactgaaaacagaactcgagatttataagctgttaaatcagaatcctcgacttaccggcatttctccctggatatgggtgcaggtgcacacacgcatatttctttaaagaaacagatctagagagagccagagcagctaatgtaataggtggtgacccagagcaaagtcctctgcgatcgggcagttagggatggcaaagcacaaaggccaggtttccatcggcttgaactcaacgtctgcccatcaccaatacccttccacatacacagagcttttctcctgggcctcattctcaaacctaaaagctaatccaaggatcgtcagacatttgaaatacatctgcaggactagggaaacagtaagctatacaaagagaaaaaatcatcaccctggagttgaaagataattctgggtcagaaaataacctaaatgtgggtatgtatcctcaacaaatctgatgagaattttattctataaaacaagacactgttttataaagtgtaaaaagggaacatccaaaaaagagaacgcatctgtctgtttcaaggggcagctgctactcaactccagctgactacgactaccaggaaactcaggcctgtccgtgccatattttttgctttctcaagaaaatccagaggcggcaggggtggatggtgagagatgacttcatgggtacaatgtacattatttgggtagcagataccctaaagagccctgacttcgccactgtgcaatctatacatgtaacaaaattacccttgcaccccataaatttatccaagtaaaaagaaaaaaaaaaagaaaatccagcaatcaagatgttaatatgaaatcttccaacttaaatagtggcattggatgggtcacaaaaaacatgcacacaggattcctatggcctgcaggccagcagtttgaaaaatctgcaacagagagactaaaaaacagtgatgtaactccaaaacaattagggatgcagtatgctgaattctcatttattttagtcactaaggaggatctattcaagacaatacaatggtatacacaggagagacatatataaggctccttaaaaagtagaaggataatcagctggcttaaactgagacctagatcagcaagtcttaaagtagaatctacgaaaccctggaggtatctgagactttttttcagggaaactgcagagtcaaactattttcatttaaaaaattaaagtaagctgggagcggtggctcacgcctgtaatcccagcactttgggaggctgaggcaggcggatcatgaggtcaggagttcgagaccagcctggccaatatggtgaaaccccgtctatactaagaatacaaaaattagccaggcgtggtggcacgcacctgtagtctcagctactcgggaggctgaggcagtagaatagcttgaacccgggaggcggaggctgcagtgagccgacattgcaccactacactccagcctggacgacagagggagattccgtctcaaaacaaacaaacaaagaaacaaacaaaaaacccaaataaaacaactgacagtaggccgggcacagtggctcatgcctgtaatcacagcattttgggaggccgaggcaggtggatcacttgaggtcaagagtttgagaccagcctgaccaacacggtgaaacccgtctctaccaaaaaatacaaaaagccgggagtggtggcaggcacctgtaattccaactactcgagaggctgacacagaagaattgcttgaacccgggaggcggagcttgcagtgagccgagatcacgccactgcactccagcctgggcgacagagggaggctccgtctcacaaacaaacaaaaacacatgttcaacattactagtcattagggaagtgcaaatcctgagtacggagataccgcttcagaggacagccaacacttggttttttttttataatagtcatccattaagatatatacacacacataatggagtatgcggccaaaaaaggaaatggaatggacacgtgctagaacacgatggaccttcaagacactacgctgcgtgaaacagccagtcaccaaaggacagacactgtgtggggttccactcgtacgagacacctagagcaattaaacccgtagaggcagaaagaatggaggtcgccagcagccaggggaggggtgaatggggaattaattattgtttaatgggcagtttcaagcgtggaagatgagaaagttcagagatgaatggtggtgacggctgcacaaaaacatgaatgtacttcatgtcacgcaactgtccatttaaaaatggttaacatggcggattttatgttatgtatcttttacaataaaactggaaaaaaagtaaatcactttacacattagatacaataaaatagtagctaagaggctgggcacagtggctcatgcctgtaatcccagcactttggaaggctgaggcaggaggaccacttgagctcaggctatcaagaccagcctgggcaacatagcaagaccccatctttgttcaaaaaaattttttttaagtagctaatttaggaaaacaataataagacagatgtattatactagaaagcaaaacatatcattaagcagaattaaactaagcatgtgtggtactgacacagctactgataaagagatagttaaaaaataaaaagcccaggcaaggtgccatggctcatgcctgtaatcccggcactttgggaggtggaggcaggcggatcacttgaggtcaggagttcaaaaccagcctggccaacaaggcaaataaccctatgtctactaaaaatacaaaaattagccacgtgtggtggtgcacgcctgtaatcccagctactcaagaggctgagacaggagaatcgcttgaacccgagaggcagaggttgcagtgagccaagatcgcaccattgcactccagcctgggtgacagagagagactccatctcaaataaataaataaataaataaataaaataaataaatagccccaaattgctctggaaaataagcatatgattagtgaaatagtacgtatatcaatgtggctgtattactaccaagtagtgtggctattaagtggcaatcaagggcagggggagttaagatgcctacctcatacaatactcgaattcaaggtggattaaaaaatggaaaaaaacaaaactataaacgactaagaagaacatatgagataaattccaaaacaattaaaacttccatgtgatgaaagacatcacaaagttaaaaacaaactagaagttatttgcaaatacataaatcaccagagaattagtgtccagaatataactagaacttccacagatcaattaaaaaccacaacaggcaaaggaaaggcacgtgcgatttacagaagatgcccaactacagcaagcagagagctgaacttttgttaaaccgtggaatgacagatttttaaagtttacttatttctacataaactgaatctaaattaagatcagtgagttattcaactgcagacacaagttaaaattgtcttcatttgcctttttcttttgtttttggaaacaagatctcactcttgcccaggctggagttcagtggcgggatcatagctcactgcagcctccaaccccttggctgaagcgattctcctgccctagcctcctgaagcactgggataacaggtgtgagccactgcatccagtccatttgctatttctttttcttctttgacggagtttcgctcttgttgcccaggctggagtacaatggcgcaatctcaggtaactgcagcctccacctcccgggttcaagcaattctcctgcctcagcctcctgagtagctgggattacaggcatgtcccaccacgcccagctaattttttgtaattttagtagagacgggggttttaccatgttggccaggctggtcttgaactcctgacctcaggtgatccacctgccttccaaagtgccaggattacaggtgtgagccaccgtgcccagccttccatttgctatttctttctttttttaaatttatttttttttttttttgagacagagtctcactttgtcactcaggctgcagtgcagtggtgcaatctcagctcactgcagtgtccacctcccaggctcaagcaatgctactgcctgagcctcccatgtagctgagactacaggcgcccaccaccacacccggctaatttttgtattttttgtagacggttttgccctattggccaggctggtctcacactctcaggctcaagcgatttgcctgccttgaactctcaagtactgagattacaggtgtgagcccccgcacctggcctgtttgctatttcttaaacaactctaattttataagaaatttgaatatctcagttttatagtcttaaagtgactatacaatttttgccatctgttggaaacaactctcgacactcttcagttctggttaactctaaaatttctgctgaaacccacttcggttaaacattcctactctactcgatattttgcttcttcgcagcaagtggtcttcctaggcggccaggactcatttaaggaaatatgtccccatgctttttattttattttgaaggaaaaattcaagttagttaaagacctgaatgtataatactggatgaaaaataaaaataaataataagccttaacttgaacagttgagctgttcataaaactgccctcccatcactgaactagactgcagctccatgtaaatggcagtttccttctcccaattaaatgtgcattcctgggctgggcacagggtacaaaataaagagatagttaaaaaataaaaagcccaaagttgctctggaaaataagcatatgatttgtgaagcagtatgtacatcagtgtggctggatcatcaccaagtagtgtggctataaatggcaatcaggggcaaagtgctcacacctgtgatcccagcactttgcgaggatgaggcaggagtatcacttgagctcaggagttcaagaccagcctcggtaacatagtgagaccctatctctacaaaaaataaaaaaattagcctggcgtagtggtgtgtgcctgtggtcccagctactcaggaggttgaggtgggaggattgcttgagcccgggcggtggagggtacagtgagccaagatcgctccctggcattccagcctgggcgactaagtgagaccctgtctcgaaaataaaataacataaactaaatttgcactttctgcctcaatatttattttgaaaattttcaaatctacagaaattgcaaaaatagtatgataaacccccgtttaacctgcatttagattcatgaagtttttaaactgccacattgcctttcgtgtgtgtgtgtgtgtattttctgaaccatttgaaagttgcatgatcataacccttcaccaaatccttacgtgtccacctcataagagatgctgtccttatctcttgatttgatatacaatgatcaagttcaagaaaattaacattgatatattacccatcatatcaatgataaaaatttcaccaactatccccatgtctttaataacaacctttgtcctaatccatgttctaatccagggtcatgcactgcatttagctgtcattctcttttaatctccctttcaactagaatgattcctaaggctttgccttcatgacactgacatttttgaggtactaacaactacgttttgtagaatttcaatttgggtttttgttttctcacagttagattcaggttatgccttatactcgtcctatcaggaggaccgcaatgtttgtttgttccatggataacgttaactgtgatcacttcattactgtggtaacaggcttctcgactgtatccttcaccctttgtaattaataagcaatctgtaagatgatattttcagactatatgagtcctccgttctccggcaaattttcaagcagggattttggcatccgtttgtaattcttgcctgcatcaatttttacagtgacagtcgcaaacagaaaggaaatttagacattctaaggctgattcttccctactataggattcttttttgagaaatccaaatgtaaaacacacctgtctccgtcacactaattcactttcaaatacttcattttttaaagctatctcatatgtgctttcttacaaccttccttccataaattaaaaatacataaagtaaatgagtagattcactttatgtattatgtgttaacaaagttaacacagaaacaccaattatatttttataaattatcaatgaacaatactgaaaattttttaaaatttacttaaaacagtctcaaaagccataatataattagggataaatattagtttcttagggccaccatagaaaagtaccacaaattgcgtgacttgaaaatacagcaatttattttctcacagttctggctaaaagtccaaaataaatgtgtcagcagggccatgacacttttcaaacttgtaggggatccttccttgcctcttccttgcttctgacagtatgctgataaccttagacgttccttgggttgtaaatacatcactccagtcctccagcctcacgtggtactctgtgtctttacatcatcttccttctgtgcgtgtctgtctctgtgtccaaatttctcctttttataaggaaaccagtcataatggattagggcccattctaatgaccttattttaacttcattactgaaaaaaattgaaggtgacctacacaaacagagaaatatactattttcatggatacaaggactctgttgctgtttggatgtcaattctccccaaattgttctattaagttcaatgcaaccccaatcaaactcctaacaggctgttagtagaaactggtaagttgattgaaaaatttaaataggctgggtgtggcggttcaggcctgtaattccagcacttcaggaggctgagacgggaggactgcttgaggtgagctgttcaagaccagcctgggcagcatagcaaaaccccgtctctacatacaaagaataaatatacggaggacgggcacgatggctcacgcctgtaatcccagcactttggaaggtcgaggcaggagtatcatctgaggtcaagagttcgagaccagcctggccaatgtggtgaaactcccgtctctattaaaaatacaaaaattagccaggcatggtggtacatgcctgtaatcgcagctactcaggaggctgaggaaggagaactgcttgaacctgggaggcagaggatgtagtgagctgagatcacgccactgcactccagcctaggcaacagagcaagactctgtctcaaaaagaaaaaaaaagatttactctaaagtcacagtaatcaagacagtgtgacactaatattagaatcaacggatcaatgaaatagaatagacccacattattttttttaaaaagtcttttcaacaaaaggtacagaaataactgatacccatatgggaaaaagttaacctcaaccccctaacttatacaatattcaaaattaatttgaaatggatcaaagacctaaacataaaagttaaaactggccagacacagtggctcacacctgtaatcctcgcactttgggaggccaaggcaggcggatcacgaggtcaggacttcaagaccagcctggccaacatggtgaagccccatctctacaaaaaatacaaaaattagccaggcatggtggtgcgtgcctgtagtcccagctactcaggaggctgagggaggagaatcgcttgaacctgggaggtggaggttgcagtgagccatcacgccactgcactccagcctgggcgacacaacgaaattcagtctccaaaaaaaaaaggtaaaactataaatcttttagaaaaaaaaatagcaatatcttagcctgaaggtagctaaaggtttcttagaccataaaaagcaataaactataaaaggaaaaatttatgagacttcatgaaaattaagaatttcagctcgtcaaaacaattaagaatatctggcaaagtaccagtattcaaaatacataaataatgtctacaactgaatataaacaatttaggggaaaaagaattaaacagacactttacaatggaagagggcaaaactgtcaataagcacatgaaaaagaacactatcattagttacctggaaattgaaattaaaacaagatactactatcaatacaaatcaactggaatggttaaatctaaaaagacagataacatcaaaagttggtaagatgtacggcaaccagaacctgtatgctgttggtgggattacaaaatgacacaaccactttcgaaaaagatctggtagtttcttctttctttttttgagatggagtctcactctgtcaccgaggctagagtgcagtggcgcgatctaggctcactgcaacctctgcctcctgggttcaagcaattctctgcctcagcctcccgagtggctggtattacaggtgcccgccaccacacccggctaatttttgtatttttagtagatggggtttcagcatcttggccaggctggtcttgaactcctgaccttgtgatccacccgcctcggcctcccaaagtgcgtgagccaccatgcctggcaggtagtttcttataaaaatatgtacctattctacgttgcgtaattccagctcctaagtatttaaccaaaaaaaccctgaaaacataaggccacacatacacacacagagacacaaaaacttgcacaagaaccttctcagcaactttattcataatatccaaaactgcaagcaactgaagcactgtatcagtggagaatggccaatcatatacagcatagtcaatggtggaataatacttaaaaaacgaatatctacacaagaataaatcttgaggccaggcgcggtggctcatgcctgtaatcccagcactttgggaggccgaggcgggtggatcacctgaggtcaggagttcgacaccaggctgggcaacatggtgaaaccccatctctactaaaaatacaaaaattagccaggcatggtggtgcgtgcctgtaatcccagctacttaggaggctgaggcaggagaatcacttgaacccaggagacggaggttgcagtgagccgagatcctgtcactgcattccagactgggtgacagaacaagactgtctcaaaaaaaaaaaaagaataaatcttgaaccttatgctgaataaccccccaaaagatatgcttaagtcctaactcccagtaactaagaatgtggtcttaactggaaacaggttgttacagatataatggagttcatacaaagagtacagagcctttaatccaatataactagtgtcctggtaaaaaaaaaagagagagacacagaggagacggccatgtaaagacagacacaccgggaaactctacgtgccaatggaggcagagactggagtgactcagctgcaaaccaggaacaccatggattccagccacaccagaagctaaggagaagggcacggaacagattctctcccagagccttcaatgtacatgtccctgctccctgctagcatcttgggtttggagttctactcttcagaactgagggagaataaatttctgctaagttcgtggtactttgttacagtagccctaggaaataaaaagaattccatttatatgaagttccagaacagaaaaaactcatctatggtggataaaaactaaaacagcccggacgcggtggctcacgcttgtaatcccagcacttttggaggccaagacaggtggatcacgaggtcaagagattgagaccatcctgaccaacacagcaaaaccccatctctactaacaatacaaaaattagttgggtgtggtgtcgcatgcctgtaatcccagctactcaggaggctgaggcaggagaatgcccacaactcaaaaaaacaacctgattaaatgacaggcaaagttgtggctttttctgggttttgggagaaaaacagaaacaaaaagaatgaatgagcacaggatttgaatagatatttcatatttttccgaagatgatatacaaatggccaataaatgcatgcaaagatgctcgccatccttagtcattggggacatgcaaataaaaaccacaatgggataccacctcatactcaccaggatggctactatcaaaacccagaaaatagcaagtgttggcgagggtgcagagaaactggacacccacgcactgttggtgggaatgtaaaacggtacagtcactgtggaaaacagtatggcggtttccaaaaccaatcacacatagaattaccataggatctagaaattccacttccaggtatacacccaaaagaatagaaaacaggcccctgaacagacatttgtacacccaagttcacaccagcattatttctaatagccgagaagtggaagcaagccaagtgtccactgacagaggaacagatttcttttaatgtagcatatacatacactggaacattattcagcctggaaaagaagggaatgctgtcacatgcagtatggatgaacctggaaaacattacgctaggtaaaacaggccagacacaaaaggacaaaacctatgaaaattccacttacaggaggtacctagaagcagtcgggttcacagaaatggaaaggagaacggtggttgccaggggatagtaggagggaggaacggtgagcctcaagggtgtggaaattcagtttgggaggattaaaaagttctggagatggacggtggtgacggatgcacagcagtgtgaacggaggcgatgccactgaaccatacaattacaaacggttaaaattttcctcccttctttctagtcaaaaacatttttaagtggttaaaatggtaatcttgctatattttaccacaattttttttttttgaaacggagtctcgctctgtctcccaggctggagtgcggtggcgtgatctcggctcactgcaagctccgcctcccgggttcacgccattctccggcctcagcctcccgagtagctgggactacaggcgcgtgccaacatgcccggctaattttttgtatttttagtagagagggggtttcaccgtgttagccaggatggtctcgatctcctgacctcgtgatccgcccgcctcggcctcccaaagtgctgggattacaggcgtgagccgccgcgcccggccccgcaattttttgacacacagagttaagataccagttcacatgtactagcatggcacggaaaataacaagtgttggtgaggaagtgaagaaactggaaacttcgtactctgctaatggaaatgtaaaatggtacagccactgtagaaatcaatgtggcagttcctcaaaaagctaaacacagaattaccataggatccagcaattccactcgtagatatatagacaaaagaactgaacacaggtattcaaacacatactggtacataaatgttcgtatcgccagtattcaaataacgaaaaggtgaaaaaaaccaatgtccagccaatggataaacaaaatgtaacaagtatatccgtaaaacaaattattattcagcccgaaaaatgaagtactgatccatgccacactgtacatgaacctcagaaacacgctaagtgaaataagctagacacacaagatcctatattgcatgagtcccttctatgaaatacctagaatggccagattcatagagacagaaagtggaatagaaggtgccgaggctggggggaaaggtgaaatggggagtcagtgcctcacggttagagtttatctggggtgatgaaaagttctggaaacagtggtgatggttacattgtgaatgtaattaatgctattgaattgtacttaaaaatggttaaaatgtcagtttgttatatacattttggacaatattttaaaaataacgcaatataccaaaaaccattaaattgcacacttttaaacattttactgaatttatgttacccagaccggcctcaactcctgggttcaagagatcctcccacctccgcctcccaaagcgctgggattacagctgtgagccatcgctcccggccaaccgcacacttttagtaggtgaattgtatggtctgcgagcatttgaataaagctttttcttttaactattgtttaaaaatgtttaaaatggcatttttttacaataaaataaacgtatgtttaaaaggcaggtacacatataactgtgaccaaaaaaaattagaaaaaaaaaaaaaaaaaaaaaaaaaaagacctgtccacgagagaacggagacaccatatcctaagcccagacaggaaccaccgcccggcttattgctcacattagtggaggaaagagtcaagggttcagtttggggctcctgagtctaccgggtgcagggttgagtgataaaaaagcgactttagcctcgtcgcatgattaggagaatcaagaattaaatgaatggagatgtatagataagtaaatcagaggccgggcgcggtggctcaagcctgtaatcccagcattttggcaggccgaggcgggcggatcccttgaggtcaggagtttgagatcagcctggccaacatggtgaaatcccgtctctactaaaaaacagaaaaattccccgggcgtgatggtgcacgcgtgtaaccccagctactcgggaggctgaggcaggagaatcgcttgaaaccgggaggcggaggttgcagggagccgagatcgcgccactgcactccagcctggaggacggagcgagatcctgtctcaaaaaaaaaaaaaagaaggctccagacgggcaattctttaatttttaacacaacaaacacccatcgaacacagcgcgggcattttgacaatggacaaaatcttgcccttgactttataatccatcgacatttggggacccataaaccccctaacctctgagaactatttagacaaatactagtcgggttttttggtttgtttttactttttaaatggaaaagtgatgattcaccttttcaaagacttgcggcttttggccaacaaacacgccatggtttactcacccacttcctctgattcttggccagacgctctaagcttgcactccctgggatagtgtttttgaattatcgtccacagttccacgttgacgagagaatttcttcgggtatggtaccgagtccacgacgatacccggcggcgacagaagggacagcataaactcgccttttcgacggtcgactggaagcacggtttacacagcgtgtggttacacgggagggtgacgggctccacgaggatttccatgcagatcccgcactggcactcggacagcgaggggatggcgtctttgggtagagccatttcaatatgttagtaaagccgactaaacaacgacacctgcacgaaaaagaatcctattttcggccaaccacagagagagcaaaagcagttttgtgtttcagtattatgcccagaagcgtatcagaattcggagaacaggagcatccaacacgtcttgaagcaaaaaggcgctctcagggtcaggcaaacaggaataccccggagggcggcgtctttgtccattttcaaggcaaacgtcccgccagcaaataaatgcaggttttcgtcggaggagcctggctgctccgcggcatgaacaccgcggctgcggctcccggggcagcgaggggaacgcgccaagtcctctcctcccctcacccggaaaggatgctccgctcagctcggggcagccgggccccgggacgcggctccgggaggaagcccgggctccggctgcagcataacttccgctttaccgctgctgcgggggagacgcgcgactcccgtgttcacctttcgggcgcctggcgcagtttcccagagctccgcgcccccgtccctcctacgcagccagaaaccctattcgttgcggcagcgcagcagccaccggacaagc

SEQ ID NO: 1856 - DNA, 8489 bp, Homo sapiens
gtgagtaaggcaaagtagaatttattgagtgacagaacggctcttggcagtgagaggggacccgaaggtgggttgctggccacgagcctgagtctatgggtttttgtgggctagaaatgggcaagtgcatgctgattggtctgtggctatgcttgacaaagcaccattcagaaataggcacgatagtgtagaggaccaatcgcggaagggtaggtatgtataaaataggtgaagggtaaggaccaatcaggagagagggtgccagacgagaatgggagctctcagtctggctcatggatttatccagaactcatagcttggttttcaggctttagactgtccttggcttgaaggttgagtttcaccagggacccctccctgtctgcctaggaatttacctgcctcctattgctatcactgtgttgcccaggctggtctgaaacccctgagctcaagtgatcctcctaccttggcctcctaaggtgcttggattataggcatgagccaccatgtccggccttgtttattttttaaataggtaatacattcacatggttcaaaattgaaaatgtaaaaaatggattaacagtgaaaagacttcctcttgtctttgacccctagcctcttagctttctttcctgacaactaatgttatcactgtcttgtgtatctctgcagaagaagtttatggatatgtaaactaatatgtgttatatatatatttatatatatatatttgtcaccttttttccacttagcaatgtatattggaaataaacatttgaaaacaacaatacatttggtgatcacttcatatcattacacaaagagcttcttcattcttttatatggctgcaaagaaagtatctattgtatcaatttgtcataatttatttaacatcctctcactctttgctataaaaataagactataataaattgtgcatactttttgctgtttccaagataaattactgtaggtggaatcactgggtcatagggtaacaggttagtttttgacagatggtatcaactcttcgagggatgacttttgcttttcaggggtcctaactgctttccccttctcaattacctgcacagccctcagcaaactgtcctgcagagcctggttctttaccatgttagtaattaggaacgtgacatccctgatgtacatctgcctcactttagcagtatagtgttctgccttgttaccacgtgcaataaagaaggtacaaagtgctgtgatgtctccttcttgcagcccacactcctccagtatggactcccatacaactctaacgcgcttgttcttaacttttcttctgagtacagaggctaaggttggaagacctctcaccaggtctggcagcttctcaagcacacgagtatgcaagcagataagtacttcaatgacgtagctgtataaaatattcaattccattgaagtgagcctacaaaaaatatggagagcttcttaagcggtcaaaaatattttatatagaaacagaaaatgaattcttttaggataactcaatatgaacccactaggagaaccagctgttgtaatttagaaaatatttactttagaatttaaattcaaattcaaatacttacattttatttttttttaagagacagggtctcactttgttgcccaggctgttctcaaactcctgagctcaagtgatcctgtcgcctcggcttcccagagtgctgggattaaaggcgtgagccatcatgcccagccagtactcactttagaattaatgcagataggctgggcgtggtgctcacgcctgtaatcccagcactgtgggaggacgaggtggttggatcacctgaggtcaggagtttgagaccagcctggccaacatggtgaaaccccgtctctactaaaaatacaaaaattagctgggcatggtggcgggcgcctgtaatcccagctactcgggaggctgaggcaggagaatggcgtgaacccaggaagtggagcttgcagggagccaagattgccccactgcactccagcctgggtgacagagtgagactccatctcaaaaaaaaaaaaaaaaagaaaaaaaaattaatgcaaataaggctttggcaagcaagagactttgtgatgagatgtgtactatagtgcctggcatataaagagatgctcaaattaatcttttttttttctttgagacggagtctcgctttgtcacccaggctggagtgcagtggtgagatctcggctcactgcaagctccgcctcccgggttcacgccattctcctgcctcagcctcccgagtagttgggactacaggtgcctgccaccacacccggctaatttttttttttttttttttttgtatttttagtagaggcagggtttcactgtgtcagccagggtggtctcgatctcctgacctcgtgatccgcccgcctcggcctcccaaagtgctgggattacaggtgtgagccactgtgcccggccaaattaatctttttttaaaaaaataaatgaacctaagaaaatgtaattgctttacaatccattgtgggaaacatactaagaaattcaattttgcaatgaccagtggaagctctcacaaagccacagaatcccactgatttctcaattgatactcactggagtgcccgaactgctgtccacatctcatcttgggctgcttggcttgccaaagccttactatgatgttcgaatttctgcatcaggttatccttggtgaagtctagttctttgaactgtgtttctaacgcttggagtttgtggtctactctgtaggataacagaatcaagggttagtttaggttacaggacaaaactaaggttttgatttaagctgaggctctaatacattatttacaaccattaccaaatttggataacttttttttttttacttttactttaaactatgaagggaaaatgggtagctatttgaatttgaaagtttcaacaaatggctccatttgccattccctctagccatcatccttgtcctttcattccatatattgcaaacttttgaattgtctaattatttgaattgcctgtcgtgtcttgtttttgtattataccttatactttatgtatttatttattttctaatacagagtctcactctgtcacccaaaccggagtgcagtggcacaatcactacctcccaggctcaagtgatcttcccacctcagcctcccgagtagctaggactacagttgtgtgccaccatacctggctaatttttaaaaaatattttttgtagagaccaggtattgctatgtttggctggtcttcaacacctgggctccagtgatccacctgtcttagcctcccaaagtactgggattacagccatgagccaccatgcccgggctataccttacgatttagagaatattttatgtaagcattactttggtgttcacagcaaccataaaaagtaaagcagtcatttttactattttactattaaagaaattgagtctcaagaggattgagacctaatgtcataaagttagctagtgctgagaccagtatataatctggatctcctcggcaggaaagtcaagggccttcaccctttgctcctatcttccgccagtcccctcacccatcctagtcaccaattacatgagacatctagttgctgcttgaatacattatgtggttccaagcttacatatggcttataccctattttctacccgattctaattgtccaactcttatcctttcttccagaatcagctcaaatccactgcctttttgaatccccatctacctggtgatctccttgcccccctgcgtctcgcttacaagcactgcctctgtggacccatctcccgcctcctgctttactattagggttagcctttcatgaactaaactacgttcttggagggaaggaatcagagactatttcttagatacctttatgtctgtcccccaatacccagcaaaggtcttgcacagtaataaaagtttccctgtatgattgacatctttgatgagaatgaaatgctgagttctgtaacccaaaatggggatttgagtagctccgaacagccatgatcatcagaggctgctgtggcaccagcattatgtctaattaaccacaaagactggagcaacacaattcacttgcctgagccacctagattgtccttatgagggaaacttgcctgggccacctagattgtcattatgagggaaatttgcctgggccacctagattgtctttatgagggaaacttgcctgagccacctagattgtccttatgagggaaacctgcctgggccacctagattgtctttatgagggaaacttgcctgagccacctagattgtccttatgagggaaacctgcctgggccacctagattgtccttatgagggaaacttgcctgggccacctagattgtctttatgagggaaacttgcctgcgccaagtagattgttgttatgagggaaacctgcctgggccacctagattgtccttatgagggaaacctgcctgggccacctagattgtccttatgagggaaacctgcctgagccacctagattctcattatgagggaaacctgcctgggccacctagattgtccttatgagggaaacctgcctgggccacctagattgtccttatgagggaaacctgcctgggccacctagattgtccttatgagggaaacctgcctgggccacctagattgtccttatgagggaaacctgcctgggccgcctagattgtccttatgagggaaacctgcctgggccgcctagattgtccttatgagggaaacctgcctgggccgcctagattgtccttatgagggaaacctgcctgggccgcctagattgtccttatgagggaaacctgcctgggccgcctagattgtcgttatgagggaaacctgcctgggccgcctagattgttgttatgagggaaacctgcctgggctgcctagattgtctttatgagggaaacttgcctgcgccaagtagattgttgttatgagggaaacctgcctgggccacctagattgtccttatgagggaaacttgcctgagccacctagattgttgttatgagggaaacctgcctcggccacctacattgtccttatgagggaaacttgcctgggctgcctagattgtccttatgagggaaacctgcctgggccacctagattgtcgttatgagggaaacctgcctgagccacctagattgtggttatgagggaaacttgcctgagccatgtagattgtggttatgagggaaacttgcctgggccgcctagattgtggttatgagagaaacttgcctgggccgcctagattgtcgttatgagggaaacttgcctgggccaagtagattgttgttatgagggaaacatgcctgggccacctagattgtcgttatgagggaagtgatgcgtcaacacacatgctacttctctgagcttccgtatctccagtgacctgaatacctttgtgactgcccagcattctatgcttgatcatcttttattcttggtcctaaatttctccctaggctaattcaccttcaggtactacatctctcctaagctttaaacctgtatttcctttctttttttttttttttttttttgagatggagtcttgctctgtcgccaggctggagtacagtggcacgatcctggctcactgcaacctctgtctcccaggttcaagtgattctcctgcctcagtctcccgagtagctgggattacaggcgccaccacatccggctaatttttgtatttttagtagagatggggtttcaccatgttggccaggctggtctcgaactcctgacctcaggcgatccgcccacctcggcctcccaaagttctgggattacaggcgtgagccaccgcacccggcctagagatgtattttcaatatgttttgtgcatctccacaaagatggagatgtcaaactcaactctcctaagcttaacctactaatacctcccccatcttcagaaattactatgaagaaatgttgtcactgctttacacatagataagactcagtataaaatgttcattttgtaggaatagaagcctgtgtgacctgatatgcctgtaatttctgtctacaagtcaaaaccatgtgatttgagctaggtgcagtggctcacaactgtaatcacagcagtttgggaggccaaggtgggtggatcacttgagtccaggagtttgagaccagcttgggcaacatagtgagacctcatctctacaaaaaataaaaaattagcctagtgtggtggtgtgcacacttgtggtcccagctactggggaagctgaggtatgagaattgcttcagcccaggagttcaaagctgcagtgagctgtgatcatgccactgcactcagcttgagcaacacagcaagaccctgtgtcaaaaaaaaaaaaagaaagttggccgggtgcagtggctcacgcctgtaatcccagccatttgggaggccaaggcaggtggatcatgaggtcaagagatcgagaccatcctggccaacatggtaaaaccccttctttactaaaaatacaaaaattagccgggtgtggtgatgcacacctgtagtcccagttactcaggaggctgaggcaggagaatcacttgaacctgggaggcggaggttgcagtgagctgaaatcgcgccactgcactccagcctggtgacagagtgagactctgtctcaaaaaaaaaaaaaaaaaaaaagccatttggcatactattttgtgttaacttttagacctttaagactatattgcttataggtcatctgtagtttgaaacttagggaagaagtctagcttgtcaatcagtataaaaatttacagttgcagcagttctttggaatcctctcaccaaaggacagtccgaggccgttccagataaatctcaaccaacatgcaaatctcagcgcaggctgttttgttttgttttagtacagttccctagtttcgttaatgacctcaccatccaatcaattgcttgaactagaaatctcagaataattctcaacttttttcttcccctgatttatgtctctctaacccattcctgcctctccatctccatcaaatgagtttctcatcatctttcactaggacccaagattaccgtagcctaactggacccccgttttccatttcccatccatcctccagacacattcttctaaaacacaattccgattctgtgactcaactgattacaaatggtttatgtcatcctggcttgcccagtgatatactcagaggcaaactggatctcctcagcaggaaagtcaagggccttcaccctttgctcctgtcttccaccagtcccctcacccatcctagttaccaattacacgagacatctagttgctgcttgaatacattatgtggttccaagcttacatatggcttatatgcactgtttcctcagcctagaatgccttcccatatttttctccctcataagctcctacttgcactttaagatccagcttaaatgaccctatatgaagagttcctttttctagtgtcaaaggcaaaattggttgatcctcccttcatgttcgcatagacctttaggaacatcaccattgtaaggtcagtcacattaaattgtaaatgtttttcaaacttttctctttcctacaggctgtgagctccttgagggcagaaaccacattttacttatttttgtaaatctaggatttagcatatgcatacattcaatggagttacagcacctgggagcagacttttctttattgttaatttacataggtttgggcctggaagacttaaaccactgtaatagagacggaattctttttttggacggagtcttgctctgttgccaggctggagtgcagtggcacgatctcggctcactgcaacctccacctcccgggttcaagtgattctcctgcctcagcctcccaagtagctgggactacaggcgcccgccaccatgcctgggtaatttttgtatttttagtagaggcagggtttcaccatgttcgccaggctggtctcaatctcttgaccctgtgatccgcccacctcggcctcccagtgtgctgggattacaggtgtgagccaccgcaccggccacagagacagaattctaatgagcatgtctgcagttctttatttctattcttcattcttctcttacccatcttcccagaatagcagacccatgcttgctccctccctatagccctcagcaaccttttcattgcctccttcaaggatatcagggttgtggtttcattgttcatcttctgaaggcaaaaggaaagaaaacaaaaacaaagcaaaacaaaaaaagcaataaatgtttgaatccagaattttctgcggtcttcctctcagcaacaggcagcagtagcaggagcgctcagtctacattctgcctgaaaggtcactcagtacaag

SEQ ID NO: 1857 - DNA, 940 bp, Homo sapiens
catggaaaatgggagctatacctcttatttcattctcctaggactctttaaccacaccagagcccaccaagtcctcttcatgatggttctgagtatcgttttgacctccctgtttggcaattccctcatgattctcctgattcactgggaccaccggctccacacgcccatgtacttcctcctgagccaactttccctcatggacgtgatgctggtttccaccactgtgcccaaaatggcggctgactacttgaccggaagtaaggccatctcccgcgctggctgtggtgcgcagatcttcttcctccccacactgggtggtggagagtgcttcctcttagcagccatggcctatgaccgctatgcggctgtctgccacccactccgatatcccactctcatgagctggcagctgtgcctgaggatgaacctgtcgtgttggctcctgggtgcagctgacgggctcctgcaggctgttgctaccctgagcttcccatattgcggtgcacacgagatcgatcacttcttctgcgagacccccgtgctggtgcgtttggcttgtgctgacacttcagtcttcgaaaacgccatgtacatctgctgtgtgttaatgctcctggtccccttttccctcatcctgtcctcctatggtctcatcctcgctgctgttctgcacatgcgctctacagaagcccgcaagaaggcctttgccacctgctcttcacatgtggctgtggtgggactcttttatggagctgccatttttacctatatgagacccaaatcccacaggtccactaaccacgacaaggttgtgtcagccttctatactatgttcacccctttactaaaccccctcatctacagtgtgaagaacagtgaggtgaagggagccctgacaaggtgtatgggtcggtgtgtggccttaagtcgtgaataa
